United States Patent 11,976,277 (PARTICLE DELIVERY SYSTEMS) - sequence listing, part 2

SEQ ID NO: 1604 - DNA, 4728 bp, synthetic construct
  misc_feature 1..4728: note = pXDP328 sequence
  source 1..4728: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctcccccgccgcgaagcgagtgaaactggacggaggttcaccagcggccaaacgggtcaagctggatggcgggtctcctgcagcgaaacgggtcaagctcgacggaggttcccccgccgctaaaagggtaaaactggatggcggtagtcccgcagcgaagagggtgaagctcgacggtggaagccccgcagctaaaagggtgaagctggattaa

SEQ ID NO: 1605 - DNA, 4638 bp, synthetic construct
  misc_feature 1..4638: note = pXDP329 sequence
  source 1..4638: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggactctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctcccccgccgcgaagcgagtgaaactgggaggttcaccagcggccaaacgggtcaagctgggcgggtctcctaaaaagaagagaaaggtcggaggttccccgaaaaagaaacggaaggtttaa

SEQ ID NO: 1606 - DNA, 4770 bp, synthetic construct
  misc_feature 1..4770: note = pXDP333 sequence
  source 1..4770: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggcccccaagaagaaaagaaaagttggcggaagccccaagaagaagagaaaagtcggcggtagccctaagaaaaagcggaaagtcggaggcagtccaaaaaagaagaggaaagtgggcgggtctcccaaaaagaagaggaaagtcggcggtagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaagggaggttcaaaaaggccagcagccacaaagaaagctggacaagctaagaagaaaaagtaa

SEQ ID NO: 1607 - DNA, 4806 bp, synthetic construct
  misc_feature 1..4806: note = pXDP334 sequence
  source 1..4806: mol_type = other DNA
gccaccatgggtgcgagagcgtcagtattaagcgggggagaattagatcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaaaaaagcacagcaagcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaagatttaaacaccatgctaaacacagtggggggacatcaagcagccatgcaaatgttaaaagagaccatcaatgaggaagctgcagaatgggatagagtgcatccagtgcatgcagggcctattgcaccaggccagatgagagaaccaaggggaagtgacatagcaggaactactagtacccttcaggaacaaataggatggatgacacataatccacctatcccagtaggagaaatctataaaagatggataatcctgggattaaataaaatagtaagaatgtatagccctaccagcattctggacataagacaaggaccaaaggaaccctttagagactatgtagaccgattctataaaactctaagagccgagcaagcttcacaagaggtaaaaaattggatgacagaaaccttgttggtccaaaatgcgaacccagattgtaagactattttaaaagcattgggaccaggagcgacactagaagaaatgatgacagcatgtcagggagtggggggacccggccataaagcaagagttttggctgaagcaatgagccaagtaacaaatccagctaccataatgatacagaaaggcaattttaggaaccaaagaaagactgttaagtgtttcaattgtggcaaagaagggcacatagccaaaaattgcagggcccctaggaaaaagggctgttggaaatgtggaaaggaaggacaccaaatgaaagattgtactgagagacaggctaattttttagggaagatctggccttcccacaagggaaggccagggaattttcttcagagcagaccagagccaacagccccaccagaagagagcttcaggtttggggaagagacaacaactccctctcagaagcaggagccgatagacaaggaactgtatcctttagcttccctcagatcactctttggcagcgacccctcgtcacaaaactttagccagaactatccgattgtgcaggcggccgcggccccagcggccaaacgggtgaagctggacggcgggtcccccgcagccaagagggtgaaactggatggaggctccccagccgcaaagcgggtcaagctggacggagggtcccccgccgctaagcgggtcaaactggatggaggcagtcctgcggctaaacgggtcaaactggacggcggtagcccggccgcaaagagggtgaagcttgattctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaagggaggttcaaaaaggccagcagccacaaagaaagctggacaagctaagaagaaaaagtaa

SEQ ID NO: 1608 - DNA, 2413 bp, synthetic construct; identical to SEQ ID NO: 1048
  misc_feature 1..2413: note = pSG005 sequence
  source 1..2413: mol_type = other DNA

SEQ ID NO: 1609 - DNA, 2465 bp, synthetic construct; identical to SEQ ID NO: 1153
  misc_feature 1..2465: note = pSG17 sequence
  source 1..2465: mol_type = other DNA

SEQ ID NO: 1610 - DNA, 4563 bp, synthetic construct; identical to SEQ ID NO: 1144
  misc_feature 1..4563: note = pXDP175 sequence
  source 1..4563: mol_type = other DNA

SEQ ID NO: 1611 - protein, 1017 aa, synthetic construct
  REGION 1..1017: note = pXDP112 sequence
PKKKRKVGGSPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVALEYPYDVPDYA

SEQ ID NO: 1612 - protein, 1037 aa, synthetic construct
  REGION 1..1037: note = pXDP114 sequence
PKKKRKVGGSPKKKRKVGGSPKKKRKVGGSPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVALEYPYDVPDYA

SEQ ID NO: 1613 - protein, 1057 aa, synthetic construct
  REGION 1..1057: note = pXDP116 sequence
PKKKRKVGGSPKKKRKVGGSPKKKRKVGGSPKKKRKVGGSPKKKRKVGGSPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVALEYPYDVPDYA

SEQ ID NO: 1614 - protein, 1021 aa, synthetic construct
  REGION 1..1021: note = pXDP111 sequence
PAAKRVKLDGGSPAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVALEYPYDVPDYA

SEQ ID NO: 1615 - protein, 1045 aa, synthetic construct
  REGION 1..1045: note = pXDP113 sequence
PAAKRVKLDGGSPAAKRVKLDGGSPAAKRVKLDGGSPAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVALEYPYDVPDYA

SEQ ID NO: 1616 - protein, 1069 aa, synthetic construct
  REGION 1..1069: note = pXDP115 sequence
PAAKRVKLDGGSPAAKRVKLDGGSPAAKRVKLDGGSPAAKRVKLDGGSPAAKRVKLDGGSPAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTSPKKKRKVALEYPYDVPDYA

SEQ ID NO: 1617 - protein, 1032 aa, synthetic construct
  REGION 1..1032: note = pXDP219 sequence
KRPAATKKAGQAKKKKSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLESKRPAATKKAGQAKKKKAPGEYPYDVPDYA

SEQ ID NO: 1618 - protein, 1022 aa, synthetic construct
  REGION 1..1022: note = pXDP220 sequence
KRPAATKKAGQAKKKKSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSKRPAATKKAGQAKKKKYPYDVPDYA

SEQ ID NO: 1619 - protein, 1070 aa, synthetic construct
  REGION 1..1070: note = pXDP223 sequence
KRPAATKKAGQAKKKKGGSKRPAATKKAGQAKKKKSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLESKRPAATKKAGQAKKKKGGSKRPAATKKAGQAKKKKAPGEYPYDVPDYA

SEQ ID NO: 1620 - protein, 1133 aa, synthetic construct
  REGION 1..1133: note = pXDP224 sequence
KRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLESKRPAATKKAGQAKKKKGGSKRPAATKKAGQAKKKKGGSKRPAATKKAGQAKKKKGGSKRPAATKKAGQAKKKK

SEQ ID NO: 1621 - protein, 1209 aa, synthetic construct
  REGION 1..1209: note = pXDP225 sequence
KRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKK

SEQ ID NO: 1622 - protein, 1061 aa, synthetic construct
  REGION 1..1061: note = pXDP226 sequence
PKKKRKVGGSPKKKRKVGGSPKKKRKVGGSPKKKRKVSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLESPKKKRKVGGSPKKKRKVGGSPKKKRKVGGSPKKKRKV

SEQ ID NO: 1623 - protein, 1061 aa, synthetic construct; identical to SEQ ID NO: 1622
  REGION 1..1061: note = pXDP227 sequence

SEQ ID NO: 1624 - protein, 1077 aa, synthetic construct
  REGION 1..1077: note = pXDP228 sequence
PAAKRVKLDGGSPAAKRVKLDGGSPAAKRVKLDGGSPAAKRVKLDSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLESPAAKRVKLDGGSPAAKRVKLDGGSPAAKRVKLDGGSPAAKRVKLD

SEQ ID NO: 1625 - protein, 1125 aa, synthetic construct
  REGION 1..1125: note = pXDP229 sequence
PAAKRVKLDGGSPAAKRVKLDGGSPAAKRVKLDGGSPAAKRVKLDGGSPAAKRVKLDGGSPAAKRVKLDSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLESPAAKRVKLDGGSPAAKRVKLDGGSPAAKRVKLDGGSPAAKRVKLDGGSPAAKRVKLDGGSPAAKRVKLD

SEQ ID NO: 1626 - protein, 1019 aa, synthetic construct
  REGION 1..1019: note = pXDP230 sequence
KRPAATKKAGQAKKKKSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLESKRPAATKKAGQAKKKK

SEQ ID NO: 1627 - protein, 1057 aa, synthetic construct
  REGION 1..1057: note = pXDP231 sequence
KRPAATKKAGQAKKKKGGSKRPAATKKAGQAKKKKSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLESKRPAATKKAGQAKKKKGGSKRPAATKKAGQAKKKK

SEQ ID NO: 1628 - protein, 1028 aa, synthetic construct
  REGION 1..1028: note = pXDP237 sequence
PAAKRVKLDGGKRTADGSEFESPKKKRKVGGSSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEGGSPKKKRKV

SEQ ID NO: 1629 - protein, 1030 aa, synthetic construct
  REGION 1..1030: note = pXDP238 sequence
PAAKRVKLDGGKRTADGSEFESPKKKRKVPPPPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEGGSPKKKRKV

SEQ ID NO: 1630 - protein, 1035 aa, synthetic construct
  REGION 1..1035: note = pXDP239 sequence
PAAKRVKLDGGKRTADGSEFESPKKKRKVGIHGVPAAPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEGGSPKKKRKV

SEQ ID NO: 1631 - protein, 1035 aa, synthetic construct
  REGION 1..1035: note = pXDP240 sequence
PAAKRVKLDGGKRTADGSEFESPKKKRKVGGGSGGGSPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEGGSPKKKRKV

SEQ ID NO: 1632 - protein, 1036 aa, synthetic construct
  REGION 1..1036: note = pXDP241 sequence
PAAKRVKLDGGKRTADGSEFESPKKKRKVPGGGSGGGSPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEGGSPKKKRKV

SEQ ID NO: 1633 - protein, 1044 aa, synthetic construct
  REGION 1..1044: note = pXDP242 sequence
PAAKRVKLDGGKRTADGSEFESPKKKRKVAEAAAKEAAAKEAAAKAPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEGGSPKKKRKV

SEQ ID NO: 1634 - protein, 1027 aa, synthetic construct
  REGION 1..1027: note = pXDP243 sequence
PAAKRVKLDGGKRTADGSEFESPKKKRKVPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEGGSPKKKRKV

SEQ ID NO: 1635 - protein, 1018 aa, synthetic construct
  REGION 1..1018: note = pXDP244 sequence
PAAKRVKLDGGSPKKKRKVGGSSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEGGSPKKKRKV

SEQ ID NO: 1636 - protein, 1017 aa, synthetic construct
  REGION 1..1017: note = pXDP245 sequence
PAAKRVKLDPPPPKKKRKVPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEGGSPKKKRKV

SEQ ID NO: 1637 - protein, 1008 aa, synthetic construct
  REGION 1..1008: note = pXDP246 sequence
PAAKRVKLDPGRSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEGGSPKKKRKV

SEQ ID NO: 1638 - protein, 1024 aa, synthetic construct
  REGION 1..1024: note = pXDP247 sequence
PKKKRKVSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEVGPKRTADSQHSTPPKTKRKVEFEPKKKRKV

SEQ ID NO: 1639 - protein, 1030 aa, synthetic construct
  REGION 1..1030: note = pXDP248 sequence
PKKKRKVSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEVGGGSGGGSKRTADSQHSTPPKTKRKVEFEPKKKRKV

SEQ ID NO: 1640 - protein, 1039 aa, synthetic construct
  REGION 1..1039: note = pXDP249 sequence
PKKKRKVSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEVAEAAAKEAAAKEAAAKAKRTADSQHSTPPKTKRKVEFEPKKKRKV

SEQ ID NO: 1641 - protein, 1034 aa, synthetic construct
  REGION 1..1034: note = pXDP250 sequence
PKKKRKVSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEVGPPKKKRKVGGSKRTADSQHSTPPKTKRKVEFEPKKKRKV

SEQ ID NO: 1642 - protein, 1022 aa, synthetic construct
  REGION 1..1022: note = pXDP251 sequence
PKKKRKVSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEVGPAEAAAKEAAAKEAAAKAPAAKRVKLD

SEQ ID NO: 1643 - protein, 1017 aa, synthetic construct
  REGION 1..1017: note = pXDP252 sequence
PKKKRKVSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEVGPGGGSGGGSGGGSPAAKRVKLD

SEQ ID NO: 1644 - protein, 1015 aa, synthetic construct
  REGION 1..1015: note = pXDP253 sequence
PKKKRKVSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEVGPPKKKRKVPPPPAAKRVKLD

SEQ ID NO: 1645 - protein, 1005 aa, synthetic construct
  REGION 1..1005: note = pXDP254 sequence
PKKKRKVSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEVGPPAAKRVKLD

SEQ ID NO: 1646 - protein, 1049 aa, synthetic construct
  REGION 1..1049: note = pXDP255 sequence
PAAKRVKLDGGKRTADGSEFESPKKKRKVGGSSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEVGPKRTADSQHSTPPKTKRKVEFEPKKKRKV

SEQ ID NO: 1647 - protein, 1062 aa, synthetic construct
  REGION 1..1062: note = pXDP256 sequence
PAAKRVKLDGGKRTADGSEFESPKKKRKVGGGSGGGSPGSRDISRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTLEVGGGSGGGSKRTADSQHSTPPKTKRKVEFEPKKKRKV

SEQ ID NO: 1648 - protein, 1004 aa, synthetic construct
  REGION 1..1004: note = pXDP263 sequence
PKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSKRPAATKKAGQAKKKK

SEQ ID NO: 1649 - protein, 1034 aa, synthetic construct
  REGION 1..1034: note = pXDP264 sequence
PKKKRKVGGSPKKKRKVGGSPKKKRKVGGSPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSKRPAATKKAGQAKKKK

SEQ ID NO: 1650 - protein, 1054 aa, synthetic construct
  REGION 1..1054: note = pXDP265 sequence
PKKKRKVGGSPKKKRKVGGSPKKKRKVGGSPKKKRKVGGSPKKKRKVGGSPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSKRPAATKKAGQAKKKK

SEQ ID NO: 1651 - protein, 997 aa, synthetic construct
  REGION 1..997: note = pXDP266 sequence
PAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSPKKKRKV

SEQ ID NO: 1652 - protein, 1006 aa, synthetic construct
  REGION 1..1006: note = pXDP267 sequence
PAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSKRPAATKKAGQAKKKK

SEQ ID NO: 1653 - protein, 1018 aa, synthetic construct
  REGION 1..1018: note = pXDP268 sequence
PAAKRVKLDGGSPAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSKRPAATKKAGQAKKKK

SEQ ID NO: 1654 - protein, 1042 aa, synthetic construct
  REGION 1..1042: note = pXDP269 sequence
PAAKRVKLDGGSPAAKRVKLDGGSPAAKRVKLDGGSPAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSKRPAATKKAGQAKKKK

SEQ ID NO: 1655 - protein, 1066 aa, synthetic construct
  REGION 1..1066: note = pXDP270 sequence
PAAKRVKLDGGSPAAKRVKLDGGSPAAKRVKLDGGSPAAKRVKLDGGSPAAKRVKLDGGSPAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSKRPAATKKAGQAKKKK

SEQ ID NO: 1656 - protein, 1004 aa, synthetic construct
  REGION 1..1004: note = pXDP271 sequence
KRPAATKKAGQAKKKKSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSPKKKRKV

SEQ ID NO: 1657 - protein, 1024 aa, synthetic construct
  REGION 1..1024: note = pXDP322 sequence
PAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGGGSGGGSKRTADSQHSTPPKTKRKVEFEPKKKRKV

SEQ ID NO: 1658 - protein, 1028 aa, synthetic construct
  REGION 1..1028: note = pXDP323 sequence
PAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGPPKKKRKVGGSKRTADSQHSTPPKTKRKVEFEPKKKRKV

SEQ ID NO: 1659 - protein, 1014 aa, synthetic construct
  REGION 1..1014: note = pXDP324 sequence
PAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVTGGGPGGGAAAGSGSPKKKRKVGSGS

SEQ ID NO: 1660 - protein, 1018 aa, synthetic construct
  REGION 1..1018: note = pXDP325 sequence
PAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGPKRTADSQHSTPPKTKRKVEFEPKKKRKV

SEQ ID NO: 1661 - protein, 1033 aa, synthetic construct
  REGION 1..1033: note = pXDP326 sequence
PAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVAEAAAKEAAAKEAAAKAKRTADSQHSTPPKTKRKVEFEPKKKRKV

SEQ ID NO: 1662 - protein, 1009 aa, synthetic construct
  REGION 1..1009: note = pXDP327 sequence
PAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGPPKKKRKVPPPPAAKRVKLD

SEQ ID NO: 1663 - protein, 1059 aa, synthetic construct
  REGION 1..1059: note = pXDP328 sequence
PAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSPAAKRVKLDGGSPAAKRVKLDGGSPAAKRVKLDGGSPAAKRVKLDGGSPAAKRVKLDGGSPAAKRVKLD

SEQ ID NO: 1664 - protein, 1029 aa, synthetic construct
  REGION 1..1029: note = pXDP329 sequence
PAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSPAAKRVKLGGSPAAKRVKLGGSPKKKRKVGGSPKKKRKV

SEQ ID NO: 1665 - protein, 1073 aa, synthetic construct
  REGION 1..1073: note = pXDP333 sequence
PKKKRKVGGSPKKKRKVGGSPKKKRKVGGSPKKKRKVGGSPKKKRKVGGSPKKKRKVSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSKRPAATKKAGQAKKKKGGSKRPAATKKAGQAKKKK

SEQ ID NO: 1666 - protein, 1085 aa, synthetic construct
  REGION 1..1085: note = pXDP334 sequence
PAAKRVKLDGGSPAAKRVKLDGGSPAAKRVKLDGGSPAAKRVKLDGGSPAAKRVKLDGGSPAAKRVKLDSRQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAVGSKRPAATKKAGQAKKKKGGSKRPAATKKAGQAKKKK

SEQ ID NO: 1667 - protein, 46 aa, synthetic construct; identical to SEQ ID NO: 461
  REGION 1..46: note = nuclear localization signal

SEQ ID NO: 1668 - protein, 66 aa, synthetic construct; identical to SEQ ID NO: 462
  REGION 1..66: note = nuclear localization signal

SEQ ID NO: 1669 - protein, 86 aa, synthetic construct; identical to SEQ ID NO: 463
  REGION 1..86: note = nuclear localization signal

SEQ ID NO: 1670 - protein, 50 aa, synthetic construct; identical to SEQ ID NO: 464
  REGION 1..50: note = nuclear localization signal

SEQ ID NO: 1671 - protein, 74 aa, synthetic construct; identical to SEQ ID NO: 465
  REGION 1..74: note = nuclear localization signal

SEQ ID NO: 1672 - protein, 98 aa, synthetic construct; identical to SEQ ID NO: 466
  REGION 1..98: note = nuclear localization signal

SEQ ID NO: 1673 - protein, 49 aa, synthetic construct; identical to SEQ ID NO: 467
  REGION 1..49: note = nuclear localization signal

SEQ ID NO: 1674 - protein, 45 aa, synthetic construct; identical to SEQ ID NO: 468
  REGION 1..45: note = nuclear localization signal

SEQ ID NO: 1675 - protein, 68 aa, synthetic construct; identical to SEQ ID NO: 469
  REGION 1..68: note = nuclear localization signal

SEQ ID NO: 1676 - protein, 106 aa, synthetic construct; identical to SEQ ID NO: 470
  REGION 1..106: note = nuclear localization signal

SEQ ID NO: 1677 - protein, 144 aa, synthetic construct; identical to SEQ ID NO: 471
  REGION 1..144: note = nuclear localization signal

SEQ ID NO: 1678 - protein, 70 aa, synthetic construct; identical to SEQ ID NO: 472
  REGION 1..70: note = nuclear localization signal

SEQ ID NO: 1679 - protein, 70 aa, synthetic construct; identical to SEQ ID NO: 472
  REGION 1..70: note = nuclear localization signal

SEQ ID NO: 1680 - protein, 78 aa, synthetic construct; identical to SEQ ID NO: 474
  REGION 1..78: note = nuclear localization signal

SEQ ID NO: 1681 - protein, 102 aa, synthetic construct; identical to SEQ ID NO: 475
  REGION 1..102: note = nuclear localization signal

SEQ ID NO: 1682 - protein, 49 aa, synthetic construct; identical to SEQ ID NO: 467
  REGION 1..49: note = nuclear localization signal

SEQ ID NO: 1683 - protein, 68 aa, synthetic construct; identical to SEQ ID NO: 469
  REGION 1..68: note = nuclear localization signal

SEQ ID NO: 1684 - protein, 65 aa, synthetic construct; identical to SEQ ID NO: 478
  REGION 1..65: note = nuclear localization signal

SEQ ID NO: 1685 - protein, 67 aa, synthetic construct; identical to SEQ ID NO: 479
  REGION 1..67: note = nuclear localization signal

SEQ ID NO: 1686 - protein, 72 aa, synthetic construct; identical to SEQ ID NO: 480
  REGION 1..72: note = nuclear localization signal

SEQ ID NO: 1687 - protein, 72 aa, synthetic construct; identical to SEQ ID NO: 481
  REGION 1..72: note = nuclear localization signal

SEQ ID NO: 1688 - protein, 73 aa, synthetic construct; identical to SEQ ID NO: 482
  REGION 1..73: note = nuclear localization signal

SEQ ID NO: 1689 - protein, 81 aa, synthetic construct; identical to SEQ ID NO: 483
  REGION 1..81: note = nuclear localization signal

SEQ ID NO: 1690 - protein, 64 aa, synthetic construct; identical to SEQ ID NO: 484
  REGION 1..64: note = nuclear localization signal

SEQ ID NO: 1691 - protein, 55 aa, synthetic construct; identical to SEQ ID NO: 485
  REGION 1..55: note = nuclear localization signal

SEQ ID NO: 1692 - protein, 54 aa, synthetic construct; identical to SEQ ID NO: 486
  REGION 1..54: note = nuclear localization signal

SEQ ID NO: 1693 - protein, 45 aa, synthetic construct; identical to SEQ ID NO: 487
  REGION 1..45: note = nuclear localization signal

SEQ ID NO: 1694 - protein, 40 aa, synthetic construct; identical to SEQ ID NO: 488
  REGION 1..40: note = nuclear localization signal

SEQ ID NO: 1695 - protein, 40 aa, synthetic construct; identical to SEQ ID NO: 488
  REGION 1..40: note = nuclear localization signal

SEQ ID NO: 1696 - protein, 40 aa, synthetic construct; identical to SEQ ID NO: 488
  REGION 1..40: note = nuclear localization signal

SEQ ID NO: 1697 - protein, 40 aa, synthetic construct; identical to SEQ ID NO: 488
  REGION 1..40: note = nuclear localization signal

SEQ ID NO: 1698 - protein, 40 aa, synthetic construct; identical to SEQ ID NO: 488
  REGION 1..40: note = nuclear localization signal

SEQ ID NO: 1699 - protein, 40 aa, synthetic construct; identical to SEQ ID NO: 488
  REGION 1..40: note = nuclear localization signal

SEQ ID NO: 1700 - protein, 40 aa, synthetic construct; identical to SEQ ID NO: 488
  REGION 1..40: note = nuclear localization signal

SEQ ID NO: 1701 - protein, 40 aa, synthetic construct; identical to SEQ ID NO: 488
  REGION 1..40: note = nuclear localization signal

SEQ ID NO: 1702 - protein, 65 aa, synthetic construct; identical to SEQ ID NO: 478
  REGION 1..65: note = nuclear localization signal

SEQ ID NO: 1703 - protein, 72 aa, synthetic construct; identical to SEQ ID NO: 481
  REGION 1..72: note = nuclear localization signal

SEQ ID NO: 1704 - protein, 36 aa, synthetic construct; identical to SEQ ID NO: 491
  REGION 1..36: note = nuclear localization signal

SEQ ID NO: 1705 - protein, 66 aa, synthetic construct; identical to SEQ ID NO: 462
  REGION 1..66: note = nuclear localization signal

SEQ ID NO: 1706 - protein, 86 aa, synthetic construct; identical to SEQ ID NO: 463
  REGION 1..86: note = nuclear localization signal

SEQ ID NO: 1707 - protein, 38 aa, synthetic construct; identical to SEQ ID NO: 494
  REGION 1..38: note = nuclear localization signal

SEQ ID NO: 1708 - protein, 38 aa, synthetic construct; identical to SEQ ID NO: 494
  REGION 1..38: note = nuclear localization signal

SEQ ID NO: 1709 - protein, 50 aa, synthetic construct; identical to SEQ ID NO: 464
  REGION 1..50: note = nuclear localization signal

SEQ ID NO: 1710 - protein, 74 aa, synthetic construct; identical to SEQ ID NO: 465
  REGION 1..74: note = nuclear localization signal

SEQ ID NO: 1711 - protein, 98 aa, synthetic construct; identical to SEQ ID NO: 466
  REGION 1..98: note = nuclear localization signal

SEQ ID NO: 1712 - protein, 45 aa, synthetic construct; identical to SEQ ID NO: 468
  REGION 1..45: note = nuclear localization signal

SEQ ID NO: 1713 - protein, 38 aa, synthetic construct; identical to SEQ ID NO: 494
  REGION 1..38: note = nuclear localization signal

SEQ ID NO: 1714 - protein, 38 aa, synthetic construct; identical to SEQ ID NO: 494
  REGION 1..38: note = nuclear localization signal

SEQ ID NO: 1715 - protein, 38 aa, synthetic construct; identical to SEQ ID NO: 494
  REGION 1..38: note = nuclear localization signal

SEQ ID NO: 1716 - protein, 38 aa, synthetic construct; identical to SEQ ID NO: 494
  REGION 1..38: note = nuclear localization signal

SEQ ID NO: 1717 - protein, 38 aa, synthetic construct; identical to SEQ ID NO: 494
  REGION 1..38: note = nuclear localization signal

SEQ ID NO: 1718 - protein, 38 aa, synthetic construct; identical to SEQ ID NO: 494
  REGION 1..38: note = nuclear localization signal

SEQ ID NO: 1719 - protein, 38 aa, synthetic construct; identical to SEQ ID NO: 494
  REGION 1..38: note = nuclear localization signal

SEQ ID NO: 1720 - protein, 38 aa, synthetic construct; identical to SEQ ID NO: 494
  REGION 1..38: note = nuclear localization signal

SEQ ID NO: 1721 - protein, 86 aa, synthetic construct; identical to SEQ ID NO: 463
  REGION 1..86: note = nuclear localization signal

SEQ ID NO: 1722 - protein, 98 aa, synthetic construct; identical to SEQ ID NO: 466
  REGION 1..98: note = nuclear localization signal

SEQ ID NO: 1723 - protein, 21 aa, synthetic construct
  REGION 1..21: note = nuclear localization signal
TSPKKKRKVALEYPYDVPDYA

SEQ ID NO: 1724 - protein, 21 aa, synthetic construct
  REGION 1..21: note = nuclear localization signal
TSPKKKRKVALEYPYDVPDYA

SEQ ID NO: 1725 - protein, 21 aa, synthetic construct
  REGION 1..21: note = nuclear localization signal
TSPKKKRKVALEYPYDVPDYA

SEQ ID NO: 1726 - protein, 21 aa, synthetic construct
  REGION 1..21: note = nuclear localization signal
TSPKKKRKVALEYPYDVPDYA

SEQ ID NO: 1727 - protein, 21 aa, synthetic construct
  REGION 1..21: note = nuclear localization signal
TSPKKKRKVALEYPYDVPDYA

SEQ ID NO: 1728 - protein, 21 aa, synthetic construct
  REGION 1..21: note = nuclear localization signal
TSPKKKRKVALEYPYDVPDYA

SEQ ID NO: 1729 - protein, 33 aa, synthetic construct; identical to SEQ ID NO: 500
  REGION 1..33: note = nuclear localization signal

SEQ ID NO: 1730 - protein, 27 aa, synthetic construct
  REGION 1..27: note = nuclear localization signal
GSKRPAATKKAGQAKKKKYPYDVPDYA

SEQ ID NO: 1731 - protein, 52 aa, synthetic construct
  REGION 1..52: note = nuclear localization signal
TLESKRPAATKKAGQAKKKKGGSKRPAATKKAGQAKKKKAPGEYPYDVPDYA

SEQ ID NO: 1732 - protein, 77 aa, synthetic construct
  REGION 1..77: note = nuclear localization signal
TLESKRPAATKKAGQAKKKKGGSKRPAATKKAGQAKKKKGGSKRPAATKKAGQAKKKKGGSKRPAATKKAGQAKKKK

SEQ ID NO: 1733 - protein, 115 aa, synthetic construct
  REGION 1..115: note = nuclear localization signal
TLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKK

SEQ ID NO: 1734 - protein, 41 aa, synthetic construct
  REGION 1..41: note = nuclear localization signal
TLESPKKKRKVGGSPKKKRKVGGSPKKKRKVGGSPKKKRKV

SEQ ID NO: 1735 - protein, 41 aa, synthetic construct; identical to SEQ ID NO: 1734
  REGION 1..41: note = nuclear localization signal

SEQ ID NO: 1736 - protein, 49 aa, synthetic construct
  REGION 1..49: note = nuclear localization signal
TLESPAAKRVKLDGGSPAAKRVKLDGGSPAAKRVKLDGGSPAAKRVKLD

SEQ ID NO: 1737 - protein, 73 aa, synthetic construct
  REGION 1..73: note = nuclear localization signal
TLESPAAKRVKLDGGSPAAKRVKLDGGSPAAKRVKLDGGSPAAKRVKLDGGSPAAKRVKLDGGSPAAKRVKLD

SEQ ID NO: 1738 - protein, 20 aa, synthetic construct
  REGION 1..20: note = nuclear localization signal
TLESKRPAATKKAGQAKKKK

SEQ ID NO: 1739 - protein, 39 aa, synthetic construct
  REGION 1..39: note = nuclear localization signal
TLESKRPAATKKAGQAKKKKGGSKRPAATKKAGQAKKKK

SEQ ID NO: 1740 - protein, 13 aa, synthetic construct
  REGION 1..13: note = nuclear localization signal
TLEGGSPKKKRKV

SEQ ID NO: 1741 - protein, 13 aa, synthetic construct
  REGION 1..13: note = nuclear localization signal
TLEGGSPKKKRKV

SEQ ID NO: 1742 - protein, 13 aa, synthetic construct
  REGION 1..13: note = nuclear localization signal
TLEGGSPKKKRKV

SEQ ID NO: 1743 - protein, 13 aa, synthetic construct
  REGION 1..13: note = nuclear localization signal
TLEGGSPKKKRKV

SEQ ID NO: 1744 - protein, 13 aa, synthetic construct
  REGION 1..13: note = nuclear localization signal
TLEGGSPKKKRKV

SEQ ID NO: 1745 - protein, 13 aa, synthetic construct
  REGION 1..13: note = nuclear localization signal
TLEGGSPKKKRKV

SEQ ID NO: 1746 - protein, 13 aa, synthetic construct
  REGION 1..13: note = nuclear localization signal
TLEGGSPKKKRKV

SEQ ID NO: 1747 - protein, 13 aa, synthetic construct
  REGION 1..13: note = nuclear localization signal
TLEGGSPKKKRKV

SEQ ID NO: 1748 - protein, 13 aa, synthetic construct
  REGION 1..13: note = nuclear localization signal
TLEGGSPKKKRKV

SEQ ID NO: 1749 - protein, 13 aa, synthetic construct
  REGION 1..13: note = nuclear localization signal
TLEGGSPKKKRKV

SEQ ID NO: 1750 - protein, 34 aa, synthetic construct
  REGION 1..34: note = nuclear localization signal
TLEVGPKRTADSQHSTPPKTKRKVEFEPKKKRKV

SEQ ID NO: 1751 - protein, 40 aa, synthetic construct
  REGION 1..40: note = nuclear localization signal
TLEVGGGSGGGSKRTADSQHSTPPKTKRKVEFEPKKKRKV

SEQ ID NO: 1752 - protein, 49 aa, synthetic construct
  REGION 1..49: note = nuclear localization signal
TLEVAEAAAKEAAAKEAAAKAKRTADSQHSTPPKTKRKVEFEPKKKRKV

SEQ ID NO: 1753 - protein, 44 aa, synthetic construct
  REGION 1..44: note = nuclear localization signal
TLEVGPPKKKRKVGGSKRTADSQHSTPPKTKRKVEFEPKKKRKV

SEQ ID NO: 1754 - protein, 32 aa, synthetic construct
  REGION 1..32: note = nuclear localization signal
TLEVGPAEAAAKEAAAKEAAAKAPAAKRVKLD

SEQ ID NO: 1755 - protein, 27 aa, synthetic construct
  REGION 1..27: note = nuclear localization signal
TLEVGPGGGSGGGSGGGSPAAKRVKLD

SEQ ID NO: 1756 - protein, 25 aa, synthetic construct
  REGION 1..25: note = nuclear localization signal
TLEVGPPKKKRKVPPPPAAKRVKLD

SEQ ID NO: 1757 - protein, 15 aa, synthetic construct
  REGION 1..15: note = nuclear localization signal
TLEVGPPAAKRVKLD

SEQ ID NO: 1758 - protein, 34 aa, synthetic construct; identical to SEQ ID NO: 1750
  REGION 1..34: note = nuclear localization signal

SEQ ID NO: 1759 - protein, 40 aa, synthetic construct; identical to SEQ ID NO: 1751
  REGION 1..40: note = nuclear localization signal

SEQ ID NO: 1760 - protein, 18 aa, synthetic construct
  REGION 1..18: note = nuclear localization signal
GSKRPAATKKAGQAKKKK

SEQ ID NO: 1761 - protein, 18 aa, synthetic construct
  REGION 1..18: note = nuclear localization signal
GSKRPAATKKAGQAKKKK

SEQ ID NO: 1762 - protein, 18 aa, synthetic construct
  REGION 1..18: note = nuclear localization signal
GSKRPAATKKAGQAKKKK

SEQ ID NO: 1763 - protein, 9 aa, synthetic construct
  REGION 1..9: note = nuclear localization signal
GSPKKKRKV

SEQ ID NO: 1764 - protein, 18 aa, synthetic construct
  REGION 1..18: note = nuclear localization signal
GSKRPAATKKAGQAKKKK

SEQ ID NO: 1765 - protein, 18 aa, synthetic construct
  REGION 1..18: note = nuclear localization signal
GSKRPAATKKAGQAKKKK

SEQ ID NO: 1766 - protein, 18 aa, synthetic construct
  REGION 1..18: note = nuclear localization signal
GSKRPAATKKAGQAKKKK

SEQ ID NO: 1767 - protein, 18 aa, synthetic construct
  REGION 1..18: note = nuclear localization signal
GSKRPAATKKAGQAKKKK

SEQ ID NO: 1768 - protein, 9 aa, synthetic construct
  REGION 1..9: note = nuclear localization signal
GSPKKKRKV

SEQ ID NO: 1769 - protein, 36 aa, synthetic construct
  REGION 1..36: note = nuclear localization signal
GGGSGGGSKRTADSQHSTPPKTKRKVEFEPKKKRKV

SEQ ID NO: 1770 - protein, 40 aa, synthetic construct
  REGION 1..40: note = nuclear localization signal
GPPKKKRKVGGSKRTADSQHSTPPKTKRKVEFEPKKKRKV

SEQ ID NO: 1771 - protein, 26 aa, synthetic construct
  REGION 1..26: note = nuclear localization signal
TGGGPGGGAAAGSGSPKKKRKVGSGS

SEQ ID NO: 1772 - protein, 30 aa, synthetic construct
  REGION 1..30: note = nuclear localization signal
GPKRTADSQHSTPPKTKRKVEFEPKKKRKV

SEQ ID NO: 1773 - protein, 45 aa, synthetic construct
  REGION 1..45: note = nuclear localization signal
AEAAAKEAAAKEAAAKAKRTADSQHSTPPKTKRKVEFEPKKKRKV

SEQ ID NO: 1774 - protein, 21 aa, synthetic construct
  REGION 1..21: note = nuclear localization signal
GPPKKKRKVPPPPAAKRVKLD

SEQ ID NO: 1775 - protein, 71 aa, synthetic construct; identical to SEQ ID NO: 551
  REGION 1..71: note = nuclear localization signal

SEQ ID NO: 1776 - protein, 41 aa, synthetic construct; identical to SEQ ID NO: 552
  REGION 1..41: note = nuclear localization signal

SEQ ID NO: 1777 - protein, 37 aa, synthetic construct; identical to SEQ ID NO: 553
  REGION 1..37: note = nuclear localization signal

SEQ ID NO: 1778 - protein, 37 aa, synthetic construct; identical to SEQ ID NO: 553
  REGION 1..37: note = nuclear localization signal

SEQ ID NO: 1779 - DNA, 179 bp, synthetic construct; identical to SEQ ID NO: 1228
  misc_feature 1..179: note = scaffold sequence
  source 1..179: mol_type = other DNA

SEQ ID NO: 1780 - DNA, 1902 bp, synthetic construct; identical to SEQ ID NO: 1140
  misc_feature 1..1902: note = pXDP164 sequence
  source 1..1902: mol_type = other DNA

SEQ ID NO: 1781 - DNA, 3198 bp, synthetic construct
  misc_feature 1..3198: note = CasX491 NLS
  source 1..3198: mol_type = other DNA
gccaccatgctcgagaccggtgccccagctgccaagcgagtcaaacttgatgggggctctcctgccgcaaagagggtaaaattggacggggggagcccagccgcaaagcgagtcaaattggatgggggcagtcccgcagccaaaagggtcaagctcgacggtggcagccctgcggcaaaaagggttaagcttgatggtggttcaccggcagcgaaaagagttaagttggattctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtatag

SEQ ID NO: 1782 - DNA, 3117 bp, synthetic construct; identical to SEQ ID NO: 1206
  misc_feature 1..3117: note = CasX491 NLS
  source 1..3117: mol_type = other DNA

SEQ ID NO: 1783 - DNA, 3062 bp, synthetic construct
  misc_feature 1..3062: note = CasX491 NLS
  source 1..3062: mol_type = other DNA
gccaccatgcccgcggccaaaagggtgaaattggaccctccacccccaaagaagaagcgcaaagttcccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggggggtagcccaaaaagaagagaaaggtatga

SEQ ID NO: 1784 - DNA, 3084 bp, synthetic construct
  misc_feature 1..3084: note = CasX491 NLS
  source 1..3084: mol_type = other DNA
gccaccatgccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggccccaagcgaactgcagacagccagcactccacacctcctaaaaccaaacgcaaggtggagttcgagcctaagaaaaagcgcaaggtctga

SEQ ID NO: 1785 - DNA, 3102 bp, synthetic construct
  misc_feature 1..3102: note = CasX491 NLS
  source 1..3102: mol_type = other DNA
gccaccatgccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggaggcggatcagggggcggatcaaagcgaactgcagacagccagcactccacacctcctaaaaccaaacgcaaggtggagttcgagcctaagaaaaagcgcaaggtctga

SEQ ID NO: 1786 - DNA, 3093 bp, synthetic construct
  misc_feature 1..3093: note = CasX491 NLS
  source 1..3093: mol_type = other DNA
gccaccatgctcgagccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggtcctgctgaggcagcagctaaagaagctgcggcgaaagaagccgctgctaaggctccagcggctaaaagggttaagctggacgcggccgcctag

SEQ ID NO: 1787 - DNA, 3078 bp, synthetic construct
  misc_feature 1..3078: note = CasX491 NLS
  source 1..3078: mol_type = other DNA
gccaccatgctcgagccaaagaagaagcggaaggtctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggtcctggtggtggctcaggtggaggcagtgggggaggttccccagcggctaaaagggttaagctggacgcggccgcctag

SEQ ID NO: 1788 - DNA, 3174 bp, synthetic construct; identical to SEQ ID NO: 1207
  misc_feature 1..3174: note = CasX491 NLS
  source 1..3174: mol_type = other DNA

SEQ ID NO: 1789 - DNA, 3213 bp, synthetic construct
  misc_feature 1..3213: note = CasX491 NLS
  source 1..3213: mol_type = other DNA
gccaccatgctcgagcccgcggccaaaagggtgaaattggacggagggaagcgcacggccgacggcagtgaattcgagtctccaaagaagaagcgcaaagttggtggcggctccggcggtggatctcccggctctagagatatctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactctcgaggtgggaggcggatcagggggcggatcaaagcgaactgcagacagccagcactccacacctcctaaaaccaaacgcaaggtggagttcgagcctaagaaaaagcgcaaggtcgcggccgcctag

SEQ ID NO: 1790 - DNA, 3153 bp, synthetic construct
  misc_feature 1..3153: note = CasX491 NLS
  source 1..3153: mol_type = other DNA
gccaccatgctcgagccagcggccaaacgggtgaagctggacggcgggtcccccgcagccaagagggtgaaactggatggaggctccccagccgcaaagcgggtcaagctggacggagggtcccccgccgctaagagggtgaaactggattctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagcgcagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgggctccaagagaccagccgcaacgaagaaagcaggccaggccaagaaaaagaaggcggccgcctag

SEQ ID NO: 1791 - DNA, 4566 bp, synthetic construct; identical to SEQ ID NO: 1210
  misc_feature 1..4566: note = pXDP17 sequence
  source 1..4566: mol_type = other DNA

SEQ ID NO: 1792 - DNA, 3354 bp, synthetic construct
  misc_feature 1..3354: note = pXDP184 sequence
  source 1..3354: mol_type = other DNA
gccaccatggaagcgccggaagatcagggcccgcagcgcgaaccgcataacgaatggaccctggaactgctggaagaactgaaacgcgaagcggtgcgccattttccgcgcccgtggctgcatggcctgggccagcatatttatgaaacctatggcgatacctgggcgggcgtggaagcgattattcgcattctgcagcagctgctgtttattcattttcgcattggctgccagcatagccgcattggcattattcagcagcgccgcgcgcgcaacggcgcgagccgcagcaactttagccagaactatccgattgtgcagaccggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1793 - DNA, 1536 bp, synthetic construct; identical to SEQ ID NO: 1003
  misc_feature 1..1536: note = pGP2 sequence
  source 1..1536: mol_type = other DNA

SEQ ID NO: 1794 - DNA, 4563 bp, synthetic construct; identical to SEQ ID NO: 1144
  misc_feature 1..4563: note = pXDP17 sequence
  source 1..4563: mol_type = other DNA

SEQ ID NO: 1795 - DNA, 2465 bp, synthetic construct; identical to SEQ ID NO: 1153
  misc_feature 1..2465: note = pSG17 sequence
  source 1..2465: mol_type = other DNA

SEQ ID NO: 1796 - DNA, 2413 bp, synthetic construct; identical to SEQ ID NO: 1048
  misc_feature 1..2413: note = pSG005 sequence
  source 1..2413: mol_type = other DNA

SEQ ID NO: 1797 - DNA, 5178 bp, synthetic construct; identical to SEQ ID NO: 1090
  misc_feature 1..5178: note = pXDP40 sequence
  source 1..5178: mol_type = other DNA

SEQ ID NO: 1798 - DNA, 5253 bp, synthetic construct
  misc_feature 1..5253: note = pXDP144 sequence
  source 1..5253: mol_type = other DNA
gccaccatggaagccgtgatcaaggtgatcagctccgcatgcaagacctactgtggcaagacgagcccaagcaagaaggaaatcggcgctatgctgagcctgctgcagaaggagggcctcctgatgagcctgtctgatctgtacagcccaggtagctgggaccctatcaccgccgccctgacacagagagccatggtgctgggcaaaagcggcgagctgaagacatggggactggtgctgggcgccctgaaagccgctagagaagagcaagtaaccagcgagcaggccaagttctggctgggactgggcggcggtagagtgagcccccctggccctgagtgcatcgagaagcctgccaccgagcggcgcattgacaaaggcgaagaagtgggcgagacaaccgtgcagagagacgccaagatggctccagaagagacagcaaccccaaagaccgtgggcaccagctgctaccactgcggcaccgctatcggctgcaactgcgccaccgccagcgcgcctcctcccccgtatgtgggcagcggcctctacccctccctggcaggagtgggagagcagcagggccagggcggagatacacccagaggcgccgagcagcctagagccgaacccggccacgccggccaggcccctggccccgccctgaccgactgggccagaatcagagaggagctggcctctacaggccctccagtggtcgccatgcctgtggtgatcaagaccgagggacctgcctggacccctctggaacctaaactgattacacggctggctgataccgtcagaaccaagggcctcagaagccccatcacaatggccgaagtggaagccctgatgagcagcccactgctgcctcacgacgtgaccaacctgatgcgggtgatcctgggccccgccccttacgccctgtggatggacgcctggggcgtgcagctgcaaacagttatcgccgccgccacaagagacccccggcacccagccaacggccagggcagaggcgagagaacaaacctggatcggctgaagggcctcgccgatggcatggccggcaatcctgagggccaggctgctctgctgagacccggggaactggttgctatcaccgccagcgccctgcaggccttcagagaagtggcccggctggccgagcctacagacccctgggccgagatcacccagggcccttctgagagcttcgtggacttcgccaacagactgatcaaggccgttgagggctccgacctgcctcctagcgcccgcgcccccgtgatcatcgactgttttagacagaaatcgcaacccgacatccagcagctgatccgggccgctccttctaccctgaccacacctggcgagatcatcaagtacgtgctggacagacagaagaccgcccccctgaccgacagaggaatcgccgccgccatgtctagcgccattcagcctctggtgatggccgtggtcaacagagaaagagatggacagacaggttctggcggcagagcccggggcctgtgctacacctgcggatcccctggacactaccaggcccagtgtcctaagaaaagaaagtctggtaacagcagagagcggtgccagctgtgtgatggcatgggccacaacgccaaacagtgccggagacgggacggaaaccaaggacaaagacccggccggggactgagcagcggaccttggcctgtcagccagcaacctgccgtgtccctggctatgaccatggaacacaaggaccggcctctggtgcgggtgatcctgacaaataccggctctcaccccgtgaagcagcggtcagtgtacatcacagccctgctggacagcggcgctgatatcaccatcattagcgaggaggactggcctaccgactggcccgtgatggaagctgccaatccccagatccacggcatcggaggcggaatcccgatgagaaagtccagagacatgatcgaggtgggcgtgatcaaccgggacggctctcttgagagacctctgctgctgttccccgccgtggctatggtgcgaggcagcatcctgggccgcgactgcctgcagggcctgggcctgagactgaccaacctgggagggccactgttcttactgttgcgctacatctggctattccgctcaaatggaagccagaccacacgcctgtgtggattgaccagtggccccttcctgaaggtaaacttgcgcggtgccccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1799 - DNA, 4914 bp, synthetic construct; identical to SEQ ID NO: 1255
  misc_feature 1..4914: note = pXDP145 sequence
  source 1..4914: mol_type = other DNA

SEQ ID NO: 1800 - DNA, 5286 bp, synthetic construct
  misc_feature 1..5286: note = pXDP150 sequence
  source 1..5286: mol_type = other DNA
gccaccatggaagctgtgattaaggtgatctcctctgcctgcaagacctactgcggcaagacctccccctctaagaaggaaatcggcgccatgctgagcctgctgcagaaagagggactgctgatgagcccttccgacctgtacagccccggcagctgggaccccatcaccgccgctctgagccagagagccatggtgctcggaaagagcggcgaactgaagacctggggcctggtgctgggcgccttaaaggctgctagggaggaacaagtgacaagcgaacaggccaagttctggctgggcttgggcggcggccgggtgtcccctcctggccctgagtgcatcgagaagcctgccacagagagaagaatcgacaagggagaagaggccggcgagaccacagctcagagagacgtaaaaatggcccctgaggaaaccgccgcccctaagaccgtggggacctcatgctaccactgtggcacagccatcggatgtaattgcgccaccgcttctgccccaccccccccctacgtgggaagcggcctttatcctagcctggccggcgtgggcgagcagcagggccaaggcggcgacacccctagaggcgctgagcagccacgggccgagcctggccacgccggacaggcccctggccccgcactgacagattgggctagagtgagagaggagctggccagcacaggccctcctgtagtggccatgcctgtggtcattaagacagagggacctgcctggacccctctggaaccaaagctgatcacccggctggctgatacagtgcgaacaaagggcctgcgcagccccatcaccatggccgaggtggaagccctgatgtccagcccgctgctgcctcatgatgtgaccaacctgatgagagtgatcctgggacccgccccttacgccctgtggatggacgcctggggagtgcagctgcaaaccgtgatcgccgcagccaccagagatcctcggcaccccgccaacggccagggccggggcgagagaaccaacctggacagactgaaaggcctggccgacggcatggttggaaatccacagggacaggctgctctgctgcggcctggcgagctggtggccatcacagcctctgccctgcaggccttcagagaggtggccagactggccgaacctgccggcccttgggccgatatcacccagggccctagcgagagcttcgtggacttcgccaatagactgatcaaggccgttgagggctctgatctgccccccagcgccagagcccccgtgatcattgactgttttagacagaagagccaacctgacatccagcaactgatccgggccgccccgtctacactgacaacccccggagaaatcatcaagtacgtgctggatagacagaagacagcccctctgaccgatcagggcatcgccgcggccatgagctcagccatccagcctctcgtgatggccgtggtgaacagagaaagggatggacagaccggaagcggcggcagggccagaggcctgtgttacacatgcggaagcccaggccactaccaggcccagtgtcctaagaaaagaaagagcggcaacagcagagaacggtgccagctgtgcgacggcatggggcacaacgccaaacagtgcagaaaaagagacggcaaccagggccagagacctggcagaggcctgtctagcggcccctggcctggcccagagcctccagccgtgagcctggctatgaccatggaacacaaggaccggcccctggtcagagtcatcctgaccaacaccggcagccaccctgtgaagcagcgcagcgtgtacatcacagccctcctggactccggcgctgacatcactatcatcagcgaggaggactggcctacagactggccagtggtggacaccgccaaccctcagatccacggtatcggcggcggcatccctatgcggaagagcagagacatgatcgaggtgggcgtgatcaaccgggatggaagcctggaacggcctctgctgctgttccccgctgtggccatggttcggggcagtatcctgggcagagattgcctgcagggccttggcctgcggctgaccaacctgggaagacccctgttcctgctcctgagatacatctggctgtttcggagcaacggcagccagaccacccggctgtgcggcctgaccagcggcccttctctgaaggccaacctgagaggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1801 - DNA, 5286 bp, synthetic construct
  misc_feature 1..5286: note = pXDP151 sequence
  source 1..5286: mol_type = other DNA
gccaccatggaggccgtgatcaaagtgatcagcagcgcctgtaaaacctactgcggaaaaacaagcccaagcaagaaagagatcggcgcaatgctgtcactgctgcaaaaggaaggcctgctgatgtctcctagcgacctgtacagccctggttcctgggaccctatcactgccgctctcagccagagagcgatggtgctgggcaagtctggggagctgaaaacctggggcctggtgctgggcgctctgaaggccgccagagaggagcaggtgacctctgaacaggcaaagttctggctggggctgggaggaggaagagtgtccccacctggacctgagtgcattgagaagcccgccacagagagaagaaccgacaagggcgaagaggtgggcgagaccaccgctcacggagatgccaagatggcccctgaggaaaccgctacacctaagacagtgggcaccagctgctaccactgcggcacagccatcggatgtagctgcgccacagccagcgcccctcctcctccttatgtgggctccggcctgtatcctagcctggccggagtgggagagcagcagggccaggagggcgacacccctcggggcgccgaacagccaagagcggagccaggacacgccggcctggcccccggcccagccctaaccgactgggcccgggtgagagaggaactggcttctacaggcccccctgtggtggccatgcctgtggtgatcaagaccgagggccctgcctggacacctctggaacctaagctgatcaccagactggccgataccgtgcggaccaagggcctgagatctcccatcaccatggccgaggtggaagccctgatgagcagccctctgctgccccacgacgtgaccaatctgatgcgggtgatcctgggccccgccccttacgccctgtggatggacgcctggggcgtgcagctgcaaacagtgatagctgccgcaacaagagatcctagacaccccgccaacggccagggccgcggagagcggaccaacctggaccggctgaagggcctggccgacggcatggtgggcaacccccagggccaggctgccctgctgagacctggcgagctggtcgccatcacagccgccgccctgcaggccttccgggaggttgccagactggcggaacctgccggtccttgggccgatatcacacagggcccctctgagcccttcgtggacttcgccaataggctgatcaaagccgttgagggctctgatctgcctccttcggctagggccccggtgatcatcgactgcttccggcagaaaagccagcctgatatccagcaactcatcagagccgccccttctaccctgaccacacctggggaaatcatcaagtacgtgctggatagacaaaagaccgctcctctgaccgaccagggcatcgctgctgctatgagcagcgccatccagcccctcgtgatggctgtcgtcaaccgggaacgggatggccagaccggctccggcggcagagccagaggcctgtgttacacctgtggcagccctggtcattaccaggcccagtgtcctaaaaagcggaagtccggaaacagcagagagcggtgccagctgtgcgacggcatgggccacaacgccaagcagtgcagaaagagagacggcaaccagggacaaagacctggcagaggcctgtccagcggcccctggcccgtgtccgaacctccagccgtcagcctggctatgaccatggaacacaaggacagacccctggtcagagtgatccttacaaacaccggcagccaccccgtgaagcagcggagcgtttacatcaccgccctgctggacagcggcgccgacatcaccatcatcagcgaggaagattggccagccgactggcccgtgatggaagccgctaatcctcagatccacggcatcggcggcggtattcccatgagaaagagcagagacatgatcgaggtgggcgtgattaacagagacggcagcctggaaagacctctgcttctgttccccgccgtggccatggtgcggggaagcatcctgggcagagattgcctgcagggcctgggcctgagactgaccaacctgggcggacctctatttctgctgctgcggtacatctggctgtttcggagcaacggcagccagacaaccagactgtgcggcctgaccagcggccctttcctgaaggtgaacctgcgaggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1802 - DNA, 5292 bp, synthetic construct
  misc_feature 1..5292: note = pXDP152 sequence
  source 1..5292: mol_type = other DNA
gccaccatggaagccgtgattaaggtcatcagctccgcctgcaagacctactgtgggaagaccagccccagcaagaaggaaatcggcgctatgctgagcctgctgcagaaagagggcctgctgatgagcccttctgatctgtacagccctggcagctgggaccccatcacagctgccctgacccagagagccatggtgctgggcaaaagcggcgagctgaagacctggggcctggtgctgggagctctgaaggccgcgagagaagagcaggtgacctctgagcaggccaagttctggctgggcctgggcggcggaagagtgtcccctcctggccccgagtgcatcgagaagcccgccaccgagcggcggatcgacaagggcgaagaggttggcgagacaaccgtgcagagagacgccaaaatggcccccgaggaaaccgccacccctaaaacagtcggtacgtcttgctaccactgcggcaccgccatcggctgcaactgcgccaccacaaccgcttcagcccctcctcctccatacgtgggaagtggactttatcctagcctggctggcgtgggcgagcaacagggccaaggcggagatacacccagaggcgctgagcagccaagagccgaacccggccacgccggccaggcccctggcccagccttgaccgattgggccagagtgcgggaagaactggccagcaccggccctcctgtcgtggccatgcccgtggtgatcaagacagagggccctgcatggacccctctggaacctaagctgatcacacgcctggctgacaccgtgagaacaaagggactgagaagccctatcacaatggctgaggtggaagccctgatgagctcccctctgctgccgcacgacgtgacaaacctgatgagagtgatcctgggtcccgcgccttacgccctctggatggacgcctggggagtgcagctgcagacagtgatcgccgccgcaaccagagatcctcggcaccctgctaacggccagggcaggggcgagagaaccaacttggatagactgaagggcctggctgatggcatggttggaaaccctcagggccaggccgcactgctgaggcctggcgagctggtggccatcaccgccagcgccctgcaagccttcagagaggtggcccggctcgccgaacccgccggcccctgggccgatatcacccagggaccctctgagagcttcgtggacttcgccaatagactgatcaaagccgtggaaggcagcgacctgcctccatcggccagagccccagtgattattgactgttttagacagaagtctcagcctgacatccagcagctgataagagccgctccatccaccctgaccacacctggagagatcatcaaatacgtgctggacagacagaagacagcccctctgacagatcagggcatcgccgctgccatgagctctgctatccaacctctggtgatggccgtggtgaacagagagagagacggccagaccggctctggcggccgggtgcggggactgtgttacacatgcggcagccctggccactatcaggcccagtgtcctaagaaaagaaagagcggcaatagcagagagcgctgccagctgtgcgacggaatgggccataatgccaagcagtgcagaagaagagacggcaaccaagggcagagacctggcagaggcctcagcagcgggccttggcccggaccagaccagcccgctgtgtctctggccatgaccatggagcacaaggaccgtccgctggtgcgagtgatcctgaccaataccggcagtcaccccgtgaagcagcggtcagtgtacatcacagccctgctggacagcggcgccgatatcaccatcatcagcgaagaggactggcccaccgactggcctgtgatggaagccgccaacccccagatccacggcatcggcggcggcattcccatgcggaagagccgggacatgatcgaggtcggcgtgatcaaccgggacggctcccttgaacggcctctgctgctgttccctgccgtggccatggtcagaggcagcatcctgggacgggattgcctgcagggcctgggcctgagactgaccaacctgggaggccctctgttcctgctgctgcggtacatctggctgtttcggagcaacggcagccagaccacccggctgtgtggactgaccagcggccccttcctgcgagtgaacctgagaggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1803 - DNA, 5286 bp, synthetic construct
  misc_feature 1..5286: note = pXDP153 sequence
  source 1..5286: mol_type = other DNA
gccaccatggaagccgtgatcaaggtgatcagctccgcttgtaaaacctactgcggaaaaacaagcccaagcaagaaggaaatcggcgctatgctgagcctgctgcagaaagagggcctcctgatgtctcctagcgatctgtacagccccggcagctgggaccctatcaccgccgccctttctcagcgggccatggtgctgggcaagtctggcgagctgaaaacatggggcttggttttaggagccctgaaggccgccagagaagagcaagtgaccagcgagcaggctaagttctggctgggactgggcggcggaagagttagcccccctggccctgagtgcatcgagaagccagccacagagcggagaattgacaagggcgaagaggtgggagagacaaccgtccagcgggatgctaagatggctcccgaggaaaccgccacccctaagacagtgggcaccagctgctaccactgtggtaccgccatcggctgcaactgcgccaccgccagcgcccctcctcctccttatgtgggcagcggcctgtacccttccctggctggtgtcggagagcagcagggccagggcggcgacacccctagaggagctgagcaacctagagccgagccaggccacgccggcctggcccctggccccgccctgaccgattgggcccggatccgagaggaactggccagcacaggacctccagtggtcgccatgcctgtggtgatcaaaaccgagggccctgcttggacacctctggaacccaagctgatcaccagattggcggataccgtgcggacaaagggcctgagatcccctataaccatggccgaggtggaagcactgatgagcagccctctgctcccgcacgacgtgacaaacctcatgcgggtgatcctgggccctgccccttacgccctgtggatggacgcctggggcgtgcagctgcagaccgtgatcgccgccgccacaagagaccccagacaccccgccaacggccaggggaggggagaaagaaccaatctggaccggctgaagggcctggccgacggcatggtcggcaacccccagggccaggccgctctgctgagaccaggcgagctggtggccatcaccgccagcgccctgcaggccttcagagaggtggcccggctggccgagcctgccggaccctgggctgatatcacccagggcccttctgagagcttcgtggatttcgccaacagactgatcaaggccgtggaaggcagcgacctgccacccagcgccagagcccctgtgatcatcgactgttttagacagaaatcccagcccgatatccagcaactgatccgggccgccccgtctaccctgacgacccctggcgagatcatcaagtacgtgctggatcggcagaagatcgcccccctgacagaccagggcatcgctgctgctatgagcagcgccatccagcccctggtgatggccgtggtgaaccgcgagagagacggacaaacaggctcaggcggcagagccagacgtctgtgttacacctgcggcagccctggacactaccaggcccagtgccctaagaagcggaagagcggcaacagcagagaaagatgccagctgtgcgacggcatgggccataatgccaaacagtgtagacggagagatagcaaccagggccagcggcctggacgcgggctgagctctggcccttggcctgtgtctgagcagccggccgtgtccctggctatgaccatggaacacaaggacagacctctggtgcgggtgatcctgaccaataccggctcccaccctgtgaagcagaggagcgtgtacatcaccgctctgctggacagcggcgcagacatcaccatcatctctgaagaggactggcccaccgactggcctgtggtcgacaccgccaaccctcagatccacggcatcggaggcggcatccccatgagaaagagcagagatatgatcgagctgggcgtgattaaccgggacggctctctggaaagacctctgctgctgttccccgctgtggccatggtgagaggaagcattctcggaagagactgcctacaaggactgggcctgcggctgacaaacctgggcggcccactgttcctgctgctgcggtacatctggctgtttagaagcaatggcagccagacaacaagactgtgcggcctgacctccggcccattcctgaaggtgaacctgcggggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1804 - DNA, 5286 bp, synthetic construct
  misc_feature 1..5286: note = pXDP154 sequence
  source 1..5286: mol_type = other DNA
gccaccatggaagccgtgatcaaggtgatcagcagcgcttgtaaaacctactgcggcaagaccagcccttctaagaaagagatcggcgccatgctgagcctgctgcaaaaagaaggcctgctgatgagcccaagcgacctgtacagccctggctcgtgggaccccatcacagccgccctgagccagagagccatgatcctgggcaaatctggcgagctgaagacctggggcctcgtgctgggcgccctgaaagccgccagagaggagcaggtgacaagcgagcaggccaagttctggctgggcttgggaggcggcagagtgtctccacctggccccgagtgcatcgagaagcctgccaccgagagaagaatcgacaagggcgaggaagtgggagaaaccaccgtgcaacgtgatgccaagatggctcctgaagagacagccacaccaaagacagtgggtacaagctgctaccactgcggtacagccatcggatgtaactgcgccaccgccagcgccccgcctccaccctacgtgggctccggactgtatccttctctggccggcgtgggagagcaacagggccaaggaggcgacacccctcctggcgccgagcagagcagagccgagcctggccacgccggccaggccccaggccctgctctgaccgactgggccagagtcagagaggaactggccagcacgggccctcctgttgtggccatgcctgtggtgattaagaccgagggaccagcctggacccctctggagcctaagctgatcacccggctggccgataccgttagaacaaagggcctccgcagccccatcaccatggccgaggtcgaagctctaatgtcctctcccctgctgcctcacgacgtgaccaatctgatgagagtgatcctgggcccggctccttacgccctgtggatggacgcctggggagtgcagctgcagacagtgatcgccgccgctaccagagatcctagacaccccgctaacggacagggccggggagagcgaacaaacctgaaccggctgaaaggcctggccgatggcatggtcggcaatcctcagggccaggccgcactgctgagacctggcgagctggtggccatcacagcttcagccctgcaggcttttagagaagtggccagactggctgaacccgctggcccttgggccgacatcatgcagggcccttccgagagctttgtggacttcgccaaccggctgatcaaggccgtggaaggcagcgacctgcctccctctgccagagcccctgtgatcatcgattgcttccggcaaaaatcccagcctgatatccagcagctgatcagaaccgctcccagcactctgaccacacctggagagatcattaagtacgtgctggatagacagaagacagcccccctgaccgaccagggaatcgccgccgccatgagctctgccatccagcctctgatcatggccgtggtgaatcgcgagagagacggccagactggaagcggaggccgcgccagaggcctgtgctacacctgcggcagccccggccattaccaggcccagtgtcctaagaagcggaagtctggcaacagcagagaaagatgccagctgtgcaatggcatgggccacaacgccaagcagtgcagaaagagagatggcaaccagggccagcggcccggcaagggcctgtcttctggaccctggcctggccctgaacctccagccgtcagcctggccatgaccatggaacacaaggaccggcccctcgtgcgcgtgatcctgaccaacaccggcagccaccccgtcaagcagcggagcgtgtacatcaccgctctgctcgacagcggcgccgacatcaccatcattagcgaggaagattggcccaccgactggcctgtgatggaagccgccaacccccagatccacggcatcggaggcggcatccccatgagaaagagcagggacatgatcgagctgggcgtgatcaacagagacggctcactcgaaagaccactgctgctgttccccgccgtcgccatggtgcggggcagcatcctgggccgggactgtctgcagggcctgggtctgaggctgacaaacctgggcggacctctgttcagcctgctgcggtacatctggctgttcagaagtaacggctctcagaccaccagactgtgtggcctgaccagcggcccttccctgaaggtgaacctgcggggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1805 - DNA, 5280 bp, synthetic construct
  misc_feature 1..5280: note = pXDP155 sequence
  source 1..5280: mol_type = other DNA
gccaccatggaagccgtgatcaaagtgatcagcagcgcctgcaagacctactgcggcaagacaagcccttctaagaaagagatcggggccatgctgtctctgctgcaaaaagaaggcctgctgatgagcccctctgatctgtacagcccaggcagttgggaccctatcaccgccgccctcagccagagagccatgatcctgggaaaaagcggagagctgaagacttggggcctggtgctgggcgccctgaaagccgctagggaagagcaggtgacatctgagcaggctaaattctggctgggcctgggcggtggcagggtcagcccaccaggccccgagtgcatcgagaagcccgccaccgagcgcagaatcgataagggcgaggaagtgggcgagacaacagtgcagcgggatgccaagatggcccctgaagaggccgccacccctaagaccgttggcacatcatgctaccactgcggcaccgccgtgggctgtaactgcgccacagccacagcctctgcccctcctccaccctacgtgggcagcggcctttatcctagcctggccggcgtgggagaacagcagggccagggagatcgcgctgagcagcctagagaagagcccggacacgccggccaggctcctggacctgccctgacagactgggcccgggtgcgggaagagctggccagcacaggccctcctgtggttgccatgcctgtggtgatcaagaccgagggccctgcctggacccctctggaacccaagctgatcacacggctggccgacaccgtgcggaccaagggcctgcgaagcccaatcaccatggccgaggtggaggctctgatgagctctcctctcctgccccacgacgtgaccaacctgatgcgggtaatcctgggccccgccccttacgccctgtggatggacgcctggggagttcagttgcagacagtgattgccgctgccactcgggaccccagacaccctgctaatggccagggcagaggcgagcgcaccaacctggacagactgaagggcttggcagatggcatggtggggaatccgcagggccaagccgccctgctgaggccaggcgagctggtggccatcaccgcatctgccctgcaggccttcagagaggtggctagacttgctgagcctgccggaccttgggctgatatcacacagggcccaagcgagagcttcgtggacttcgccaaccggctgatcaaggccgtggaaggcagcgacctgcctcctacagcccgggcccctgtgattatcgactgcttccggcagaaatcccagcccgacatccagcaactgattagagccgcccctagcaccctgaccacccccggagaaatcatcaagtacgtgctggacagacagaagacagcccctctgacagatcaaggcatcgccgctgccatgagcagcgccattcagcccctggtgatggctgtggtcaacagagagagagacggccagaccggctccggcggaagagctagaggtctctgttacacctgcggctctcctggacattaccaggcccagtgtcctaagaagagaaagtccggcaacagcagagagagatgccagctgtgcgacggcatgggccacaacgccaagcaatgtagaaagcgggacggcaaccagggacagagacccggcagagggctgtcgagcggaccctggcctgggcctgagcagccagccgtgtccctggccatgaccatggaacacaaggaccggcccctggtcagagtgatcctgacaaataccggcagccaccccgtgaagcagagaagcgtgtacatcaccgccctgctggacagcggagctgacatcaccatcatcagcgaggaagattggcctaccgactggccggtggtggacaccgccaatcctcagatccacggcatcggcggcggcatccctatgagaaagtccagagatatgatcgaactgggcgtgatcaaccgggacggcagcctggaacggcctctgctgctgtttcctgctgtggccatggtccgaggaagcatcctgggcagagattgcctgcagggactgggccttcggctgaccaacctgggcggccccctgtttctgttactgagatacatctggctgttcagaagcaacggcagccaaaccacaagactgtgtggcctgacctctggccccttcctgagagtgaacctgagaggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1806 - DNA, 5286 bp, synthetic construct
  misc_feature 1..5286: note = pXDP156 sequence
  source 1..5286: mol_type = other DNA
gccaccatggaagccgtgatcaaagtgatcagcagcgcctgcaagacctactgcggcaagacaagcccttctaagaaagagattggggcgatgctgtctctgctgcaaaaagaaggcctgctgatgagcccttctgatctgtactcccccggcagctgggaccccatcaccgccgctctgagccaaagagccatggtgctgggcaaaagcggagagctcaagacctggggcctggtgctgggagccctgaaggccgctagagaggaacaggtgacctccgaacaagctaagttctggctgggcctgggaggtggccgggtgtcccctcctggcccagagtgcatcgagaagcctgccacagagcggagaatcgacaagggcgaggaggtgggcgaaaccaccgcccagagagatgccaagatggcccctgagaaaatggccacccctaagacggtgggcacaagctgctaccagtgcggcaccgctacaggctgtaattgcgccaccgcctctgctcctcctcccccatacgtgggctccggactgtaccctagcctggccggagtgggagaacaacagggtcagggaggcgacaccccttggggcgccgagcagccccgggccgagcccggccacgccggcctggcccctggcccagccctgacagattgggccagaatcagagaggaactggccagcaccggccccccagtggtggccatgcctgtggtcatcaagaccgagggccccgcctggacaccactggaacctaagctgatcaccagactggccgatacagtgcggacaaagggcctgcggagccctatcaccatggccgaagttgaggccctcatgagctctcctctgctgccccacgacgtgacaaatctgatgcgggtgatcctgggccccgccccttacgccctgtggatggacgcctggggcgtgcagctgcagaccgtgatcgctgctgctaccagagaccctagacaccctgctaatggccaaggccgtggcgagaggaccaacctggatagactgaaaggcctcgctgacggcatggccggcaaccccgagggccaggccgccctgctcagacccggcgagctggtggccattactgccagcgcactgcaggccttcagagaagtggccagattggctgagcctaccgacccctgggctgaaatcacacagggccctagcgagtcattcgtggacttcgccaatagactgatcaaggccgtggaagggtctgacctgcctccaagcgccagagccccggttatcatcgactgcttccggcagaagagccagcctgatatccagcagctgatccgggccgctccatctaccctgaccacccctggcgaaatcatcaagtacgtgctggaccggcagaaaactgcccctctgacagaccagggcatcgccgccgctatgagctccgccatccagcctctggtgatggccgtggtgaaccgggaaagagatggccaaacaggctctggtggccgggcccggggactttgttatacatgcggatcccccggccattaccaggcccagtgccctaagaagcggaagagcggcaacagcagagagcggtgccagctgtgcgacggcatgggccacaacgccaagcagtgtagacggcgggatggaaaccagggccagaggcctggcagaggactgagcagcggcagctggcctgtgtctgagcagcctgccgtgtccctggcaatgaccatggagcacaaggacagacctctggtcagagtgatcctgacaaacaccggcagccaccccgttaagcaaagaagcgtgtacatcaccgccctgctggacagcggcgccgacatcacaatcatcagcgaggaagattggcccaccgactggcctgtgatggaagccgctaaccctcagatccacggcatcggtggcggcatccctatgagaaagtccagagacatgatcgaggtgggcgtgatcaaccgcgacggcagcctggagagacccctgctgctgttccccgccgtggcaatggtcagaggtagtatcctgggcagagattgtctgcagggactgggcctgagactgaccaacctgggcggccccctgtttctgctcctgcgctacatctggttgtttagaagcaacggcagccagacaaccagactgtgtggcctgaccagcggacctttcctgaaggtgaaccttagaggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1807 - DNA, 5286 bp, synthetic construct
  misc_feature 1..5286: note = pXDP157 sequence
  source 1..5286: mol_type = other DNA
gccaccatggaagccgtgatcaaggtgatcagctctgcctgtaaaacctactgcggaaaaaccagccccagcaagaaggaaatcggcgccatgctgagcctgctgcaaaaagagggcctgctgatgagcccttctgatctgtacagccccggaagctgggaccccatcaccgccgctctgagccagcgggctatggtgctgggcaagagcggcgaactgaagacctggggactcgtgctgggagccctgaaggccgccagagaagaacaggtgaccagcgagcaggccaagttctggctgggcctgggcggtggcagagtgtcccccccaggccccgagtgcatcgagaagcctgccacagagagaagaatcgacaagggcgaggagggcggagagacaaccacccagcgggatgccaaaatggcgcctgaggaaaccgccactccaaagaccgtgggaacaagctgctaccactgcggcaccgccacaggttgtacatgcgccaccgccagcgctccacctccaccttatgtgggcagcggcctgtacccctccctggccggagtgggcgagcagcagggccaggagggcgacacaccccccagagccgagcagcctggcgctgagcctggccacgctggccaggcccctggccccgctctgaccgactgggccagagtgagagaagagctggccagcacaggccctcctgtggtggccatgcctgtggtgattaagaccgagggccctgcatggacacctctggaacccaagctgattacaagactggctgacaccgtgcggacaaagggcctgcgctctcctatcaccatggccgaggtggaagctctgatgagcagccccctcctgcctcacgacgtgacaaacctgatgcgggtgatcctgggcccagcgccttacgccctgtggatggacgcctggggcgtgcagctgcagaccgttatcgccgctgctacaagagatccaagacatcctgccaacggccagggcagaggcgaaagaaccaatctggacagacttaaggggctggccgacggcatggttggcaacccccagggccaggccgccctgctgaggcctggcgagctggtggccatcaccgcctctgccctgcaggcttttcgggaagtggccagactggctgagcctgccggcccttgggcggatatcacccagggaccatccgagagcttcgtggacttcgccaaccggctgatcaaggccgtggaaggatctgacctgcctccttctgcccgggctcctgtgatcatcgactgcttcagacagaaatctcagcccgacatccaacaactgatcagagccgccccatctacactgaccacccctggcgagatcatcaagtacgtgctggaccggcagaagaccgcccctctgaccgaccagggcatcgccgccgccatgagcagcgctatccagcctctggtcatggctgtggtcaacagagagagagacggacaaacaggctctggcggaagagcaagaggcctgtgttacacctgcggctctcctggacactaccaggcccagtgccctaagaaaagaaagagcggcaacagccgggaacggtgccagctgtgcgacggcatgggccacaacgccaagcagtgtagacgacgggacggctcccagggccaaagaccgggaagaggcctgagcagcggcccttggcctggcccagatcagcctgccgtcagcctggccatgaccatggaacacaaggacagacctctggtgcgggtgatcctgaccaacaccggcagccaccccgtgaagcagagaagcgtgtacatcaccgccctgctggatagcggagccgatatcaccatcatcagcgaggaggactggccaacagactggcccgtggttgacaccgccaatcctcagattcacggcatcggcggaggaatccctatgagaaagtcccgtgatatgatcgaggtgggcgtgatcaacagagatggtagcctggaaagacctctgctgctcttccccgccgtagccatggtccgggggtccatcctcggccgggattgtctgcagggcctgggcctgaggctgacaaatctgggaggccctctgtttctgctgctgagatacatctggctgagcagaagcaacggctctcagaccacaagactctgcggcctcaccagcggccccttcctgaaggtgaacctgagaggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1808 - DNA, 5286 bp, synthetic construct
  misc_feature 1..5286: note = pXDP158 sequence
  source 1..5286: mol_type = other DNA
gccaccatggaagccgtcatcaaggtgatcagctccgcatgcaagacatactgcggcaagacctcccctagcaagaaagagatcggagccatgctgtctctgctgcagaaagaaggcctgctgacaagcccttctgacctgtacagccccggaagctgggaccccatcacagccgccctgagccagagaaccatgatcctgggcaagagcggggagctcaagacctggggccttatcctgggcgccctgaaagccgccagagaggaacaagtgaccagcgagcaagctaagttctggctgggccttggaggcggaaaagtgtctccacctggacccgagtgcatcgagaaacctgccaccgagcgtagaatcgataagggcgaagaggccagagagacaaccgctcagcgggatgccatgatggccccagaagagacagtgaccccaaagacagtgggcaccagctgctaccactgcggcacagccatcggttgtaattgcgccacagcctccgcccctcctcctccatacgtgggctctggcctgtatcctagcctggccggcgtgggcgagaagcagggccaggagggagatacccctcctggcgccgagcagccaagggccgagcccggtcatgccggccaggcccccggccccgctctgaccgattgggccagaatcagagaggaactggccagcaccggccctcctgtggtggcgatgcccgtggttatcaagacagagggccctacctggacccctctggaacccaaactgatcaccagactggccgatacagtgcggaccaagggcctgcggagccctatcaccatggctgaagtggaagctcttatgagcagccccctgctgccccacgacgtgaccaacctgatgagagtgatccttggacctgccccctacgccctgtggatggacgcctggggcgtgcagctgcagaccgttatcgccgccgctacaagagaccctagacaccccgccaacggccagggcagaggcgagagaaccaacctggacagactgaagggcctggctgacggcatggtcggcaatcctcagggccaggccgccctgctccggcctggcgagctggtggccatcaccgcctctgccctgcaggccttccgggaggtggcccggctggccgagcccgctggcccttgggccgatatcacccagggccccagcgagagcttcgtggacttcgccaatagactgatcaaagccgtggaaggcagcgacctgcctcccagcgccagagcccctgtgatcatcgactgcttcagacagaagagccagcctgatatccagcagctgatcagagccgccccttccaccctgaccacacctggcgagatcatcaagtacgtgctggatagacagaagacagctccactcaccgaccagggcatcgccgctgcgatgagcagcgctattcagccactggtcatggcggtcgtgaaccgtgagagagacggacaaacaggcagcggcggcagagcaagaggcctgtgttacacctgtggaagccctggccactaccaggctcaatgtcctaagaagagaaagagcggaaacagcagagaacggtgccagctgtgcgacggcatcggccacaacgccaagcagtgcagaaagcgggacggcaaccagggccagagacctggcagaggtctgagctctggcccttggcctggaccagagcctcctgccgtgtccctggctatgaccatggaacacagagaccggcccctggtgcgcgtgatcctgactaacaccggcagccaccctgtgaagcagcgcagcgtgtacatcaccgccctgctggacagcggcgccgacatcaccatcatttctgaagaagattggcccaccgactggcctgtggtggacacagccaacccccaaatccacggcatcggcggaggcatccctatgcggaagtcgagagatatgatcgagctgggcgtgatcaaccgggacggctctctggaacggcccctgctgctgtttcctgccgtggccatggtgcggggatcaatcctgggcagagattgcctgcaaggcctgggcctgcggctgaccaacctgggaggacctctgttcctgctgctgcggtacatctggctgtttcacagcagcggctcccagaccactaggccatgtggcctgaccagcggcccgttcctgagagtgaacctgaggggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1809 - DNA, 5286 bp, synthetic construct
  misc_feature 1..5286: note = pXDP159 sequence
  source 1..5286: mol_type = other DNA
gccaccatggaagccgtgatcaaggtgatctccagcacttgcaagacctactgcggcaagacatctcctagcaaaaaagagatcggcgccatgctgagcctgctgcaaaaggaaggcctgctgatgagcccttccgatctgtattctcccggctcctgggaccctatcacagccgccctgtctcagcgggctatggtgctgggcaaaagcggagaactgaaaacctggggcctggtgctgggtgctctgaaggccgccagagaggaaagagtgacatctgagcaggccaaattctggctgggcctgggcggcgggagagtgagcccacctggccccgagtgcatcgagaagcctgctacagagagaaggatcgacaagggcgaagaggtgggcgaaaccaccgtgcagagagatgccaagatggcccctgagggcaccgccacccccaagacagtgggcacaagctgctaccactgcggaaccgccattggatgtaactgcgccaccgccagcgcccctccacctccttacgtgggaagtggcctatatcctagcctggccggcgttggcgagcagcagggccagggcggcgacaccccgcggggcgccgagcagcctagagccgagcctggccacgccggcctggcccctgggccagccctgaccgactgggccagaatcagagaagagctggccagcaccggcccccccgtggtcgccatgcctgtggtgatcaagaccgaaggccccgcttggacaccactggaacctaagctgatcacaagactggccgacaccgtgcggaccaagggcctgagaagccccatcacaatggccgaagtcgaggccctgatgagcagccctctcctgcctcatgatgtgaccaacctgatgcgggtaatcctgggaccggcaccctacgccctgtggatggacgcctggggcgtgcagctgcagaccgttatcgccgccgcaacaagagacccaagacaccctgccaacggccagggccgcggagagagaaccaacctggatagactcaagggcttggctgatggcatggctggcaatcctgagggccaagctgccctcctgagaccaggcgagctggtggccatcacagcctctgcgctgcaggctttccgggaagtggctagactggctgagcccacagacccctgggccgagatcacccagggaccttctgagagcttcgtggacttcgccaatagactgatcaaggccgtggaaggaagcgacctgcctcctagcgcccgcgccccagtgatcattgactgcttcagacaaaaaagccagcctgacatccaacagctgatccgggccgctccatctacactgaccacccctggggagatcatcaagtacgtgctggaccggcagaagaccgctcccctgaccgaccagggcatcgccgccgccatgagcagcgccatccagccccttgttatggccgtggtgaaccgggagcgggatggccagaccggctccggcggcagagccagaggtctgtgttacacctgtggaagccctggccactaccaggcccagtgtcctaagaagagaaagagcggaaatagcagagagcgttgccagctgtgcgacggcatgggccacaacgccaagcagtgcagacggagagacggaaaccagggccagcggcctggcagaggcctgagcagcggcccctggccagtgtctgaacagccagccgtgtccctggctatgaccatggagcacaaggacagacccctggtgcggatcgtgcctacctgttccggctctcaccccgtgaagcagcggagcgtgtacatcaccgccctgctggacagcggcgctgatatcaccatcatcagcgaggaggactggcctacagattggcctgtgatggaagccgccaaccctcagatccacggcatcggcggaggcatccccatgagaaagagcagagacatgatcgaagtcggcgtgatcaacagagatggctcactggaacggcctctgctgctgttccctgccgtggctatggtcagaggaagcatcctgggcagagattgcctgcaaggactcggcctccgcctgacaaacctgggcggacctctgtttctgctgctgcggtacatatggctgtttcggagcaacggcagccaaacaaccagactgtgcggcctgacatctggccctttcctgaaggtgaacctacgaggtgccaccagctgctaccactgcggcaccggcggcagcccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1810 - DNA, 4953 bp, synthetic construct
  misc_feature 1..4953: note = pXDP190 sequence
  source 1..4953: mol_type = other DNA
gaattcgccaccatggaagctgtgattaaggtgatctcctctgcctgcaagacctactgcggcaagacctccccctctaagaaggaaatcggcgccatgctgagcctgctgcagaaagagggactgctgatgagcccttccgacctgtacagccccggcagctgggaccccatcaccgccgctctgagccagagagccatggtgctcggaaagagcggcgaactgaagacctggggcctggtgctgggcgccttaaaggctgctagggaggaacaagtgacaagcgaacaggccaagttctggctgggcttgggcggcggccgggtgtcccctcctggccctgagtgcatcgagaagcctgccacagagagaagaatcgacaagggagaagaggccggcgagaccacagctcagagagacgtaaaaatggcccctgaggaaaccgccgcccctaagaccgtggggacctcatgctaccactgtggcacagccatcggatgtaattgcgccaccgcttctgccccaccccccccctacgtgggaagcggcctttatcctagcctggccggcgtgggcgagcagcagggccaaggcggcgacacccctagaggcgctgagcagccacgggccgagcctggccacgccggacaggcccctggccccgcactgacagattgggctagagtgagagaggagctggccagcacaggccctcctgtagtggccatgcctgtggtcattaagacagagggacctgcctggacccctctggaaccaaagctgatcacccggctggctgatacagtgcgaacaaagggcctgcgcagccccatcaccatggccgaggtggaagccctgatgtccagcccgctgctgcctcatgatgtgaccaacctgatgagagtgatcctgggacccgccccttacgccctgtggatggacgcctggggagtgcagctgcaaaccgtgatcgccgcagccaccagagatcctcggcaccccgccaacggccagggccggggcgagagaaccaacctggacagactgaaaggcctggccgacggcatggttggaaatccacagggacaggctgctctgctgcggcctggcgagctggtggccatcacagcctctgccctgcaggccttcagagaggtggccagactggccgaacctgccggcccttgggccgatatcacccagggccctagcgagagcttcgtggacttcgccaatagactgatcaaggccgttgagggctctgatctgccccccagcgccagagcccccgtgatcattgactgttttagacagaagagccaacctgacatccagcaactgatccgggccgccccgtctacactgacaacccccggagaaatcatcaagtacgtgctggatagacagaagacagcccctctgaccgatcagggcatcgccgcggccatgagctcagccatccagcctctcgtgatggccgtggtgaacagagaaagggatggacagaccggaagcggcggcagggccagaggcctgtgttacacatgcggaagcccaggccactaccaggcccagtgtcctaagaaaagaaagagcggcaacagcagagaacggtgccagctgtgcgacggcatggggcacaacgccaaacagtgcagaaaaagagacggcaaccagggccagagacctggcagaggcctgtctagcggcccctggcctggcccagagcctccagccgtgagcggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1811 - DNA, 4947 bp, synthetic construct
  misc_feature 1..4947: note = pXDP191 sequence
  source 1..4947: mol_type = other DNA
gccaccatggaggccgtgatcaaagtgatcagcagcgcctgtaaaacctactgcggaaaaacaagcccaagcaagaaagagatcggcgcaatgctgtcactgctgcaaaaggaaggcctgctgatgtctcctagcgacctgtacagccctggttcctgggaccctatcactgccgctctcagccagagagcgatggtgctgggcaagtctggggagctgaaaacctggggcctggtgctgggcgctctgaaggccgccagagaggagcaggtgacctctgaacaggcaaagttctggctggggctgggaggaggaagagtgtccccacctggacctgagtgcattgagaagcccgccacagagagaagaaccgacaagggcgaagaggtgggcgagaccaccgctcacggagatgccaagatggcccctgaggaaaccgctacacctaagacagtgggcaccagctgctaccactgcggcacagccatcggatgtagctgcgccacagccagcgcccctcctcctccttatgtgggctccggcctgtatcctagcctggccggagtgggagagcagcagggccaggagggcgacacccctcggggcgccgaacagccaagagcggagccaggacacgccggcctggcccccggcccagccctaaccgactgggcccgggtgagagaggaactggcttctacaggcccccctgtggtggccatgcctgtggtgatcaagaccgagggccctgcctggacacctctggaacctaagctgatcaccagactggccgataccgtgcggaccaagggcctgagatctcccatcaccatggccgaggtggaagccctgatgagcagccctctgctgccccacgacgtgaccaatctgatgcgggtgatcctgggccccgccccttacgccctgtggatggacgcctggggcgtgcagctgcaaacagtgatagctgccgcaacaagagatcctagacaccccgccaacggccagggccgcggagagcggaccaacctggaccggctgaagggcctggccgacggcatggtgggcaacccccagggccaggctgccctgctgagacctggcgagctggtcgccatcacagccgccgccctgcaggccttccgggaggttgccagactggcggaacctgccggtccttgggccgatatcacacagggcccctctgagcccttcgtggacttcgccaataggctgatcaaagccgttgagggctctgatctgcctccttcggctagggccccggtgatcatcgactgcttccggcagaaaagccagcctgatatccagcaactcatcagagccgccccttctaccctgaccacacctggggaaatcatcaagtacgtgctggatagacaaaagaccgctcctctgaccgaccagggcatcgctgctgctatgagcagcgccatccagcccctcgtgatggctgtcgtcaaccgggaacgggatggccagaccggctccggcggcagagccagaggcctgtgttacacctgtggcagccctggtcattaccaggcccagtgtcctaaaaagcggaagtccggaaacagcagagagcggtgccagctgtgcgacggcatgggccacaacgccaagcagtgcagaaagagagacggcaaccagggacaaagacctggcagaggcctgtccagcggcccctggcccgtgtccgaacctccagccgtcagcggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1812 - DNA, 4953 bp, synthetic construct
  misc_feature 1..4953: note = pXDP192 sequence
  source 1..4953: mol_type = other DNA
gccaccatggaagccgtgattaaggtcatcagctccgcctgcaagacctactgtgggaagaccagccccagcaagaaggaaatcggcgctatgctgagcctgctgcagaaagagggcctgctgatgagcccttctgatctgtacagccctggcagctgggaccccatcacagctgccctgacccagagagccatggtgctgggcaaaagcggcgagctgaagacctggggcctggtgctgggagctctgaaggccgcgagagaagagcaggtgacctctgagcaggccaagttctggctgggcctgggcggcggaagagtgtcccctcctggccccgagtgcatcgagaagcccgccaccgagcggcggatcgacaagggcgaagaggttggcgagacaaccgtgcagagagacgccaaaatggcccccgaggaaaccgccacccctaaaacagtcggtacgtcttgctaccactgcggcaccgccatcggctgcaactgcgccaccacaaccgcttcagcccctcctcctccatacgtgggaagtggactttatcctagcctggctggcgtgggcgagcaacagggccaaggcggagatacacccagaggcgctgagcagccaagagccgaacccggccacgccggccaggcccctggcccagccttgaccgattgggccagagtgcgggaagaactggccagcaccggccctcctgtcgtggccatgcccgtggtgatcaagacagagggccctgcatggacccctctggaacctaagctgatcacacgcctggctgacaccgtgagaacaaagggactgagaagccctatcacaatggctgaggtggaagccctgatgagctcccctctgctgccgcacgacgtgacaaacctgatgagagtgatcctgggtcccgcgccttacgccctctggatggacgcctggggagtgcagctgcagacagtgatcgccgccgcaaccagagatcctcggcaccctgctaacggccagggcaggggcgagagaaccaacttggatagactgaagggcctggctgatggcatggttggaaaccctcagggccaggccgcactgctgaggcctggcgagctggtggccatcaccgccagcgccctgcaagccttcagagaggtggcccggctcgccgaacccgccggcccctgggccgatatcacccagggaccctctgagagcttcgtggacttcgccaatagactgatcaaagccgtggaaggcagcgacctgcctccatcggccagagccccagtgattattgactgttttagacagaagtctcagcctgacatccagcagctgataagagccgctccatccaccctgaccacacctggagagatcatcaaatacgtgctggacagacagaagacagcccctctgacagatcagggcatcgccgctgccatgagctctgctatccaacctctggtgatggccgtggtgaacagagagagagacggccagaccggctctggcggccgggtgcggggactgtgttacacatgcggcagccctggccactatcaggcccagtgtcctaagaaaagaaagagcggcaatagcagagagcgctgccagctgtgcgacggaatgggccataatgccaagcagtgcagaagaagagacggcaaccaagggcagagacctggcagaggcctcagcagcgggccttggcccggaccagaccagcccgctgtgtctggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1813 - DNA, 4947 bp, synthetic construct
  misc_feature 1..4947: note = pXDP193 sequence
  source 1..4947: mol_type = other DNA
gccaccatggaagccgtgatcaaggtgatcagctccgcttgtaaaacctactgcggaaaaacaagcccaagcaagaaggaaatcggcgctatgctgagcctgctgcagaaagagggcctcctgatgtctcctagcgatctgtacagccccggcagctgggaccctatcaccgccgccctttctcagcgggccatggtgctgggcaagtctggcgagctgaaaacatggggcttggttttaggagccctgaaggccgccagagaagagcaagtgaccagcgagcaggctaagttctggctgggactgggcggcggaagagttagcccccctggccctgagtgcatcgagaagccagccacagagcggagaattgacaagggcgaagaggtgggagagacaaccgtccagcgggatgctaagatggctcccgaggaaaccgccacccctaagacagtgggcaccagctgctaccactgtggtaccgccatcggctgcaactgcgccaccgccagcgcccctcctcctccttatgtgggcagcggcctgtacccttccctggctggtgtcggagagcagcagggccagggcggcgacacccctagaggagctgagcaacctagagccgagccaggccacgccggcctggcccctggccccgccctgaccgattgggcccggatccgagaggaactggccagcacaggacctccagtggtcgccatgcctgtggtgatcaaaaccgagggccctgcttggacacctctggaacccaagctgatcaccagattggcggataccgtgcggacaaagggcctgagatcccctataaccatggccgaggtggaagcactgatgagcagccctctgctcccgcacgacgtgacaaacctcatgcgggtgatcctgggccctgccccttacgccctgtggatggacgcctggggcgtgcagctgcagaccgtgatcgccgccgccacaagagaccccagacaccccgccaacggccaggggaggggagaaagaaccaatctggaccggctgaagggcctggccgacggcatggtcggcaacccccagggccaggccgctctgctgagaccaggcgagctggtggccatcaccgccagcgccctgcaggccttcagagaggtggcccggctggccgagcctgccggaccctgggctgatatcacccagggcccttctgagagcttcgtggatttcgccaacagactgatcaaggccgtggaaggcagcgacctgccacccagcgccagagcccctgtgatcatcgactgttttagacagaaatcccagcccgatatccagcaactgatccgggccgccccgtctaccctgacgacccctggcgagatcatcaagtacgtgctggatcggcagaagatcgcccccctgacagaccagggcatcgctgctgctatgagcagcgccatccagcccctggtgatggccgtggtgaaccgcgagagagacggacaaacaggctcaggcggcagagccagacgtctgtgttacacctgcggcagccctggacactaccaggcccagtgccctaagaagcggaagagcggcaacagcagagaaagatgccagctgtgcgacggcatgggccataatgccaaacagtgtagacggagagatagcaaccagggccagcggcctggacgcgggctgagctctggcccttggcctgtgtctgagcagccggccgtgtccggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1814 - DNA, 4947 bp, synthetic construct
  misc_feature 1..4947: note = pXDP194 sequence
  source 1..4947: mol_type = other DNA
gccaccatggaagccgtgatcaaggtgatcagcagcgcttgtaaaacctactgcggcaagaccagcccttctaagaaagagatcggcgccatgctgagcctgctgcaaaaagaaggcctgctgatgagcccaagcgacctgtacagccctggctcgtgggaccccatcacagccgccctgagccagagagccatgatcctgggcaaatctggcgagctgaagacctggggcctcgtgctgggcgccctgaaagccgccagagaggagcaggtgacaagcgagcaggccaagttctggctgggcttgggaggcggcagagtgtctccacctggccccgagtgcatcgagaagcctgccaccgagagaagaatcgacaagggcgaggaagtgggagaaaccaccgtgcaacgtgatgccaagatggctcctgaagagacagccacaccaaagacagtgggtacaagctgctaccactgcggtacagccatcggatgtaactgcgccaccgccagcgccccgcctccaccctacgtgggctccggactgtatccttctctggccggcgtgggagagcaacagggccaaggaggcgacacccctcctggcgccgagcagagcagagccgagcctggccacgccggccaggccccaggccctgctctgaccgactgggccagagtcagagaggaactggccagcacgggccctcctgttgtggccatgcctgtggtgattaagaccgagggaccagcctggacccctctggagcctaagctgatcacccggctggccgataccgttagaacaaagggcctccgcagccccatcaccatggccgaggtcgaagctctaatgtcctctcccctgctgcctcacgacgtgaccaatctgatgagagtgatcctgggcccggctccttacgccctgtggatggacgcctggggagtgcagctgcagacagtgatcgccgccgctaccagagatcctagacaccccgctaacggacagggccggggagagcgaacaaacctgaaccggctgaaaggcctggccgatggcatggtcggcaatcctcagggccaggccgcactgctgagacctggcgagctggtggccatcacagcttcagccctgcaggcttttagagaagtggccagactggctgaacccgctggcccttgggccgacatcatgcagggcccttccgagagctttgtggacttcgccaaccggctgatcaaggccgtggaaggcagcgacctgcctccctctgccagagcccctgtgatcatcgattgcttccggcaaaaatcccagcctgatatccagcagctgatcagaaccgctcccagcactctgaccacacctggagagatcattaagtacgtgctggatagacagaagacagcccccctgaccgaccagggaatcgccgccgccatgagctctgccatccagcctctgatcatggccgtggtgaatcgcgagagagacggccagactggaagcggaggccgcgccagaggcctgtgctacacctgcggcagccccggccattaccaggcccagtgtcctaagaagcggaagtctggcaacagcagagaaagatgccagctgtgcaatggcatgggccacaacgccaagcagtgcagaaagagagatggcaaccagggccagcggcccggcaagggcctgtcttctggaccctggcctggccctgaacctccagccgtcagcggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1815 - DNA, 4941 bp, synthetic construct
  misc_feature 1..4941: note = pXDP195 sequence
  source 1..4941: mol_type = other DNA
gccaccatggaagccgtgatcaaagtgatcagcagcgcctgcaagacctactgcggcaagacaagcccttctaagaaagagatcggggccatgctgtctctgctgcaaaaagaaggcctgctgatgagcccctctgatctgtacagcccaggcagttgggaccctatcaccgccgccctcagccagagagccatgatcctgggaaaaagcggagagctgaagacttggggcctggtgctgggcgccctgaaagccgctagggaagagcaggtgacatctgagcaggctaaattctggctgggcctgggcggtggcagggtcagcccaccaggccccgagtgcatcgagaagcccgccaccgagcgcagaatcgataagggcgaggaagtgggcgagacaacagtgcagcgggatgccaagatggcccctgaagaggccgccacccctaagaccgttggcacatcatgctaccactgcggcaccgccgtgggctgtaactgcgccacagccacagcctctgcccctcctccaccctacgtgggcagcggcctttatcctagcctggccggcgtgggagaacagcagggccagggagatcgcgctgagcagcctagagaagagcccggacacgccggccaggctcctggacctgccctgacagactgggcccgggtgcgggaagagctggccagcacaggccctcctgtggttgccatgcctgtggtgatcaagaccgagggccctgcctggacccctctggaacccaagctgatcacacggctggccgacaccgtgcggaccaagggcctgcgaagcccaatcaccatggccgaggtggaggctctgatgagctctcctctcctgccccacgacgtgaccaacctgatgcgggtaatcctgggccccgccccttacgccctgtggatggacgcctggggagttcagttgcagacagtgattgccgctgccactcgggaccccagacaccctgctaatggccagggcagaggcgagcgcaccaacctggacagactgaagggcttggcagatggcatggtggggaatccgcagggccaagccgccctgctgaggccaggcgagctggtggccatcaccgcatctgccctgcaggccttcagagaggtggctagacttgctgagcctgccggaccttgggctgatatcacacagggcccaagcgagagcttcgtggacttcgccaaccggctgatcaaggccgtggaaggcagcgacctgcctcctacagcccgggcccctgtgattatcgactgcttccggcagaaatcccagcccgacatccagcaactgattagagccgcccctagcaccctgaccacccccggagaaatcatcaagtacgtgctggacagacagaagacagcccctctgacagatcaaggcatcgccgctgccatgagcagcgccattcagcccctggtgatggctgtggtcaacagagagagagacggccagaccggctccggcggaagagctagaggtctctgttacacctgcggctctcctggacattaccaggcccagtgtcctaagaagagaaagtccggcaacagcagagagagatgccagctgtgcgacggcatgggccacaacgccaagcaatgtagaaagcgggacggcaaccagggacagagacccggcagagggctgtcgagcggaccctggcctgggcctgagcagccagccgtgtccggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1816 - DNA, 4947 bp, synthetic construct
  misc_feature 1..4947: note = pXDP196 sequence
  source 1..4947: mol_type = other DNA
gccaccatggaagccgtgatcaaagtgatcagcagcgcctgcaagacctactgcggcaagacaagcccttctaagaaagagattggggcgatgctgtctctgctgcaaaaagaaggcctgctgatgagcccttctgatctgtactcccccggcagctgggaccccatcaccgccgctctgagccaaagagccatggtgctgggcaaaagcggagagctcaagacctggggcctggtgctgggagccctgaaggccgctagagaggaacaggtgacctccgaacaagctaagttctggctgggcctgggaggtggccgggtgtcccctcctggcccagagtgcatcgagaagcctgccacagagcggagaatcgacaagggcgaggaggtgggcgaaaccaccgcccagagagatgccaagatggcccctgagaaaatggccacccctaagacggtgggcacaagctgctaccagtgcggcaccgctacaggctgtaattgcgccaccgcctctgctcctcctcccccatacgtgggctccggactgtaccctagcctggccggagtgggagaacaacagggtcagggaggcgacaccccttggggcgccgagcagccccgggccgagcccggccacgccggcctggcccctggcccagccctgacagattgggccagaatcagagaggaactggccagcaccggccccccagtggtggccatgcctgtggtcatcaagaccgagggccccgcctggacaccactggaacctaagctgatcaccagactggccgatacagtgcggacaaagggcctgcggagccctatcaccatggccgaagttgaggccctcatgagctctcctctgctgccccacgacgtgacaaatctgatgcgggtgatcctgggccccgccccttacgccctgtggatggacgcctggggcgtgcagctgcagaccgtgatcgctgctgctaccagagaccctagacaccctgctaatggccaaggccgtggcgagaggaccaacctggatagactgaaaggcctcgctgacggcatggccggcaaccccgagggccaggccgccctgctcagacccggcgagctggtggccattactgccagcgcactgcaggccttcagagaagtggccagattggctgagcctaccgacccctgggctgaaatcacacagggccctagcgagtcattcgtggacttcgccaatagactgatcaaggccgtggaagggtctgacctgcctccaagcgccagagccccggttatcatcgactgcttccggcagaagagccagcctgatatccagcagctgatccgggccgctccatctaccctgaccacccctggcgaaatcatcaagtacgtgctggaccggcagaaaactgcccctctgacagaccagggcatcgccgccgctatgagctccgccatccagcctctggtgatggccgtggtgaaccgggaaagagatggccaaacaggctctggtggccgggcccggggactttgttatacatgcggatcccccggccattaccaggcccagtgccctaagaagcggaagagcggcaacagcagagagcggtgccagctgtgcgacggcatgggccacaacgccaagcagtgtagacggcgggatggaaaccagggccagaggcctggcagaggactgagcagcggcagctggcctgtgtctgagcagcctgccgtgtccggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1817 - DNA, 4947 bp, synthetic construct
  misc_feature 1..4947: note = pXDP197 sequence
  source 1..4947: mol_type = other DNA
gccaccatggaagccgtgatcaaggtgatcagctctgcctgtaaaacctactgcggaaaaaccagccccagcaagaaggaaatcggcgccatgctgagcctgctgcaaaaagagggcctgctgatgagcccttctgatctgtacagccccggaagctgggaccccatcaccgccgctctgagccagcgggctatggtgctgggcaagagcggcgaactgaagacctggggactcgtgctgggagccctgaaggccgccagagaagaacaggtgaccagcgagcaggccaagttctggctgggcctgggcggtggcagagtgtcccccccaggccccgagtgcatcgagaagcctgccacagagagaagaatcgacaagggcgaggagggcggagagacaaccacccagcgggatgccaaaatggcgcctgaggaaaccgccactccaaagaccgtgggaacaagctgctaccactgcggcaccgccacaggttgtacatgcgccaccgccagcgctccacctccaccttatgtgggcagcggcctgtacccctccctggccggagtgggcgagcagcagggccaggagggcgacacaccccccagagccgagcagcctggcgctgagcctggccacgctggccaggcccctggccccgctctgaccgactgggccagagtgagagaagagctggccagcacaggccctcctgtggtggccatgcctgtggtgattaagaccgagggccctgcatggacacctctggaacccaagctgattacaagactggctgacaccgtgcggacaaagggcctgcgctctcctatcaccatggccgaggtggaagctctgatgagcagccccctcctgcctcacgacgtgacaaacctgatgcgggtgatcctgggcccagcgccttacgccctgtggatggacgcctggggcgtgcagctgcagaccgttatcgccgctgctacaagagatccaagacatcctgccaacggccagggcagaggcgaaagaaccaatctggacagacttaaggggctggccgacggcatggttggcaacccccagggccaggccgccctgctgaggcctggcgagctggtggccatcaccgcctctgccctgcaggcttttcgggaagtggccagactggctgagcctgccggcccttgggcggatatcacccagggaccatccgagagcttcgtggacttcgccaaccggctgatcaaggccgtggaaggatctgacctgcctccttctgcccgggctcctgtgatcatcgactgcttcagacagaaatctcagcccgacatccaacaactgatcagagccgccccatctacactgaccacccctggcgagatcatcaagtacgtgctggaccggcagaagaccgcccctctgaccgaccagggcatcgccgccgccatgagcagcgctatccagcctctggtcatggctgtggtcaacagagagagagacggacaaacaggctctggcggaagagcaagaggcctgtgttacacctgcggctctcctggacactaccaggcccagtgccctaagaaaagaaagagcggcaacagccgggaacggtgccagctgtgcgacggcatgggccacaacgccaagcagtgtagacgacgggacggctcccagggccaaagaccgggaagaggcctgagcagcggcccttggcctggcccagatcagcctgccgtcagcggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1818 - DNA, 4947 bp, synthetic construct
  misc_feature 1..4947: note = pXDP198 sequence
  source 1..4947: mol_type = other DNA
gccaccatggaagccgtcatcaaggtgatcagctccgcatgcaagacatactgcggcaagacctcccctagcaagaaagagatcggagccatgctgtctctgctgcagaaagaaggcctgctgacaagcccttctgacctgtacagccccggaagctgggaccccatcacagccgccctgagccagagaaccatgatcctgggcaagagcggggagctcaagacctggggccttatcctgggcgccctgaaagccgccagagaggaacaagtgaccagcgagcaagctaagttctggctgggccttggaggcggaaaagtgtctccacctggacccgagtgcatcgagaaacctgccaccgagcgtagaatcgataagggcgaagaggccagagagacaaccgctcagcgggatgccatgatggccccagaagagacagtgaccccaaagacagtgggcaccagctgctaccactgcggcacagccatcggttgtaattgcgccacagcctccgcccctcctcctccatacgtgggctctggcctgtatcctagcctggccggcgtgggcgagaagcagggccaggagggagatacccctcctggcgccgagcagccaagggccgagcccggtcatgccggccaggcccccggccccgctctgaccgattgggccagaatcagagaggaactggccagcaccggccctcctgtggtggcgatgcccgtggttatcaagacagagggccctacctggacccctctggaacccaaactgatcaccagactggccgatacagtgcggaccaagggcctgcggagccctatcaccatggctgaagtggaagctcttatgagcagccccctgctgccccacgacgtgaccaacctgatgagagtgatccttggacctgccccctacgccctgtggatggacgcctggggcgtgcagctgcagaccgttatcgccgccgctacaagagaccctagacaccccgccaacggccagggcagaggcgagagaaccaacctggacagactgaagggcctggctgacggcatggtcggcaatcctcagggccaggccgccctgctccggcctggcgagctggtggccatcaccgcctctgccctgcaggccttccgggaggtggcccggctggccgagcccgctggcccttgggccgatatcacccagggccccagcgagagcttcgtggacttcgccaatagactgatcaaagccgtggaaggcagcgacctgcctcccagcgccagagcccctgtgatcatcgactgcttcagacagaagagccagcctgatatccagcagctgatcagagccgccccttccaccctgaccacacctggcgagatcatcaagtacgtgctggatagacagaagacagctccactcaccgaccagggcatcgccgctgcgatgagcagcgctattcagccactggtcatggcggtcgtgaaccgtgagagagacggacaaacaggcagcggcggcagagcaagaggcctgtgttacacctgtggaagccctggccactaccaggctcaatgtcctaagaagagaaagagcggaaacagcagagaacggtgccagctgtgcgacggcatcggccacaacgccaagcagtgcagaaagcgggacggcaaccagggccagagacctggcagaggtctgagctctggcccttggcctggaccagagcctcctgccgtgtccggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1819 - DNA, 4947 bp, synthetic construct
  misc_feature 1..4947: note = pXDP199 sequence
  source 1..4947: mol_type = other DNA
gccaccatggaagccgtgatcaaggtgatctccagcacttgcaagacctactgcggcaagacatctcctagcaaaaaagagatcggcgccatgctgagcctgctgcaaaaggaaggcctgctgatgagcccttccgatctgtattctcccggctcctgggaccctatcacagccgccctgtctcagcgggctatggtgctgggcaaaagcggagaactgaaaacctggggcctggtgctgggtgctctgaaggccgccagagaggaaagagtgacatctgagcaggccaaattctggctgggcctgggcggcgggagagtgagcccacctggccccgagtgcatcgagaagcctgctacagagagaaggatcgacaagggcgaagaggtgggcgaaaccaccgtgcagagagatgccaagatggcccctgagggcaccgccacccccaagacagtgggcacaagctgctaccactgcggaaccgccattggatgtaactgcgccaccgccagcgcccctccacctccttacgtgggaagtggcctatatcctagcctggccggcgttggcgagcagcagggccagggcggcgacaccccgcggggcgccgagcagcctagagccgagcctggccacgccggcctggcccctgggccagccctgaccgactgggccagaatcagagaagagctggccagcaccggcccccccgtggtcgccatgcctgtggtgatcaagaccgaaggccccgcttggacaccactggaacctaagctgatcacaagactggccgacaccgtgcggaccaagggcctgagaagccccatcacaatggccgaagtcgaggccctgatgagcagccctctcctgcctcatgatgtgaccaacctgatgcgggtaatcctgggaccggcaccctacgccctgtggatggacgcctggggcgtgcagctgcagaccgttatcgccgccgcaacaagagacccaagacaccctgccaacggccagggccgcggagagagaaccaacctggatagactcaagggcttggctgatggcatggctggcaatcctgagggccaagctgccctcctgagaccaggcgagctggtggccatcacagcctctgcgctgcaggctttccgggaagtggctagactggctgagcccacagacccctgggccgagatcacccagggaccttctgagagcttcgtggacttcgccaatagactgatcaaggccgtggaaggaagcgacctgcctcctagcgcccgcgccccagtgatcattgactgcttcagacaaaaaagccagcctgacatccaacagctgatccgggccgctccatctacactgaccacccctggggagatcatcaagtacgtgctggaccggcagaagaccgctcccctgaccgaccagggcatcgccgccgccatgagcagcgccatccagccccttgttatggccgtggtgaaccgggagcgggatggccagaccggctccggcggcagagccagaggtctgtgttacacctgtggaagccctggccactaccaggcccagtgtcctaagaagagaaagagcggaaatagcagagagcgttgccagctgtgcgacggcatgggccacaacgccaagcagtgcagacggagagacggaaaccagggccagcggcctggcagaggcctgagcagcggcccctggccagtgtctgaacagccagccgtgtccggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1820 - DNA, 4947 bp, synthetic construct
  misc_feature 1..4947: note = pXDP200 sequence
  source 1..4947: mol_type = other DNA
gccaccatggaagccgtgatcaaggtgatcagctccgcatgcaagacctactgtggcaagacgagcccaagcaagaaggaaatcggcgctatgctgagcctgctgcagaaggagggcctcctgatgagcctgtctgatctgtacagcccaggtagctgggaccctatcaccgccgccctgacacagagagccatggtgctgggcaaaagcggcgagctgaagacatggggactggtgctgggcgccctgaaagccgctagagaagagcaagtaaccagcgagcaggccaagttctggctgggactgggcggcggtagagtgagcccccctggccctgagtgcatcgagaagcctgccaccgagcggcgcattgacaaaggcgaagaagtgggcgagacaaccgtgcagagagacgccaagatggctccagaagagacagcaaccccaaagaccgtgggcaccagctgctaccactgcggcaccgctatcggctgcaactgcgccaccgccagcgcgcctcctcccccgtatgtgggcagcggcctctacccctccctggcaggagtgggagagcagcagggccagggcggagatacacccagaggcgccgagcagcctagagccgaacccggccacgccggccaggcccctggccccgccctgaccgactgggccagaatcagagaggagctggcctctacaggccctccagtggtcgccatgcctgtggtgatcaagaccgagggacctgcctggacccctctggaacctaaactgattacacggctggctgataccgtcagaaccaagggcctcagaagccccatcacaatggccgaagtggaagccctgatgagcagcccactgctgcctcacgacgtgaccaacctgatgcgggtgatcctgggccccgccccttacgccctgtggatggacgcctggggcgtgcagctgcaaacagttatcgccgccgccacaagagacccccggcacccagccaacggccagggcagaggcgagagaacaaacctggatcggctgaagggcctcgccgatggcatggccggcaatcctgagggccaggctgctctgctgagacccggggaactggttgctatcaccgccagcgccctgcaggccttcagagaagtggcccggctggccgagcctacagacccctgggccgagatcacccagggcccttctgagagcttcgtggacttcgccaacagactgatcaaggccgttgagggctccgacctgcctcctagcgcccgcgcccccgtgatcatcgactgttttagacagaaatcgcaacccgacatccagcagctgatccgggccgctccttctaccctgaccacacctggcgagatcatcaagtacgtgctggacagacagaagaccgcccccctgaccgacagaggaatcgccgccgccatgtctagcgccattcagcctctggtgatggccgtggtcaacagagaaagagatggacagacaggttctggcggcagagcccggggcctgtgctacacctgcggatcccctggacactaccaggcccagtgtcctaagaaaagaaagtctggtaacagcagagagcggtgccagctgtgtgatggcatgggccacaacgccaaacagtgccggagacgggacggaaaccaaggacaaagacccggccggggactgagcagcggaccttggcctgtcagccagcaacctgccgtgtccggtgccaccagctgctaccactgcggcaccggtgcccctaagaaaaagaggaaagtgggcggatctccgaagaaaaaacggaaggtcggtgggtcacccaagaagaagcggaaggtaggtggctcacctaaaaaaaaacgcaaggttggcgggagccccaaaaaaaagcgaaaggtaggcgggagtccaaagaagaagcggaaggtctctagacaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggaccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgagaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgatgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgactagtccaaaaaagaagagaaaggtagccctcgagtacccatatgatgtccctgactacgcttga

SEQ ID NO: 1821 - DNA, 1763 bp, synthetic construct; identical to SEQ ID NO: 1139
  misc_feature 1..1763: note = pXDP161 sequence
  source 1..1763: mol_type = other DNA

SEQ ID NO: 1822 - DNA, 1902 bp, synthetic construct; identical to SEQ ID NO: 1140
  misc_feature 1..1902: note = pXDP164 sequence
  source 1..1902: mol_type = other DNA

SEQ ID NO: 1823 - DNA, 1902 bp, synthetic construct; identical to SEQ ID NO: 1174
  misc_feature 1..1902: note = pXDP353 sequence
  source 1..1902: mol_type = other DNA

SEQ ID NO: 1824 - DNA, 3117 bp, synthetic construct; identical to SEQ ID NO: 1206
  misc_feature 1..3117: note = pXDP344 sequence
  source 1..3117: mol_type = other DNA

SEQ ID NO: 1825 - DNA, 116 bp, synthetic construct
  misc_feature 1..116: note = scaffold
  source 1..116: mol_type = other DNA
actggcgcttttatctgattactttgagagccatcaccagcgactatgtcgtagtgggtaaagctcacatgaggatcacccatgtgagcatcaaagctgcattctagttgtggttt

SEQ ID NO: 1826 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacctgaggatcacccaggtgagcatcaaagctgcattctagttgtggttttttttt

SEQ ID NO: 1827 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcgcatgaggatcacccatgcgagcatcaaagctgcattctagttgtggttttttttt

SEQ ID NO: 1828 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcgcctgaggatcacccaggcgagcatcaaagctgcattctagttgtggttttttttt

SEQ ID NO: 1829 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcgcctgagcatcagccaggcgagcatcaaagctgcattctagttgtggttttttttt

SEQ ID NO: 1830 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacatgagcatcagccatgtgagcatcaaagctgcattctagttgtggttttttttt

SEQ ID NO: 1831 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacatgagtatcaaccatgtgagcatcaaagctgcattctagttgtggttttttttt

SEQ ID NO: 1832 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacatgagaatcagccatgtgagcatcaaagctgcattctagttgtggttttttttt

SEQ ID NO: 1833 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcccttgaggatcacccatgtgagcatcaaagctgcattctagttgtggttttttttt

SEQ ID NO: 1834 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacttgaggatcacccatgtgagcatcaaagctgcattctagttgtggttttttttt

SEQ ID NO: 1835 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacctgaggatcacccatgtgagcatcaaagctgcattctagttgtggttttttttt

SEQ ID NO: 1836 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacatgaggatcacctatgtgagcatcaaagctgcattctagttgtggttttttttt

SEQ ID NO: 1837 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacattaggatcaccaatgtgagcatcaaagctgcattctagttgtggttttttttt

SEQ ID NO: 1838 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacattaggatcaccgatgtgagcatcaaagctgcattctagttgtggttttttttt

SEQ ID NO: 1839 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacattaggatcacctatgtgagcatcaaagctgcattctagttgtggttttttttt

SEQ ID NO: 1840 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacatgaggattacccatgtgagcatcaaagctgcattctagttgtggttttttttt

SEQ ID NO: 1841 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacatgaggataacccatgtgagcatcaaagctgcattctagttgtggttttttttt

SEQ ID NO: 1842 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacatgaggatgacccatgtgagcatcaaagctgcattctagttgtggttttttttt

SEQ ID NO: 1843 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacatgaggaccacccatgtgagcatcaaagctgcattctagttgtggttttttttt

SEQ ID NO: 1844 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcagatgaggatcacccatgggagcatcaaagctgcattctagttgtggttttttttt

SEQ ID NO: 1845 - DNA, 122 bp, synthetic construct
  misc_feature 1..122: note = scaffold
  source 1..122: mol_type = other DNA
actggcgcttttatctgattactttgagagccatcaccagcgactatgtcgtagtgggtaaagctcacatggggatcacccatgtgagcatcaaagctgcattctagttgtggttttttttt

SEQ ID NO: 1846 - RNA, 19 nt, synthetic construct
  misc_feature 1..19: note = MS2 hairpin
  source 1..19: mol_type = other RNA
acatgaggatcacccatgt

SEQ ID NO: 1847 - RNA, 19 nt, synthetic construct
  misc_feature 1..19: note = MS2 hairpin
  source 1..19: mol_type = other RNA
acctgaggatcacccaggt

SEQ ID NO: 1848 - RNA, 19 nt, synthetic construct
  misc_feature 1..19: note = MS2 hairpin
  source 1..19: mol_type = other RNA
gcatgaggatcacccatgc

SEQ ID NO: 1849 - RNA, 19 nt, synthetic construct
  misc_feature 1..19: note = MS2 hairpin
  source 1..19: mol_type = other RNA
gcctgaggatcacccaggc

SEQ ID NO: 1850 - RNA, 19 nt, synthetic construct
  misc_feature 1..19: note = MS2 hairpin
  source 1..19: mol_type = other RNA
gcctgagcatcagccaggc

SEQ ID NO: 1851 - RNA, 19 nt, synthetic construct
  misc_feature 1..19: note = MS2 hairpin
  source 1..19: mol_type = other RNA
acatgagcatcagccatgt

SEQ ID NO: 1852 - RNA, 19 nt, synthetic construct
  misc_feature 1..19: note = MS2 hairpin
  source 1..19: mol_type = other RNA
acttgaggatcacccatgt

SEQ ID NO: 1853 - RNA, 19 nt, synthetic construct
  misc_feature 1..19: note = MS2 hairpin
  source 1..19: mol_type = other RNA
acattaggatcaccaatgt

SEQ ID NO: 1854 - RNA, 19 nt, synthetic construct
  misc_feature 1..19: note = MS2 hairpin
  source 1..19: mol_type = other RNA
acatgaggaccacccatgt

SEQ ID NO: 1855 - RNA, 20 nt, synthetic construct
  misc_feature 1..20: note = spacer
  source 1..20: mol_type = other RNA
ctgcattctagttgtggttt

SEQ ID NO: 1856 - protein, 8 aa, synthetic construct
  REGION 1..8: note = nuclear localization signal
KRSFSKAF

SEQ ID NO: 1857 - protein, 25 aa, synthetic construct
  REGION 1..25: note = nuclear localization signal
MSRRRKANPTKLSENAKKLAKEVEN

SEQ ID NO: 1858 - protein, 15 aa, synthetic construct
  REGION 1..15: note = nuclear localization signal
KRKGSPERGERKRHW

SEQ ID NO: 1859 - DNA, 396 bp, unidentified; identical to SEQ ID NO: 917
  misc_feature 1..396: note = HIV-1 matrix
  source 1..396: mol_type = genomic DNA

SEQ ID NO: 1860 - DNA, 693 bp, unidentified; identical to SEQ ID NO: 918
  misc_feature 1..693: note = HIV-1 capsid
  source 1..693: mol_type = genomic DNA

SEQ ID NO: 1861 - DNA, 42 bp, unidentified; identical to SEQ ID NO: 919
  misc_feature 1..42: note = HIV-1 P2
  source 1..42: mol_type = genomic DNA

SEQ ID NO: 1862 - DNA, 164 bp, unidentified; identical to SEQ ID NO: 920
  misc_feature 1..164: note = HIV-1 nucleocapsid
  source 1..164: mol_type = genomic DNA

SEQ ID NO: 1863 - DNA, 48 bp, unidentified; identical to SEQ ID NO: 921
  misc_feature 1..48: note = HIV-1 P1
  source 1..48: mol_type = genomic DNA

SEQ ID NO: 1864 - DNA, 156 bp, unidentified; identical to SEQ ID NO: 922
  misc_feature 1..156: note = HIV-1 P6
  source 1..156: mol_type = genomic DNA

SEQ ID NO: 1865 - DNA, 263 bp, unidentified
  misc_feature 1..263: note = HIV-1 protease
  source 1..263: mol_type = genomic DNA
taaagataggggggcaattaaaggaagctctattagatacaggagcagatgatacagtattagaagaaatgaatttgccaggaagatggaaaccaaaaatgatagggggaattggaggttttatcaaagtaagacagtatgatcagatactcatagaaatctgcggacataaagctataggtacagtattagtaggacctacacctgtcaacataattggaagaaatctgttgactcagattggctgcactttaaatttttaa

SEQ ID NO: 1866 - protein, 54 aa, unidentified
  REGION 1..54: note = Deltaproteobacteria sp.
EKRINKIRKKLSADNATKPVSRSGPMKTLLVRVMTDDLKKRLEKRRKKPEVMPQ

SEQ ID NO: 1867 - protein, 44 aa, unidentified
  REGION 1..44: note = Deltaproteobacteria sp.
VISNNAANNLRMLLDDYTKMKEAILQVYWQEFKDDHVGLMCKFA

SEQ ID NO: 1868 - protein, 91 aa, unidentified
  REGION 1..91: note = Deltaproteobacteria sp.
QPASKKIDQNKLKPEMDEKGNLTTAGFACSQCGQPLFVYKLEQVSEKGKAYTNYFGRCNVAEHEKLILLAQLKPEKDSDEAVTYSLGKFGQ

SEQ ID NO: 1869 - protein, 141 aa, unidentified
  REGION 1..141: note = Deltaproteobacteria sp.
RALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSF

SEQ ID NO: 1870 - protein, 177 aa, unidentified
  REGION 1..177: note = Deltaproteobacteria sp.
PVVERRENEVDWWNTINEVKKLIDAKRDMGRVFWSGVTAEKRNTILEGYNYLPNENDHKKREGSLENPKKPAKRQFGDLLLYLEKKYAGDWGKVFDEAWERIDKKIAGLTSHIEREEARNAEDAQSKAVLTDWLRAKASFVLERLKEMDEKEFYACEIQLQKWYGDLRGNPFAVEAE

SEQ ID NO: 1871 - protein, 151 aa, unidentified
  REGION 1..151: note = Deltaproteobacteria sp.
NRVVDISGFSIGSDGHSIQYRNLLAWKYLENGKREFYLLMNYGKKGRIRFTDGTDIKKSGKWQGLLYGGGKAKVIDLTFDPDDEQLIILPLAFGTRQGREFIWNDLLSLETGLIKLANGRVIEKTIYNKKIGRDEPALFVALTFERREVVD

SEQ ID NO: 1872 - protein, 164 aa, unidentified
  REGION 1..164: note = Deltaproteobacteria sp.
PSNIKPVNLIGVDRGENIPAVIALTDPEGCPLPEFKDSSGGPTDILRIGEGYKEKQRAIQAAKEVEQRRAGGYSRKFASKSRNLADDMVRNSARDLFYHAVTHDAVLVFENLSRGFGRQGKRTFMTERQYTKMEDWLTAKLAYEGLTSKTYLSKTLAQYTSKTC

SEQ ID NO: 1873 - protein, 110 aa, unidentified
  REGION 1..110: note = Deltaproteobacteria sp.
SNCGFTITTADYDGMLVRLKKTSDGWATTLNNKELKAEGQITYYNRYKRQTVEKELSAELDRLSEESGNNDISKWTKGRRDEALFLLKKRFSHRPVQEQFVCLDCGHEVH

SEQ ID NO: 1874 - protein, 53 aa, unidentified
  REGION 1..53: note = Deltaproteobacteria sp.
ADEQAALNIARSWLFLNSNSTEFKSYKSGKQPFVGAWQAFYKRRLKEVWKPNA

SEQ ID NO: 1875 - protein, 56 aa, unidentified
  REGION 1..56: note = Planctomycetes sp.
QEIKRINKIRRRLVKDSNTKKAGKTGPMKTLLVRVMTPDLRERLENLRKKPENIPQ

SEQ ID NO: 1876 - protein, 44 aa, unidentified
  REGION 1..44: note = Planctomycetes sp.
PISNTSRANLNKLLTDYTEMKKAILHVYWEEFQKDPVGLMSRVA

SEQ ID NO: 1877 - protein, 90 aa, unidentified
  REGION 1..90: note = Planctomycetes sp.
QPAPKNIDQRKLIPVKDGNERLTSSGFACSQCCQPLYVYKLEQVNDKGKPHTNYFGRCNVSEHERLILLSPHKPEANDELVTYSLGKFGQ

SEQ ID NO: 1878 - protein, 141 aa, unidentified
  REGION 1..141: note = Planctomycetes sp.
RALDFYSIHVTRESNHPVKPLEQIGGNSCASGPVGKALSDACMGAVASFLTKYQDIILEHQKVIKKNEKRLANLKDIASANGLAFPKITLPPQPHTKEGIEAYNNVVAQIVIWVNLNLWQKLKIGRDEAKPLQRLKGFPSF

SEQ ID NO: 1879 - protein, 168 aa, unidentified
  REGION 1..168: note = Planctomycetes sp.
PLVERQANEVDWWDMVCNVKKLINEKKEDGKVFWQNLAGYKRQEALLPYLSSEEDRKKGKKFARYQFGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAE

SEQ ID NO: 1880 - protein, 146 aa, unidentified
  REGION 1..146: note = Planctomycetes sp.
NSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLD

SEQ ID NO: 1881 - protein, 164 aa, unidentified
  REGION 1..164: note = Planctomycetes sp.
SSNIKPMNLIGIDRGENIPAVIALTDPEGCPLSRFKDSLGNPTHILRIGESYKEKQRTIQAAKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTC

SEQ ID NO: 1882 - protein, 110 aa, unidentified
  REGION 1..110: note = Planctomycetes sp.
SNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETH

SEQ ID NO: 1883 - protein, 58 aa, unidentified
  REGION 1..58: note = Planctomycetes sp.
ADEQAALNIARSWLFLRSQEYKKYQTNKTTGNTDKRAFVETWQSFYRKKLKEVWKPAV

SEQ ID NO: 1884 - protein, 979 aa, synthetic construct
  REGION 1..979: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPALSKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1885 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPDVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1886 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFHLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1887 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVEQWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1888 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLPERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1889 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIDLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1890 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIELAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1891 - protein, 978 aa, synthetic construct
  REGION 1..978: note = CasX variant
QEIKRINKIRRRLVKDSNTKKAGKTPPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1892 - protein, 978 aa, synthetic construct
  REGION 1..978: note = CasX variant
QEIKRINKIRRRLVKDSNTKKAGKTGPPKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1893 - protein, 977 aa, synthetic construct; identical to SEQ ID NO: 266
  REGION 1..977: note = CasX variant

SEQ ID NO: 1894 - protein, 977 aa, synthetic construct
  REGION 1..977: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1895 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYHDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1896 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIAHFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1897 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIATFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1898 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTDEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1899 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTEEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1900 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKRFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1901 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKKFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1902 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNKNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1903 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRRWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1904 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRKWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1905 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFRRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1906 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFKRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1907 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGERYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1908 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGEKYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1909 - protein, 977 aa, synthetic construct
  REGION 1..977: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1910 - protein, 977 aa, synthetic construct
  REGION 1..977: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSIDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1911 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSRLDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1912 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSKLDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1913 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLQLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1914 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGQVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1915 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKATTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1916 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGQFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1917 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFQQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1918 - protein, 978 aa, synthetic construct; identical to SEQ ID NO: 260
  REGION 1..978: note = CasX variant

SEQ ID NO: 1919 - protein, 978 aa, synthetic construct
  REGION 1..978: note = CasX variant
QEIKPINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1920 - protein, 978 aa, synthetic construct
  REGION 1..978: note = CasX variant
QEIWRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1921 - protein, 978 aa, synthetic construct; identical to SEQ ID NO: 254
  REGION 1..978: note = CasX variant

SEQ ID NO: 1922 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERAEVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1923 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMLTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1924 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMHTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1925 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPTQEKFVCLNCGFETHADEQAALNIARSWLFLRSQEYKKYQTNKTTGNTDKRAFVETWQSFYRKKLKEVWKPAV

SEQ ID NO: 1926 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLEFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1927 - protein, 977 aa, synthetic construct
  REGION 1..977: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1928 - protein, 979 aa, synthetic construct
  REGION 1..979: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQAGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1929 - protein, 978 aa, synthetic construct
  REGION 1..978: note = CasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEKERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 1930 - protein, 56 aa, synthetic construct; identical to SEQ ID NO: 1875
  REGION 1..56: note = CasX 515 domain

SEQ ID NO: 1931 - protein, 44 aa, synthetic construct; identical to SEQ ID NO: 1876
  REGION 1..44: note = CasX 515 domain

SEQ ID NO: 1932 - protein, 91 aa, synthetic construct; identical to SEQ ID NO: 1868
  REGION 1..91: note = CasX 515 domain

SEQ ID NO: 1933 - protein, 141 aa, synthetic construct; identical to SEQ ID NO: 1869
  REGION 1..141: note = CasX 515 domain

SEQ ID NO: 1934 - protein, 168 aa, synthetic construct
  REGION 1..168: note = CasX 515 domain
PLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAE

SEQ ID NO: 1935 - protein, 146 aa, synthetic construct; identical to SEQ ID NO: 1880
  REGION 1..146: note = CasX 515 domain

SEQ ID NO: 1936 - protein, 164 aa, synthetic construct
  REGION 1..164: note = CasX 515 domain
SSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTC

SEQ ID NO: 1937 - protein, 110 aa, synthetic construct; identical to SEQ ID NO: 1882
  REGION 1..110: note = CasX 515 domain

SEQ ID NO: 1938 - protein, 58 aa, synthetic construct; identical to SEQ ID NO: 1883
  REGION 1..58: note = CasX 515 domain

SEQ ID NO: 1939 - protein, 979 aa, synthetic construct
  REGION 1..979: note = dCasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1940 - protein, 977 aa, synthetic construct
  REGION 1..977: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1941 - protein, 979 aa, synthetic construct
  REGION 1..979: note = dCasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1942 - protein, 978 aa, synthetic construct
  REGION 1..978: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASNPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1943 - protein, 979 aa, synthetic construct
  REGION 1..979: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGYGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1944 - protein, 979 aa, synthetic construct
  REGION 1..979: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGWGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1945 - protein, 978 aa, synthetic construct
  REGION 1..978: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASYPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1946 - protein, 978 aa, synthetic construct
  REGION 1..978: note = dCasX variant
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1947 - protein, 978 aa, synthetic construct
  REGION 1..978: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1948 - protein, 978 aa, synthetic construct
  REGION 1..978: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTIHTSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1949 - protein, 977 aa, synthetic construct
  REGION 1..977: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNHNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1950 - protein, 978 aa, synthetic construct
  REGION 1..978: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1951 - protein, 979 aa, synthetic construct
  REGION 1..979: note = dCasX variant
RQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGAPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1952 - protein, 978 aa, synthetic construct
  REGION 1..978: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHIQLRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1953 - protein, 977 aa, synthetic construct
  REGION 1..977: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTTQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1954 - protein, 977 aa, synthetic construct
  REGION 1..977: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKRSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1955 - protein, 977 aa, synthetic construct
  REGION 1..977: note = dCasX variant
QEIKRINKIRRRLVKDSNTKKAGKTYPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1956 - protein, 977 aa, synthetic construct
  REGION 1..977: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTIHSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1957 - protein, 977 aa, synthetic construct
  REGION 1..977: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAATQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1958 - protein, 977 aa, synthetic construct
  REGION 1..977: note = dCasX variant
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAAKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 1959 - RNA, 89 nt, synthetic construct
  misc_feature 1..89: note = CasX variant scaffold
  source 1..89: mol_type = other RNA
actgggccttctatctgattactctgaggcccatcaccagcgactatgtcgtagtgggtaaagctccctcttcggagggagcatcagag

SEQ ID NO: 1960 - RNA, 96 nt, synthetic construct
  misc_feature 1..96: note = CasX variant scaffold
  source 1..96: mol_type = other RNA
actgggccttctatctgattactctgaggcccatcaccagcgactatgtcgtagtgggtaaagcccttagggaccttggtccctaagggcatcaga

SEQ ID NO: 1961 - RNA, 99 nt, synthetic construct
  misc_feature 1..99: note = CasX variant scaffold
  source 1..99: mol_type = other RNA
actgggccttctatctgattactctgaggcccatcaccagcgactatgtcgtagtgggtaaagcctcttagggaccttggtccctaagaggcatcagag

SEQ ID NO: 1962 - RNA, 89 nt, synthetic construct
  misc_feature 1..89: note = CasX variant scaffold
  source 1..89: mol_type = other RNA
actgggccttctatctgattactctgaggcccatcaccagcgactatgtcgtagtgggtaaagctccctccttggagggagcatcagag

SEQ ID NO: 1963 - RNA, 97 nt, synthetic construct
  misc_feature 1..97: note = CasX variant scaffold
  source 1..97: mol_type = other RNA
actgggccttctatctgattactctgaggcccatcaccagcgactatgtcgtagtgggtaaagcccttagggaggaaactccctaagggcatcagag

SEQ ID NO: 1964 - RNA, 99 nt, synthetic construct
  misc_feature 1..99: note = CasX variant scaffold
  source 1..99: mol_type = other RNA
actgggccttctatctgattactctgaggcccatcaccagcgactatgtcgtagtgggtaaagcctcttagggaggaaactccctaagaggcatcagag

SEQ ID NO: 1965 - RNA, 89 nt, synthetic construct
  misc_feature 1..89: note = CasX variant scaffold
  source 1..89: mol_type = other RNA
actgggccttctatctgattactctgaggcccatcaccagcgactatgtcgtagtgggtaaagctccctggaaacagggagcatcagag

SEQ ID NO: 1966 - RNA, 98 nt, synthetic construct
  misc_feature 1..98: note = CasX variant scaffold
  source 1..98: mol_type = other RNA
actgggccttctatctgattactctgaggcccatcaccagcgactatgtcgtagtgggtaaagcccttagggacttcaggtccctaagggcatcagag

SEQ ID NO: 1967 - RNA, 100 nt, synthetic construct
  misc_feature 1..100: note = CasX variant scaffold
  source 1..100: mol_type = other RNA
actgggccttctatctgattactctgaggcccatcaccagcgactatgtcgtagtgggtaaagcctcttagggacttcaggtccctaagaggcatcagag

SEQ ID NO: 1968 - RNA, 90 nt, synthetic construct
  misc_feature 1..90: note = CasX variant scaffold
  source 1..90: mol_type = other RNA
actgggccttctatctgattactctgaggcccatcaccagcgactatgtcgtagtgggtaaagctccctcttcaggagggagcatcagag

SEQ ID NO: 1969 - RNA, 97 nt, synthetic construct
  misc_feature 1..97: note = CasX variant scaffold
  source 1..97: mol_type = other RNA
actgggccttctatctgattactctgaggcccatcaccaggcactatgtgctagtgggtaaagcccttagggaccttggtccctaagggcatcagag

SEQ ID NO: 1970 - RNA, 99 nt, synthetic construct
  misc_feature 1..99: note = CasX variant scaffold
  source 1..99: mol_type = other RNA
actgggccttctatctgattactctgaggcccatcaccaggcactatgtgctagtgggtaaagcctcttagggaccttggtccctaagaggcatcagag

SEQ ID NO: 1971 - RNA, 89 nt, synthetic construct
  misc_feature 1..89: note = CasX variant scaffold
  source 1..89: mol_type = other RNA
actgggccttctatctgattactctgaggcccatcaccaggcactatgtgctagtgggtaaagctccctccttggagggagcatcagag

SEQ ID NO: 1972 - RNA, 97 nt, synthetic construct
  misc_feature 1..97: note = CasX variant scaffold
  source 1..97: mol_type = other RNA
actgggccttctatctgattactctgaggcccatcaccaggcactatgtgctagtgggtaaagcccttagggaggaaactccctaagggcatcagag

SEQ ID NO: 1973 - RNA, 99 nt, synthetic construct
  misc_feature 1..99: note = CasX variant scaffold
  source 1..99: mol_type = other RNA
actgggccttctatctgattactctgaggcccatcaccaggcactatgtgctagtgggtaaagcctcttagggaggaaactccctaagaggcatcagag

SEQ ID NO: 1974 - RNA, 89 nt, synthetic construct
  misc_feature 1..89: note = CasX variant scaffold
  source 1..89: mol_type = other RNA
actgggccttctatctgattactctgaggcccatcaccaggcactatgtgctagtgggtaaagctccctggaaacagggagcatcagag

SEQ ID NO: 1975 - RNA, 98 nt, synthetic construct
  misc_feature 1..98: note = CasX variant scaffold
  source 1..98: mol_type = other RNA
actgggccttctatctgattactctgaggcccatcaccaggcactatgtgctagtgggtaaagcccttagggacttcaggtccctaagggcatcagag

SEQ ID NO: 1976 - RNA, 100 nt, synthetic construct
  misc_feature 1..100: note = CasX variant scaffold
  source 1..100: mol_type = other RNA
actgggccttctatctgattactctgaggcccatcaccaggcactatgtgctagtgggtaaagcctcttagggacttcaggtccctaagaggcatcagag

SEQ ID NO: 1977 - RNA, 90 nt, synthetic construct
  misc_feature 1..90: note = CasX variant scaffold
  source 1..90: mol_type = other RNA
actgggccttctatctgattactctgaggcccatcaccaggcactatgtgctagtgggtaaagctccctcttcaggagggagcatcagag

SEQ ID NO: 1978 - RNA, 96 nt, synthetic construct
  misc_feature 1..96: note = CasX variant scaffold
  source 1..96: mol_type = other RNA
actggcgcttctatctgattactctgagcgccatcaccagcgactatgtcgtagtgggtaaagctcacatgaggatcacccatgtgagcatcagag

SEQ ID NO: 1979 - RNA, 145 nt, synthetic construct
  misc_feature 1..145: note = CasX variant scaffold
  source 1..145: mol_type = other RNA
actggcgcttctatctgattactctgagcgccatcaccagcgactatgtcgtagtgggtaaagctgcactatgggcgcagcgtcaatgacgctgacggtacaggccacatgaggatcacccatgtggtatagtgcagcatcagag

SEQ ID NO: 1980 - RNA, 155 nt, synthetic construct
  misc_feature 1..155: note = CasX variant scaffold
  source 1..155: mol_type = other RNA
actggcgcttctatctgattactctgagcgccatcaccagcgactatgtcgtagtgggtaaagctgcactatgggcgcagctcatgaggatcacccatgagctgacggtacaggccacatgaggatcacccatgtggtatagtgcagcatcagag

SEQ ID NO: 1981 - RNA, 159 nt, synthetic construct
  misc_feature 1..159: note = CasX variant scaffold
  source 1..159: mol_type = other RNA
actggcgcttctatctgattactctgagcgccatcaccagcgactatgtcgtagtgggtaaagctgcactatgggcgcagacatggcagtcgtaacgacgcgggtctgacggtacaggccacatgaggatcacccatgtggtatagtgcagcatcagag

SEQ ID NO: 1982 - RNA, 145 nt, synthetic construct
  misc_feature 1..145: note = CasX variant scaffold
  source 1..145: mol_type = other RNA
actggcgcttttatctgattactttgagagccatcaccagcgactatgtcgtagtgggtaaagctgcactatggggccacatgaggatcacccatgtggtgtacagcgcagcgtcaatgacgctgacgatagtgcagcatcaaag

SEQ ID NO: 1983 - RNA, 436 nt, synthetic construct
  misc_feature 1..436: note = CasX variant scaffold
  source 1..436: mol_type = other RNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaagctgcattctagttgtggtttcacaattattcttgagtgtagtctcgtcattcaccaaatctttgtttggtgcgcgcggccggcatggtcccagcctcctcgctggcgccggctgggcaacattccgaggggaccgtcccctcggtaatggcgaatgggacgtcgactgctaacaaagcccgaaaggaagctgagttggctgctgccaccgctgagcaataactagcataaccccttggggcctctaaacgggtcttgaggggttttttgctgatttttttt

SEQ ID NO: 1984 - RNA, 272 nt, synthetic construct
  misc_feature 1..272: note = CasX variant scaffold
  source 1..272: mol_type = other RNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaagctgcattctagttgtggtttatggccggcatggtcccagcctcctcgctggcgccggctgggcaacattccgaggggaccgccccctcggtaatggcgaatgggacccatttttttt

SEQ ID NO: 1985 - RNA, 271 nt, synthetic construct
  misc_feature 1..271: note = CasX variant scaffold
  source 1..271: mol_type = other RNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaagctgcattctagttgtggtttgtggccggcatggtccagcctactcgctggcgcgggctgggcaacattccgaggggacccgtccctcggtaatggcgaatgggacccatttttttt

SEQ ID NO: 1986 - RNA, 274 nt, synthetic construct
  misc_feature 1..274: note = CasX variant scaffold
  source 1..274: mol_type = other RNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaagctgcattctagttgtggtttgtggccggcatggccccagcctcctcgctggcgccggctgggcaacgatccgaggggactgtccctctcgagaatcggcaaatggggcccctttttttt

SEQ ID NO: 1987 - RNA, 283 nt, synthetic construct
  misc_feature 1..283: note = CasX variant scaffold
  source 1..283: mol_type = other RNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaagctgcattctagttgtggttttcgggtcggcatggcatctccacctccacctcctcgcggtccgacctgggcatccgaaggaggagcggacgtccactcggatggctaagggagagcccagtttttttt

SEQ ID NO: 1988 - RNA, 276 nt, synthetic construct
  misc_feature 1..276: note = CasX variant scaffold
  source 1..276: mol_type = other RNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaagctgcattctagttgtggttttcgggtcggcatggcatctccacctccccgtggtccgacctgggcatccgaaggaggacggacgtccactcggatggctaagggagtgccggctttttttt

SEQ ID NO: 1989 - RNA, 251 nt, synthetic construct
  misc_feature 1..251: note = CasX variant scaffold
  source 1..251: mol_type = other RNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaagctgcattctagttgtggtttggccggcatggtcccagcctcctcgctggcgccggctgggcaacatgcttcggcatggcgaatgggactttttttt

SEQ ID NO: 1990 - RNA, 377 nt, synthetic construct
  misc_feature 1..377: note = CasX variant scaffold
  source 1..377: mol_type = other RNA
actggcgcttttatctgattactttgagagccatcaccagcgactatgtcgtagtgggtaaagctcacatgaggatcacccatgtgagcatcaaagctgcattctagttgtggtttcacaattattcttgagtgtagtctcgtcattcaccaaatctttgtttggtgcgcgcggccggcatggtcccagcctcctcgctggcgccggctgggcaacattccgaggggaccgtcccctcggtaatggcgaatgggacgtcgactgctaacaaagcccgaaaggaagctgagttggctgctgccaccgctgagcaataactagcataaccccttggggcctctaaacgggtcttgaggggttttttgctgatttttttt

SEQ ID NO: 1991 - RNA, 213 nt, synthetic construct
  misc_feature 1..213: note = CasX variant scaffold
  source 1..213: mol_type = other RNA
actggcgcttttatctgattactttgagagccatcaccagcgactatgtcgtagtgggtaaagctcacatgaggatcacccatgtgagcatcaaagctgcattctagttgtggtttatggccggcatggtcccagcctcctcgctggcgccggctgggcaacattccgaggggaccgccccctcggtaatggcgaatgggacccatttttttt

SEQ ID NO: 1992 - RNA, 212 nt, synthetic construct
  misc_feature 1..212: note = CasX variant scaffold
  source 1..212: mol_type = other RNA
actggcgcttttatctgattactttgagagccatcaccagcgactatgtcgtagtgggtaaagctcacatgaggatcacccatgtgagcatcaaagctgcattctagttgtggtttgtggccggcatggtccagcctactcgctggcgcgggctgggcaacattccgaggggacccgtccctcggtaatggcgaatgggacccatttttttt

SEQ ID NO: 1993 - RNA, 215 nt, synthetic construct
  misc_feature 1..215: note = CasX variant scaffold
  source 1..215: mol_type = other RNA
actggcgcttttatctgattactttgagagccatcaccagcgactatgtcgtagtgggtaaagctcacatgaggatcacccatgtgagcatcaaagctgcattctagttgtggtttgtggccggcatggccccagcctcctcgctggcgccggctgggcaacgatccgaggggactgtccctctcgagaatcggcaaatggggcccctttttttt

SEQ ID NO: 1994 - RNA, 224 nt, synthetic construct
  misc_feature 1..224: note = CasX variant scaffold
  source 1..224: mol_type = other RNA
actggcgcttttatctgattactttgagagccatcaccagcgactatgtcgtagtgggtaaagctcacatgaggatcacccatgtgagcatcaaagctgcattctagttgtggttttcgggtcggcatggcatctccacctccacctcctcgcggtccgacctgggcatccgaaggaggagcggacgtccactcggatggctaagggagagcccagtttttttt

SEQ ID NO: 1995 - RNA, 217 nt, synthetic construct
  misc_feature 1..217: note = CasX variant scaffold
  source 1..217: mol_type = other RNA
actggcgcttttatctgattactttgagagccatcaccagcgactatgtcgtagtgggtaaagctcacatgaggatcacccatgtgagcatcaaagctgcattctagttgtggttttcgggtcggcatggcatctccacctccccgtggtccgacctgggcatccgaaggaggacggacgtccactcggatggctaagggagtgccggctttttttt

SEQ ID NO: 1996 - RNA, 192 nt, synthetic construct
  misc_feature 1..192: note = CasX variant scaffold
  source 1..192: mol_type = other RNA
actggcgcttttatctgattactttgagagccatcaccagcgactatgtcgtagtgggtaaagctcacatgaggatcacccatgtgagcatcaaagctgcattctagttgtggtttggccggcatggtcccagcctcctcgctggcgccggctgggcaacatgcttcggcatggcgaatgggactttttttt

SEQ ID NO: 1997 - RNA, 163 nt, synthetic construct
  misc_feature 1..163: note = CasX variant scaffold
  source 1..163: mol_type = other RNA
actggcgcttttatctgattactttgagagccatcaccagcgactatgtcgtagtgggtaaagctgcactatgggcgcagcaaggagtttatatggaaacccttgctgacggtacaggccaaggagtttatatggaaacccttggtatagtgcagcatcaaag

SEQ ID NO: 1998 - RNA, 147 nt, synthetic construct
  misc_feature 1..147: note = CasX variant scaffold
  source 1..147: mol_type = other RNA
actggcgcttttatctgattactttgagagccatcaccagcgactatgtcgtagtgggtaaagctgcactatgggcgcagcgccctgaagaagggcgctgacggtacaggccgccctgaagaagggcggtatagtgcagcatcaaag

SEQ ID NO: 1999 - RNA, 173 nt, synthetic construct
  misc_feature 1..173: note = CasX variant scaffold
  source 1..173: mol_type = other RNA
actggcgcttttatctgattactttgagagccatcaccagcgactatgtcgtagtgggtaaagctgcactatgggcgcagcggctcgtgtagctcattagctccgagccgctgacggtacaggccggctcgtgtagctcattagctccgagccggtatagtgcagcatcaaag

SEQ ID NO: 2000 - RNA, 177 nt, synthetic construct
  misc_feature 1..177: note = CasX variant scaffold
  source 1..177: mol_type = other RNA
actggcgcttttatctgattactttgagagccatcaccagcgactatgtcgtagtgggtaaagctgcactatgggcgcagcccgtgtgcatccgcagtgtcggatccacgggctgacggtacaggccccgtgtgcatccgcagtgtcggatccacggggtatagtgcagcatcaaag

SEQ ID NO: 2001 - RNA, 161 nt, synthetic construct
  misc_feature 1..161: note = CasX variant scaffold
  source 1..161: mol_type = other RNA
actggcgcttttatctgattactttgagagccatcaccagcgactatgtcgtagtgggtaaagctgcactatgggcgcagcatccattgcactccggatagctgctgacggtacaggccatccattgcactccggatagctggtatagtgcagcatcaaag

SEQ ID NO: 2002 - RNA, 157 nt, synthetic construct
  misc_feature 1..157: note = CasX variant scaffold
  source 1..157: mol_type = other RNA
actggcgcttttatctgattactttgagagccatcaccagcgactatgtcgtagtgggtaaagctgcactatgggcgcagcatgcatgtctaagacagcatgctgacggtacaggccatgcatgtctaagacagcatggtatagtgcagcatcaaag

SEQ ID NO: 2003 - RNA, 162 nt, synthetic construct
  misc_feature 1..162: note = CasX variant scaffold
  source 1..162: mol_type = other RNA
actggcgcttttatctgattactttgagagccatcaccagcgactatgtcgtagtgggtaaagctgcactatgggcgcagcaaaacataaggaaaacctatgttctgacggtacaggccaaaacataaggaaaacctatgttggtatagtgcagcatcaaag

SEQ ID NO: 2004 - RNA, 175 nt, synthetic construct
  misc_feature 1..175: note = CasX variant scaffold
  source 1..175: mol_type = other RNA
actggcgcttctatctgattactctgagcgccatcaccagcgactatgtcgtagtgggtaaagccgcttacggactatgggcgcagcaaggagtttatatggaaacccttgctgacggtacaggccaaggagtttatatggaaacccttggtatagtccgtaagaggcatcagag

SEQ ID NO: 2005 - RNA, 159 nt, synthetic construct
  misc_feature 1..159: note = CasX variant scaffold
  source 1..159: mol_type = other RNA
actggcgcttctatctgattactctgagcgccatcaccagcgactatgtcgtagtgggtaaagccgcttacggactatgggcgcagcgccctgaagaagggcgctgacggtacaggccgccctgaagaagggcggtatagtccgtaagaggcatcagag

SEQ ID NO: 2006 - RNA, 185 nt, synthetic construct
  misc_feature 1..185: note = CasX variant scaffold
  source 1..185: mol_type = other RNA
actggcgcttctatctgattactctgagcgccatcaccagcgactatgtcgtagtgggtaaagccgcttacggactatgggcgcagcggctcgtgtagctcattagctccgagccgctgacggtacaggccggctcgtgtagctcattagctccgagccggtatagtccgtaagaggcatcagag

SEQ ID NO: 2007 - RNA, 189 nt, synthetic construct
  misc_feature 1..189: note = CasX variant scaffold
  source 1..189: mol_type = other RNA
actggcgcttctatctgattactctgagcgccatcaccagcgactatgtcgtagtgggtaaagccgcttacggactatgggcgcagcccgtgtgcatccgcagtgtcggatccacgggctgacggtacaggccccgtgtgcatccgcagtgtcggatccacggggtatagtccgtaagaggcatcagag

SEQ ID NO: 2008 - RNA, 173 nt, synthetic construct
  misc_feature 1..173: note = CasX variant scaffold
  source 1..173: mol_type = other RNA
actggcgcttctatctgattactctgagcgccatcaccagcgactatgtcgtagtgggtaaagccgcttacggactatgggcgcagcatccattgcactccggatagctgctgacggtacaggccatccattgcactccggatagctggtatagtccgtaagaggcatcagag

SEQ ID NO: 2009 - RNA, 169 nt, synthetic construct
  misc_feature 1..169: note = CasX variant scaffold
  source 1..169: mol_type = other RNA
actggcgcttctatctgattactctgagcgccatcaccagcgactatgtcgtagtgggtaaagccgcttacggactatgggcgcagcatgcatgtctaagacagcatgctgacggtacaggccatgcatgtctaagacagcatggtatagtccgtaagaggcatcagag

SEQ ID NO: 2010 - RNA, 175 nt, synthetic construct
  misc_feature 1..175: note = CasX variant scaffold
  source 1..175: mol_type = other RNA
actggcgcttctatctgattactctgagcgccatcaccagcgactatgtcgtagtgggtaaagccgcttacggactatgggcgcagcaaaacataaggaaaacctatgttgctgacggtacaggccaaaacataaggaaaacctatgttggtatagtccgtaagaggcatcagag

SEQ ID NO: 2011 - RNA, 19 nt, synthetic construct
  misc_feature 1..19: note = MS2 hairpin
  source 1..19: mol_type = other RNA
acatgaggatcacccatgt

SEQ ID NO: 2012 - RNA, 20 nt, synthetic construct
  misc_feature 1..20: note = Q beta hairpin
  source 1..20: mol_type = other RNA
atgcatgtctaagacagcat

SEQ ID NO: 2013 - RNA, 29 nt, synthetic construct
  misc_feature 1..29: note = U1 hairpin II hairpin
  source 1..29: mol_type = other RNA
ggaatccattgcactccggatttcactag

SEQ ID NO: 2014 - RNA, 12 nt, synthetic construct
  misc_feature 1..12: note = Uvsx hairpin
  source 1..12: mol_type = other RNA
cctcttcggagg

SEQ ID NO: 2015 - RNA, 23 nt, synthetic construct
  misc_feature 1..23: note = PP7 hairpin
  source 1..23: mol_type = other RNA
aaggagtttatatggaaaccctt

SEQ ID NO: 2016 - RNA, 30 nt, synthetic construct
  misc_feature 1..30: note = phage replication loop
  source 1..30: mol_type = other RNA
aggtgggacgacctctcggtcgtcctatct

SEQ ID NO: 2017 - RNA, 19 nt, synthetic construct
  misc_feature 1..19: note = kissing loop a
  source 1..19: mol_type = other RNA
tgctcgctccgttcgagca

SEQ ID NO: 2018 - RNA, 21 nt, synthetic construct
  misc_feature 1..21: note = kissing loop b1
  source 1..21: mol_type = other RNA
tgctcgacgcgtcctcgagca

SEQ ID NO: 2019 - RNA, 22 nt, synthetic construct
  misc_feature 1..22: note = kissing loop b2
  source 1..22: mol_type = other RNA
tgctcgtttgcggctacgagca

SEQ ID NO: 2020 - RNA, 17 nt, synthetic construct
  misc_feature 1..17: note = G quadriplex M3q
  source 1..17: mol_type = other RNA
agggagggagggagagg

SEQ ID NO: 2021 - RNA, 19 nt, synthetic construct
  misc_feature 1..19: note = G quadriplex telomere basket
  source 1..19: mol_type = other RNA
ggttagggttagggttagg

SEQ ID NO: 2022 - RNA, 25 nt, synthetic construct
  misc_feature 1..25: note = sarcin ricin loop
  source 1..25: mol_type = other RNA
ctgctcagtacgagaggaaccgcag

SEQ ID NO: 2023 - RNA, 78 nt, synthetic construct
  misc_feature 1..78: note = pseudoknots
  source 1..78: mol_type = other RNA
tacactgggatcgctgaattagagatcggcgtcctttcattctatatactttggagttttaaaatgtctctaagtaca

SEQ ID NO: 2024 - RNA, 28 nt, synthetic construct
  misc_feature 1..28: note = transactivation response element
  source 1..28: mol_type = other RNA
ggctcgtgtagctcattagctccgagcc

SEQ ID NO: 2025 - RNA, 30 nt, synthetic construct
  misc_feature 1..30: note = iron response element
  source 1..30: mol_type = other RNA
ccgtgtgcatccgcagtgtcggatccacgg

SEQ ID NO: 2026 - RNA, 23 nt, synthetic construct
  misc_feature 1..23: note = phage GA hairpin
  source 1..23: mol_type = other RNA
aaaacataaggaaaacctatgtt

SEQ ID NO: 2027 - RNA, 15 nt, synthetic construct
  misc_feature 1..15: note = phage Delta N hairpin
  source 1..15: mol_type = other RNA
gccctgaagaagggc

SEQ ID NO: 2028-2100 - skipped (73 entries)

SEQ ID NO: 2101 - RNA, 108 nt, synthetic construct
  misc_feature 1..108: note = gNA Variant Scaffold
  source 1..108: mol_type = other RNA
tactggcgcttttatctcattactttgagagccatcaccagcgactatgtcgtatgggtaaagcgcaggtgggacgacctctcggtcgtcctatctgaagcatcaaag

SEQ ID NO: 2102 - RNA, 99 nt, synthetic construct
  misc_feature 1..99: note = gNA Variant Scaffold
  source 1..99: mol_type = other RNA
tactggcgcttttatctcattactttgagagccatcaccagcgactatgtcgtatgggtaaagcgctgctcgacgcgtcctcgagcagaagcatcaaag

SEQ ID NO: 2103 - RNA, 97 nt, synthetic construct
  misc_feature 1..97: note = gNA Variant Scaffold
  source 1..97: mol_type = other RNA
tactggcgcttttatctcattactttgagagccatcaccagcgactatgtcgtatgggtaaagcgctgctcgctccgttcgagcagaagcatcaaag

SEQ ID NO: 2104 - RNA, 91 nt, synthetic construct
  misc_feature 1..91: note = gNA Variant Scaffold
  source 1..91: mol_type = other RNA
gtactggcgcttttatctcattactttgagagccatcaccagcgactatgtcgtatgggtaaagcgccctcttcggagggaagcatcaaag

SEQ ID NO: 2105 - RNA, 99 nt, synthetic construct
  misc_feature 1..99: note = gNA Variant Scaffold
  source 1..99: mol_type = other RNA
tactggcgcttttatctcattactttgagagccatcaccagcgactatgtcgtatgggtaaagcgcaggagtttctatggaaaccctgaagcatcaaag

SEQ ID NO: 2106 - RNA, 99 nt, synthetic construct
  misc_feature 1..99: note = gNA Variant Scaffold
  source 1..99: mol_type = other RNA
gtactggcgcctttatctcattactttgagagccatcaccagcgactatgtcgtatgggtaaagcgcttacggacttcggtccgtaagaagcatcaaag

SEQ ID NO: 2107 - RNA, 90 nt, synthetic construct
  misc_feature 1..90: note = gNA Variant Scaffold
  source 1..90: mol_type = other RNA
tactggcgcttttatctcattactttgagagccatcaccagcgactatgtcgtatgggtaaagcgctgcgcttgcgcagaagcatcaaag

SEQ ID NO: 2108 - RNA, 108 nt, synthetic construct
  misc_feature 1..108: note = gNA Variant Scaffold
  source 1..108: mol_type = other RNA
tactggcgcttttatctgattactttgagagccatcaccagcgactatgtcgtatgggtaaagcgcttatttatcggagagaaatccgataaataagaagcatcaaag

SEQ ID NO: 2109 - RNA, 108 nt, synthetic construct
  misc_feature 1..108: note = gNA Variant Scaffold
  source 1..108: mol_type = other RNA
tactggcgcttttatcgcattactttgagagccatcaccagcgactatgtcgtatgggtaaagcgcttatttatcggagagaaatccgataaataagaagcatcaaag

SEQ ID NO: 2110 - RNA, 110 nt, synthetic construct
  misc_feature 1..110: note = gNA Variant Scaffold
  source 1..110: mol_type = other RNA
tactggcgcttttatctcattactttgagagccatcaccagcgactatgtcgtatgggtaaagcgcttatttatcggagacttcggtccgataaataagaagcatcaaag

SEQ ID NO: 2111 - RNA, 97 nt, synthetic construct
  misc_feature 1..97: note = gNA Variant Scaffold
  source 1..97: mol_type = other RNA
tactggcgcttttatctcattactttgagagccatcaccagcgactatgtcgtatgggtaaagcgcacatgaggattacccatgtgaagcatcaaag

SEQ ID NO: 2112 - RNA, 106 nt, synthetic construct
  misc_feature 1..106: note = gNA Variant Scaffold
  source 1..106: mol_type = other RNA
gctggcgcttttatctcattactttgagagccatcaccagcgactatgtcgtatgggtaaagcgcttatttatcgtgagaaatccgataaataagaagcatcaaag

SEQ ID NO: 2113 - RNA, 96 nt, synthetic construct
  misc_feature 1..96: note = gNA Variant Scaffold
  source 1..96: mol_type = other RNA
tactggcgcttttatctcattactttgagagccatcaccagcgactatgtcgtatgggtaaagcgctgcatgtctaagacagcagaagcatcaaag

SEQ ID NO: 2114 - RNA, 90 nt, synthetic construct
  misc_feature 1..90: note = gNA Variant Scaffold
  source 1..90: mol_type = other RNA
tactggcgcttttatctcattactttgagagccatcaccagcgactatgtcgtatgggtaaagcgcagggcttcggccgaagcatcaaag

SEQ ID NO: 2115 - RNA, 98 nt, synthetic construct
  misc_feature 1..98: note = gNA Variant Scaffold
  source 1..98: mol_type = other RNA
tactggcgcttttatctcattactttgagagccatcaccagcgactatgtcgtatgggtaaagcgcaatccattgcactccggattgaagcatcaaag

SEQ ID NO: 2116 - RNA, 108 nt, synthetic construct
  misc_feature 1..108: note = gNA Variant Scaffold
  source 1..108: mol_type = other RNA
tactggcgcttttctcgcattactttgagagccatcaccagcgactatgtcgtatgggtaaagcgcttatttatcggagagaaatccgataaataagaagcatcaaag

SEQ ID NO: 2117 - RNA, 108 nt, synthetic construct
  misc_feature 1..108: note = gNA Variant Scaffold
  source 1..108: mol_type = other RNA
tactggcgcttttatctcattactttgagagccatcaccagcgactatgtcgtatgggtaaagcgcttatttatcggacttcggtccgataaataagaagcatcaaag

SEQ ID NO: 2118 - RNA, 100 nt, synthetic construct
  misc_feature 1..100: note = gNA Variant Scaffold
  source 1..100: mol_type = other RNA
tactggcgcttttatctcattactttgagagccatcaccagcgactatgtcgtatgggtaaagcgctgctcgtttgcggctacgagcagaagcatcaaag

SEQ ID NO: 2119 - RNA, 100 nt, synthetic construct
  misc_feature 1..100: note = gNA Variant Scaffold
  source 1..100: mol_type = other RNA
tactggcgcttttatctcattactttgagagccatcaccagcgactatgtcgtatgggtaaagcgcttatttatcgagagataaataagaagcatcaaag

SEQ ID NO: 2120 - RNA, 107 nt, synthetic construct
  misc_feature 1..107: note = gNA Variant Scaffold
  source 1..107: mol_type = other RNA
tacggcgcttttatctcattactttgagagccatcaccagcgactatgtcgtatgggtaaagcgcttatttatcggagagaaatccgataaataagaagcatcaaag

SEQ ID NO: 2121 - RNA, 99 nt, synthetic construct
  misc_feature 1..99: note = gNA Variant Scaffold
  source 1..99: mol_type = other RNA
tactggcgccttttatctcattactttgagagccatcaccagcgactatgtcgtatgggtaaagcgcttacggacttcggtccgtaagaagcatcaaag

SEQ ID NO: 2122 - RNA, 108 nt, synthetic construct
  misc_feature 1..108: note = gNA Variant Scaffold
  source 1..108: mol_type = other RNA
tactggcgcttttatctcattactttgagagccatcaccagcgactatgtcgtatcggtaaagcgcttatttatcggagagaaatccgataaataagaagcatcaaag

SEQ ID NO: 2123 - RNA, 108 nt, synthetic construct
  misc_feature 1..108: note = gNA Variant Scaffold
  source 1..108: mol_type = other RNA
tactggcgcctttatctcattactttgagagccatcaccagcgactatgtcgtatgggtaaagcgcttatttatcggacttcggtccgataaataagaagcatcaaag

SEQ ID NO: 2124 - RNA, 105 nt, synthetic construct
  misc_feature 1..105: note = gNA Variant Scaffold
  source 1..105: mol_type = other RNA
tactggcgcttttatctcattactttgagagccatcaccagcgactatgtcgtatgggtaaagcgcttatttatcgagaaatccgataaataagaagcatcaaag

SEQ ID NO: 2125 - RNA, 103 nt, synthetic construct
  misc_feature 1..103: note = gNA Variant Scaffold
  source 1..103: mol_type = other RNA
gcgcttttatctcattactttgagagccatcaccagcgactatgtcgtatgggtaaagcgcttatttatcggagagaaatccgataaataagaagcatcaaag

SEQ ID NO: 2126 - RNA, 103 nt, synthetic construct
  misc_feature 1..103: note = gNA Variant Scaffold
  source 1..103: mol_type = other RNA
tactggcgcttttatctcattactttgagagccatcaccagcgactatgtcgtatgggtaaagcgcttatttatcggagagagataaataagaagcatcaaag

SEQ ID NO: 2127 - RNA, 108 nt, synthetic construct
  misc_feature 1..108: note = gNA Variant Scaffold
  source 1..108: mol_type = other RNA
tactggcgcttttatctcattactttggagagccatcaccagcgactatgtcgtatgggtaaagcgcttatttatcggagagtatccgataaataagaagcatcaaag

SEQ ID NO: 2128 - RNA, 109 nt, synthetic construct
  misc_feature 1..109: note = gNA Variant Scaffold
  source 1..109: mol_type = other RNA
tactggcgcttttatctcattactttgagagccatcaccagcgactatgttcgtatgggtaaagcgcttatttatcggagagaaatccgataaataagaagcatcaaag

SEQ ID NO: 2129 - RNA, 105 nt, synthetic construct
  misc_feature 1..105: note = gNA Variant Scaffold
  source 1..105: mol_type = other RNA
agcgcttttatctcattactttgagagccatcaccagcgactatgtcgtatgggtaaagcgcttatttatcggagagaaatgccgataaataagaagcatcaaag

SEQ ID NO: 2130 - RNA, 109 nt, synthetic construct
  misc_feature 1..109: note = gNA Variant Scaffold
  source 1..109: mol_type = other RNA
tactggcgcttttatctcattactttgagagccatcaccagcgactatgtcgtatgggtaaagcgcttatttatcggagagaaatccgataaaataagaagcatcaaag

SEQ ID NO: 2131 - RNA, 109 nt, synthetic construct
  misc_feature 1..109: note = gNA Variant Scaffold
  source 1..109: mol_type = other RNA
tactggcgcttttatctcattactttgagagccatcaccagcgactatgtcgtatgggtaaagcgcttattgtatcggagagaaatccgataaataagaagcatcaaag

SEQ ID NO: 2132 - RNA, 102 nt, synthetic construct
  misc_feature 1..102: note = gNA Variant Scaffold
  source 1..102: mol_type = other RNA
gcgcttttatctcattactttgagagccatcaccagcgactatgtcgtatgggtaaagcgcttatttatcggacttcggtccgataaataagcgcatcaaag

SEQ ID NO: 2133 - RNA, 108 nt, synthetic construct
  misc_feature 1..108: note = gNA Variant Scaffold
  source 1..108: mol_type = other RNA
tactggcgcttttctctcattactttgagagccatcaccagcgactatgtcgtatgggtaaagcgcttatttatcggagagaaatccgataaataagaagcatcaaag

SEQ ID NO: 2134 - RNA, 106 nt, synthetic construct
  misc_feature 1..106: note = gNA Variant Scaffold
  source 1..106: mol_type = other RNA
gtggcgcttttatctcattactttgagagccatcaccagcgactatgtcgtatgggtaaagcgcttatttatcggagagaaatccgataaataagaagcatcaaag

SEQ ID NO: 2135 - RNA, 110 nt, synthetic construct
  misc_feature 1..110: note = gNA Variant Scaffold
  source 1..110: mol_type = other RNA
tactggcgcttttatctcattactttgagagccatcaccagcgaccttatgtcgtatgggtaaagcgcttatttatcggagagaaatccgataaataagaagcatcaaag

SEQ ID NO: 2136 - RNA, 107 nt, synthetic construct
  misc_feature 1..107: note = gNA Variant Scaffold
  source 1..107: mol_type = other RNA
gatggcgcttttatctcattactttgagagccatcaccagcgactatgtcgtatgggtaaagcgcttatttatcggacttcggtccgataaataagaagcatcaaag

SEQ ID NO: 2137 - RNA, 106 nt, synthetic construct
  misc_feature 1..106: note = gNA Variant Scaffold
  source 1..106: mol_type = other RNA
tactggcgcttttatctcattactttgagagccatcaccagcgactatgtcgtatgggtaaagcgcttatttatcggagagaaatccgataaaagaagcatcaaag

SEQ ID NO: 2138 - RNA, 109 nt, synthetic construct
  misc_feature 1..109: note = gNA Variant Scaffold
  source 1..109: mol_type = other RNA
tactggcgcttttatctcattactttgagagccatcaccagcgatctatgtcgtatgggtaaagcgcttatttatcggagagaaatccgataaataagaagcatcaaag

SEQ ID NO: 2139 - RNA, 106 nt, synthetic construct
  misc_feature 1..106: note = gNA Variant Scaffold
  source 1..106: mol_type = other RNA
tactggcgcttttatctcattactttgagagccatcaccagcgactatgtcgtatgggtaaaggcttatttatcggagagaaatccgataaaaagaagcatcaaag

SEQ ID NO: 2140 - RNA, 107 nt, synthetic construct
  misc_feature 1..107: note = gNA Variant Scaffold
  source 1..107: mol_type = other RNA
tactggcgcttttatctcattactttgagagccatcaccagcgactatgtcgtatgggtaaagcgcttatttatcggagagaaatccgataaaaagaagcatcaaag

SEQ ID NO: 2141 - RNA, 107 nt, synthetic construct
  misc_feature 1..107: note = gNA Variant Scaffold
  source 1..107: mol_type = other RNA
tactggcgctttatctcattactttgagagccatcaccagcgactatgtcgtatgggtaaagcgcttatttatcggacttcggtccgataaataagaagcatcaaag

SEQ ID NO: 2142 - RNA, 98 nt, synthetic construct
  misc_feature 1..98: note = gNA Variant Scaffold
  source 1..98: mol_type = other RNA
cggcgcttttctcgcattactttgagagccatcaccagcgactatgtcgtatgggtaaagcgcttattgtatcgagagataaataagaagcatcaaag

SEQ ID NO: 2143 - RNA, 107 nt, synthetic construct
  misc_feature 1..107: note = gNA Variant Scaffold
  source 1..107: mol_type = other RNA
cactggcgcttttatctcattactttgagagccatcaccagcgactatgtcgtatgggtaaagcgcttattttcggagagaaatccgataaataagaagcatcaaag

SEQ ID NO: 2144 - RNA, 106 nt, synthetic construct
  misc_feature 1..106: note = gNA Variant Scaffold
  source 1..106: mol_type = other RNA
tactggcgctttatctcattactttgagagccatcaccagcgacttcggtcgtatgggtaaagcgcttatgtatcggcttcggccgatacataagaagcatcaaag

SEQ ID NO: 2145 - RNA, 107 nt, synthetic construct
  misc_feature 1..107: note = gNA Variant Scaffold
  source 1..107: mol_type = other RNA
tactggcgcttttatctcattactttgagagccatcaccagcgacttcggtcgtatgggtaaagcgcttatgtatcggcttcggccgatacataagaagcatcaaag

SEQ ID NO: 2146 - RNA, 109 nt, synthetic construct
  misc_feature 1..109: note = gNA Variant Scaffold
  source 1..109: mol_type = other RNA
tactggcgcttttatctcattactttgagagccatcaccagcgactatgtcgtatgggtgaaagcgcttatttatcggagagaaatccgataaataagaagcatcaaag

SEQ ID NO: 2147 - RNA, 64 nt, synthetic construct
  misc_feature 1..64: note = gNA Variant Scaffold
  source 1..64: mol_type = other RNA
tactggcgcttttatctcattactttgagagccatcaccagcgacttcggtcgtatgggtaaag

SEQ ID NO: 2148 - RNA, 62 nt, synthetic construct
  misc_feature 1..62: note = gNA Variant Scaffold
  source 1..62: mol_type = other RNA
gatgggcttttatctcattactttgagagccatcaccagcgacttcggtcgtatgggtaaag

SEQ ID NO: 2149 - RNA, 105 nt, synthetic construct
  misc_feature 1..105: note = gNA Variant Scaffold
  source 1..105: mol_type = other RNA
gatgggcttttatctcattactttgagagccatcaccagcgacttcggtcgtatgggtaaagcgcttatttatcggcttcggccgataaataagaagcatcaaag

SEQ ID NO: 2150 - RNA, 156 nt, synthetic construct
  misc_feature 1..156: note = gNA Variant Scaffold
  source 1..156: mol_type = other RNA
tactggcgcttttatctcattactttgagagccatcaccagcgactatgtcgtatgggtaaagcgctacactgggatcgctgaattagagatcggcgtcctttcattctatatactttggagttttaaaatgtctctaagtacagaagcatcaaag

SEQ ID NO: 2151 - RNA, 103 nt, synthetic construct
  misc_feature 1..103: note = gNA Variant Scaffold
  source 1..103: mol_type = other RNA
ggcgcttttatctcattactttgagagccatcaccagcgacttcggtcgtatgggtaaagcgcttatttatcggcttcggccgataaataagaagcatcaaag

SEQ ID NO: 2152 - RNA, 106 nt, synthetic construct
  misc_feature 1..106: note = gNA Variant Scaffold
  source 1..106: mol_type = other RNA
gctggcgcttttatctcattactttgagagccatcaccagcgacttcggtcgtatgggtaaagcgcttatttatcggcttcggccgataaataagaagcatcaaag

SEQ ID NO: 2153 - RNA, 109 nt, synthetic construct
  misc_feature 1..109: note = gNA Variant Scaffold
  source 1..109: mol_type = other RNA
tactggcgcttttatctcattactttgagagccatcaccagcgacttcggtcgtatgggtaaagcgcttatttatcggagagaaatccgataaataagaagcatcaaag

SEQ ID NO: 2154 - RNA, 112 nt, synthetic construct
  misc_feature 1..112: note = gNA Variant Scaffold
  source 1..112: mol_type = other RNA
tactggcgcttttatctcattactttgagagccatgctccaccagcgactatgtcgtatgggtaaagcgcttatttatcggagagaaatccgataaataagaagcatcaaag

SEQ ID NO: 2155 - RNA, 97 nt, synthetic construct
  misc_feature 1..97: note = gNA Variant Scaffold
  source 1..97: mol_type = other RNA
tactggcgcttttatctcattactttgagagccatcaccagcgactatgtcgtatgggtaaagcggggttagggttagggttagggaagcatcaaag

SEQ ID NO: 2156 - RNA, 96 nt, synthetic construct
  misc_feature 1..96: note = gNA Variant Scaffold
  source 1..96: mol_type = other RNA
tactggcgcttttatctcattactttgagagccatcaccagcgactatgtcgtatgggtaaagcggagggagggagggagagggaaagcatcaaag

SEQ ID NO: 2157 - RNA, 101 nt, synthetic construct
  misc_feature 1..101: note = gNA Variant Scaffold
  source 1..101: mol_type = other RNA
tactggcgcttttatctcattactttgagagccatcaccagcgactatgtcgtatgggtaaagcgttgggttagggttagggttagggaaaagcatcaaag

SEQ ID NO: 2158 - RNA, 91 nt, synthetic construct
  misc_feature 1..91: note = gNA Variant Scaffold
  source 1..91: mol_type = other RNA
tactggcgcttttatctcattactttgagagccatcaccagcgactatgtcgtatgggtaaagcgcagggcttcggccggaagcatcaaag

SEQ ID NO: 2159 - RNA, 103 nt, synthetic construct
  misc_feature 1..103: note = gNA Variant Scaffold
  source 1..103: mol_type = other RNA
tactggcgcttttatctcattactttgagagccatcaccagcgactatgtcgtatgggtaaagcgcctgctcagtacgagaggaaccgcaggaagcatcaaag

SEQ ID NO: 2160 - RNA, 90 nt, synthetic construct
  misc_feature 1..90: note = gNA Variant Scaffold
  source 1..90: mol_type = other RNA
tactggcgcttttatctgattactttgagagccatcaccagcgactatgtcgtatgggtaaagcgccctcttcggagggaagcatcaaag

SEQ ID NO: 2161 - RNA, 98 nt, synthetic construct
  misc_feature 1..98: note = gNA Variant Scaffold
  source 1..98: mol_type = other RNA
tactggcgcctttatctgattactttgagagccatcaccagcgactatgtcgtatgggtaaagcgcttacggacttcggtccgtaagaagcatcaaag

SEQ ID NO: 2162 - RNA, 98 nt, synthetic construct
  misc_feature 1..98: note = gNA Variant Scaffold
  source 1..98: mol_type = other RNA
tactggcgcttttatctgattactttgagagccatcaccagcgactatgtcgtatgggtaaagcgcggacgacctctcggtcgtccgaagcatcaaag

SEQ ID NO: 2163 - RNA, 108 nt, synthetic construct
  misc_feature 1..108: note = gNA Variant Scaffold
  source 1..108: mol_type = other RNA
tactggcgcttttatctgattactttgagagccatcaccagcgactatgtcgtatgggtaaagcgcaggtgggacgacctctcggtcgtcctatctgaagcatcaaag

SEQ ID NO: 2164 - RNA, 99 nt, synthetic construct
  misc_feature 1..99: note = gNA Variant Scaffold
  source 1..99: mol_type = other RNA
tactggcgcctttatctgcattactttgagagccatcaccagcgactatgtcgtatgggtaaagcgcttacggacttcggtccgtaagaagcatcaaag

SEQ ID NO: 2165 - RNA, 97 nt, synthetic construct
  misc_feature 1..97: note = gNA Variant Scaffold
  source 1..97: mol_type = other RNA
gctggcgcttttatctgattactttgagagccatcaccagcgactatgtcgtatgggtaaagcgcttacggacttcggtccgtaagaagcatcaaag

SEQ ID NO: 2166 - RNA, 108 nt, synthetic construct
  misc_feature 1..108: note = gNA Variant Scaffold
  source 1..108: mol_type = other RNA
tactggcgcctttatctgattactttgagagccatcaccagcgactatgtcgtatgggtaaagcgcaggtgggacgacctctcggtcgtcctatctgaagcatcaaag

SEQ ID NO: 2167 - RNA, 98 nt, synthetic construct
  misc_feature 1..98: note = gNA Variant Scaffold
  source 1..98: mol_type = other RNA
tactggcgcctttatctgattactttgagagccatcaccagcgactatgtcgtatgggtaaagcgcggacgacctctcggtcgtccgaagcatcaaag

SEQ ID NO: 2168 - RNA, 90 nt, synthetic construct
  misc_feature 1..90: note = gNA Variant Scaffold
  source 1..90: mol_type = other RNA
tactggcgcctttatctcattactttgagagccatcaccagcgactatgtcgtatgggtaaagcgccctcttcggagggaagcatcaaag

SEQ ID NO: 2169 - RNA, 98 nt, synthetic construct
  misc_feature 1..98: note = gNA Variant Scaffold
  source 1..98: mol_type = other RNA
tactggcgcttttatctcattactttgagagccatcaccagcgactatgtcgtatgggtaaagcgcttacggacttcggtccgtaagaagcatcaaag

SEQ ID NO: 2170 - RNA, 99 nt, synthetic construct
  misc_feature 1..99: note = gNA Variant Scaffold
  source 1..99: mol_type = other RNA
tactggcgcctttatcatcattactttgagagccatcaccagcgactatgtcgtatgggtaaagcgcttacggacttcggtccgtaagaagcatcaaag

SEQ ID NO: 2171 - RNA, 194 nt, synthetic construct
  misc_feature 1..194: note = gNA Variant Scaffold
  source 1..194: mol_type = other RNA
tactggcgcttttatctcattactttgagagccatcaccagcgactatgtcgtatgggtaaagcgcttatttatcggagagaaatccgataaataagaagcatcaaagggccggcatggtcccagcctcctcgctggcgccggctgggcaacattccgaggggaccgtcccctcggtaatggcgaatgggaccc

SEQ ID NO: 2172 - RNA, 108 nt, synthetic construct
  misc_feature 1..108: note = gNA Variant Scaffold
  source 1..108: mol_type = other RNA
tactggcgcctttatctcattactttgagagccatcaccagcgactatgtcgtatgggtaaagcgcaggtgggacgacctctcggtcgtcctatctgaagcatcaaag

SEQ ID NO: 2173 - RNA, 106 nt, synthetic construct
  misc_feature 1..106: note = gNA Variant Scaffold
  source 1..106: mol_type = other RNA
tactggcgcttttatctcattactttgagagccatcaccagcgactatgtcgtatgggtaaagcgcttatttatcggagaaatccgataaataagaagcatcaaag

SEQ ID NO: 2174 - RNA, 98 nt, synthetic construct
  misc_feature 1..98: note = gNA Variant Scaffold
  source 1..98: mol_type = other RNA
tactggcgcctttatctcattactttgagagccatcaccagcgactatgtcgtatgggtaaagcgcggacgacctctcggtcgtccgaagcatcaaag

SEQ ID NO: 2175 - RNA, 92 nt, synthetic construct
  misc_feature 1..92: note = gNA Variant Scaffold
  source 1..92: mol_type = other RNA
tactggcgcttttatctcattactttgagagccatcaccagcgactatgtcgtatgggtaaagcgccggacttcggtccggaagcatcaaag

SEQ ID NO: 2176 - RNA, 108 nt, synthetic construct
  misc_feature 1..108: note = gNA Variant Scaffold
  source 1..108: mol_type = other RNA
tactggcgcttttatcggattactttgagagccatcaccagcgactatgtcgtatgggtaaagcgcttatttatcggagagaaatccgataaataagaagcatcaaag

SEQ ID NO: 2177 - RNA, 98 nt, synthetic construct
  misc_feature 1..98: note = gNA Variant Scaffold
  source 1..98: mol_type = other RNA
tactggcgcttttatctcattactttgagagccatcaccagcgactatgtcgtatgggtaaagcgcggacgacctctcggtcgtccgaagcatcaaag

SEQ ID NO: 2178 - RNA, 89 nt, synthetic construct
  misc_feature 1..89: note = gNA Variant Scaffold
  source 1..89: mol_type = other RNA
gctggcgcttttatctgattactttgagagccatcaccagcgactatgtcgtatgggtaaagcgccctcttcggagggaagcatcaaag

SEQ ID NO: 2179 - RNA, 88 nt, synthetic construct
  misc_feature 1..88: note = gNA Variant Scaffold
  source 1..88: mol_type = other RNA
gctggcgcctttatctgattactttgagagccatcaccagcgactatgtcgtatgggtaaagctccctcttcggagggagcatcaaag

SEQ ID NO: 2180 - RNA, 197 nt, synthetic construct
  misc_feature 1..197: note = gNA Variant Scaffold
  source 1..197: mol_type = other RNA
tactggcgcttttatctcattactttgagagccatcaccagcgactatgtcgtatgggtaaagcgcttatttatcggagagaaatccgataaataagaagcatcaaaggggtcggcatggcatctccacctcctcgcggtccgacctgggcatccgaaggaggacgcacgtccactcggatggctaagggagagcca

SEQ ID NO: 2181 - RNA, 88 nt, synthetic construct
  misc_feature 1..88: note = gNA Variant Scaffold
  source 1..88: mol_type = other RNA
gctggcgcctttatctgattactttgagagccatcaccagcgactatgtcgtatgggtaaagcgccctcttcggagggcgcatcaaag

SEQ ID NO: 2182 - RNA, 186 nt, synthetic construct
  misc_feature 1..186: note = gNA Variant Scaffold
  source 1..186: mol_type = other RNA
tactggcgcttttatctcattactttgagagccatcaccagcgactatgtcgtatgggtaaagcgcttatttatcggagagaaatccgataaataagaagcatcaaagttttggccggcatggtcccagcctcctcgctggcgccggctgggcaacatgcttcggcatggcgaatgggaccccggg

SEQ ID NO: 2183 - RNA, 97 nt, synthetic construct
  misc_feature 1..97: note = gNA Variant Scaffold
  source 1..97: mol_type = other RNA
gatggcgcctttatctcattactttgagagccatcaccagcgactatgtcgtatgggtaaagcgcttacggacttcggtccgtaagaagcatcaaag

SEQ ID NO: 2184 - RNA, 89 nt, synthetic construct
  misc_feature 1..89: note = gNA Variant Scaffold
  source 1..89: mol_type = other RNA
gctggcgcttttatctcattactttgagagccatcaccagcgactatgtcgtatgggtaaagcgccctcttcggagggaagcatcaaag

SEQ ID NO: 2185 - RNA, 96 nt, synthetic construct
  misc_feature 1..96: note = gNA Variant Scaffold
  source 1..96: mol_type = other RNA
gctggcgcctttatctgattactttgagagccatcaccagcgactatgtcgtatgggtaaagctcttacggacttcggtccgtaagagcatcaaag

SEQ ID NO: 2186 - RNA, 96 nt, synthetic construct
  misc_feature 1..96: note = gNA Variant Scaffold
  source 1..96: mol_type = other RNA
gctggcgcctttatctgattactttgagagccatcaccagcgactatgtcgtatgggtaaagctcggacgacctctcggtcgtccgagcatcaaag

SEQ ID NO: 2187 - RNA, 160 nt, synthetic construct
  misc_feature 1..160: note = gNA Variant Scaffold
  source 1..160: mol_type = other RNA
tactggcgcttttatctcattactttgagagccatcaccagcgactatgtcgtatgggtaaagcgcttatttatcggagagaaatccgataaataagaagcatcaaagcctgtcaccggatgtgctttccggtctgatgagtccgtgaggacgaaacagg

SEQ ID NO: 2188 - RNA, 97 nt, synthetic construct
  misc_feature 1..97: note = gNA Variant Scaffold
  source 1..97: mol_type = other RNA
gctggcgcttttatctgattactttgagagccatcaccagcgactatgtcgtatgggtaaagcgcggacgacctctcggtcgtccgaagcatcaaag

SEQ ID NO: 2189 - RNA, 97 nt, synthetic construct
  misc_feature 1..97: note = gNA Variant Scaffold
  source 1..97: mol_type = other RNA
gctggcgcctttatctgattactttgagagccatcaccagcgactatgtcgtatgggtaaagcgcggacgacctctcggtcgtccgaagcatcaaag

SEQ ID NO: 2190 - RNA, 106 nt, synthetic construct
  misc_feature 1..106: note = gNA Variant Scaffold
  source 1..106: mol_type = other RNA
gctggcgcctttatctgattactttgagagccatcaccagcgactatgtcgtatgggtaaagctcaggtgggacgacctctcggtcgtcctatctgagcatcaaag

SEQ ID NO: 2191 - RNA, 177 nt, synthetic construct
  misc_feature 1..177: note = gNA Variant Scaffold
  source 1..177: mol_type = other RNA
tactggcgcttttatctcattactttgagagccatcaccagcgactatgtcgtatgggtaaagcgcttatttatcggagagaaatccgataaataagaagcatcaaaggatggccggcatggtcccagcctcctcgctggcgccggctgggcaacaccttcgggtggcgaatgggac

SEQ ID NO: 2192 - RNA, 107 nt, synthetic construct
  misc_feature 1..107: note = gNA Variant Scaffold
  source 1..107: mol_type = other RNA
gctggcgcttttatctgattactttgagagccatcaccagcgactatgtcgtatgggtaaagcgcaggtgggacgacctctcggtcgtcctatctgaagcatcaaag

SEQ ID NO: 2193 - RNA, 109 nt, synthetic construct
  misc_feature 1..109: note = gNA Variant Scaffold
  source 1..109: mol_type = other RNA
tactggcgcttttatctcattactttgagagccatcaccagcgactatgtcgtactgggtaaagcgcttatttatcggagagaaatccgataaataagaagcatcaaag

SEQ ID NO: 2194 - RNA, 107 nt, synthetic construct
  misc_feature 1..107: note = gNA Variant Scaffold
  source 1..107: mol_type = other RNA
tactggcgcttttatctcattactttgagagccatcaccagcgactatgtcgtatgggtaaagcgcttatttatcgtgagaaatccgataaataagaagcatcaaag

SEQ ID NO: 2195 - RNA, 109 nt, synthetic construct
  misc_feature 1..109: note = gNA Variant Scaffold
  source 1..109: mol_type = other RNA
gtactggcgcttttatctcattactttgagagccatcaccagcgactatgtcgtatgggtaaagcgcttatttatcggagagaaatccgataaataagaagcatcaaag

SEQ ID NO: 2196 - RNA, 97 nt, synthetic construct
  misc_feature 1..97: note = gNA Variant Scaffold
  source 1..97: mol_type = other RNA
gctggcgcttttatctcattactttgagagccatcaccagcgactatgtcgtatgggtaaagcgcggacgacctctcggtcgtccgaagcatcaaag

SEQ ID NO: 2197 - RNA, 97 nt, synthetic construct
  misc_feature 1..97: note = gNA Variant Scaffold
  source 1..97: mol_type = other RNA
gctggcgcctttatctgattactttgagagccatcaccagcgactatgtcgtatgggtaaagcgcttacggacttcggtccgtaagaagcatcaaag

SEQ ID NO: 2198 - RNA, 107 nt, synthetic construct
  misc_feature 1..107: note = gNA Variant Scaffold
  source 1..107: mol_type = other RNA
gctggcgcttttatctcattactttgagagccatcaccagcgactatgtcgtatgggtaaagcgcttatttatcggagagaaatccgataaataagaagcatcaaag

SEQ ID NO: 2199 - RNA, 97 nt, synthetic construct
  misc_feature 1..97: note = gNA Variant Scaffold
  source 1..97: mol_type = other RNA
gctggcgcctttatctcattactttgagagccatcaccagcgactatgtcgtatgggtaaagcgcttacggacttcggtccgtaagaagcatcaaag

SEQ ID NO: 2200 - RNA, 89 nt, synthetic construct
  misc_feature 1..89: note = gNA Variant Scaffold
  source 1..89: mol_type = other RNA
gctggcgcctttatctgattactttgagagccatcaccagcgactatgtcgtatgggtaaagcgccctcttcggagggaagcatcaaag

SEQ ID NO: 2201 - RNA, 107 nt, synthetic construct
  misc_feature 1..107: note = gNA Variant Scaffold
  source 1..107: mol_type = other RNA
gctggcgcttttatctcattactttgagagccatcaccagcgactatgtcgtatgggtaaagcgcaggtgggacgacctctcggtcgtcctatctgaagcatcaaag

SEQ ID NO: 2202 - RNA, 107 nt, synthetic construct
  misc_feature 1..107: note = gNA Variant Scaffold
  source 1..107: mol_type = other RNA
gctggcgcctttatctcattactttgagagccatcaccagcgactatgtcgtatgggtaaagcgcaggtgggacgacctctcggtcgtcctatctgaagcatcaaag

SEQ ID NO: 2203 - RNA, 107 nt, synthetic construct
  misc_feature 1..107: note = gNA Variant Scaffold
  source 1..107: mol_type = other RNA
gctggcgcctttatctgattactttgagagccatcaccagcgactatgtcgtatgggtaaagcgcaggtgggacgacctctcggtcgtcctatctgaagcatcaaag

SEQ ID NO: 2204 - RNA, 98 nt, synthetic construct
  misc_feature 1..98: note = gNA Variant Scaffold
  source 1..98: mol_type = other RNA
tactggcgcttttatctgattactttgagagccatcaccagcgactatgtcgtatgggtaaagcgcttacggacttcggtccgtaagaagcatcaaag

SEQ ID NO: 2205 - RNA, 89 nt, synthetic construct
  misc_feature 1..89: note = gNA Variant Scaffold
  source 1..89: mol_type = other RNA
gctggcgcctttatctcattactttgagagccatcaccagcgactatgtcgtatgggtaaagcgccctcttcggagggaagcatcaaag

SEQ ID NO: 2206 - RNA, 97 nt, synthetic construct
  misc_feature 1..97: note = gNA Variant Scaffold
  source 1..97: mol_type = other RNA
gctggcgcttttatctcattactttgagagccatcaccagcgactatgtcgtatgggtaaagcgcttacggacttcggtccgtaagaagcatcaaag

SEQ ID NO: 2207 - RNA, 97 nt, synthetic construct
  misc_feature 1..97: note = gNA Variant Scaffold
  source 1..97: mol_type = other RNA
gctggcgcctttatctcattactttgagagccatcaccagcgactatgtcgtatgggtaaagcgcggacgacctctcggtcgtccgaagcatcaaag

SEQ ID NO: 2208 - RNA, 177 nt, synthetic construct
  misc_feature 1..177: note = gNA Variant Scaffold
  source 1..177: mol_type = other RNA
gatggccggcatggtcccagcctcctcgctggcgccggctgggcaacaccttcgggtggcgaatgggactactggcgcttttatctcattactttgagagccatcaccagcgactatgtcgtatgggtaaagcgcttatttatcggagagaaatccgataaataagaagcatcaaag

SEQ ID NO: 2209 - RNA, 194 nt, synthetic construct
  misc_feature 1..194: note = gNA Variant Scaffold
  source 1..194: mol_type = other RNA
ggccggcatggtcccagcctcctcgctggcgccggctgggcaacattccgaggggaccgtcccctcggtaatggcgaatgggaccctactggcgcttttatctcattactttgagagccatcaccagcgactatgtcgtatgggtaaagcgcttatttatcggagagaaatccgataaataagaagcatcaaag

SEQ ID NO: 2210 - RNA, 96 nt, synthetic construct
  misc_feature 1..96: note = gNA Variant Scaffold
  source 1..96: mol_type = other RNA
gctggcgcctttatctgattactttgagagccatcaccagcgactatgtcgtatgggtaaagcgcttacggacttcggtccgtaagcgcatcaaag

SEQ ID NO: 2211 - RNA, 172 nt, synthetic construct
  misc_feature 1..172: note = gNA Variant Scaffold
  source 1..172: mol_type = other RNA
cgtggttagggccacgttaaatagttgcttaagccctaagcgttgatcttcggatcaggtgcaatactggcgcttttatctcattactttgagagccatcaccagcgactatgtcgtatgggtaaagcgcttatttatcggagagaaatccgataaataagaagcatcaaag

SEQ ID NO: 2212 - RNA, 197 nt, synthetic construct
  misc_feature 1..197: note = gNA Variant Scaffold
  source 1..197: mol_type = other RNA
gggtcggcatggcatctccacctcctcgcggtccgacctgggcatccgaaggaggacgcacgtccactcggatggctaagggagagccatactggcgcttttatctcattactttgagagccatcaccagcgactatgtcgtatgggtaaagcgcttatttatcggagagaaatccgataaataagaagcatcaaag

SEQ ID NO: 2213 - RNA, 171 nt, synthetic construct
  misc_feature 1..171: note = gNA Variant Scaffold
  source 1..171: mol_type = other RNA
tactggcgcttttatctcattactttgagagccatcaccagcgactatgtcgtatgggtaaagcgcttatttatcggagagaaatccgataaataagaagcatcaaagccagtactgatgagtccgtgaggacgaaacgagtaagctcgtctactggcgcttttatctcat

SEQ ID NO: 2214 - RNA, 99 nt, synthetic construct
  misc_feature 1..99: note = gNA Variant Scaffold
  source 1..99: mol_type = other RNA
tactggcgcctttatctcattactttagagagccatcaccagcgactatgtcgtatgggtaaagcgcttacggacttcggtccgtaagaagcatcaaag

SEQ ID NO: 2215 - RNA, 157 nt, synthetic construct
  misc_feature 1..157: note = gNA Variant Scaffold
  source 1..157: mol_type = other RNA
cgactactgatgagtccgtgaggacgaaacgagtaagctcgtctagtcgtactggcgcttttatctcattactttgagagccatcaccagcgactatgtcgtatgggtaaagcgcttatttatcggagagaaatccgataaataagaagcatcaaag

SEQ ID NO: 2216 - RNA, 106 nt, synthetic construct
  misc_feature 1..106: note = gNA Variant Scaffold
  source 1..106: mol_type = other RNA
gctggcgcctttatctgattactttgagagccatcaccagcgactatgtcgtatgggtaaagcgcaggtgggacgacctctcggtcgtcctatctgcgcatcaaag

SEQ ID NO: 2217 - RNA, 97 nt, synthetic construct
  misc_feature 1..97: note = gNA Variant Scaffold
  source 1..97: mol_type = other RNA
tactggcgcctttatctcattactttagagccatcaccagcgactatgtcgtatgggtaaagcgcttacggacttcggtccgtaagaagcatcaaag

SEQ ID NO: 2218 - RNA, 186 nt, synthetic construct
  misc_feature 1..186: note = gNA Variant Scaffold
  source 1..186: mol_type = other RNA
tactggcgcttttatctcattactttgagagccatcaccagcgactatgtcgtatgggtaaagcgcttatttatcggagagaaatccgataaataagaagcatcaaagcattcctcagaaaatgacaaacctgtggggcgtaagtagatcttcggatctatgatcgtgcagacgttaaaatcaggt

SEQ ID NO: 2219 - RNA, 171 nt, synthetic construct
  misc_feature 1..171: note = gNA Variant Scaffold
  source 1..171: mol_type = other RNA
tactggcgcttttatctcattactttgagagccatcaccagcgactatgtcgtatgggtaaagcgcttatttatcggagagaaatccgataaataagaagcatcaaagcgactactgatgagtccgtgaggacgaaacgagtaagctcgtctagtcgcgtgtagcgaagca

SEQ ID NO: 2220 - RNA, 186 nt, synthetic construct
  misc_feature 1..186: note = gNA Variant Scaffold
  source 1..186: mol_type = other RNA
cattcctcagaaaatgacaaacctgtggggcgtaagtagatcttcggatctatgatcgtgcagacgttaaaatcaggttactggcgcttttatctcattactttgagagccatcaccagcgactatgtcgtatgggtaaagcgcttatttatcggagagaaatccgataaataagaagcatcaaag

SEQ ID NO: 2221 - RNA, 186 nt, synthetic construct
  misc_feature 1..186: note = gNA Variant Scaffold
  source 1..186: mol_type = other RNA
ttttggccggcatggtcccagcctcctcgctggcgccggctgggcaacatgcttcggcatggcgaatgggaccccgggtactggcgcttttatctcattactttgagagccatcaccagcgactatgtcgtatgggtaaagcgcttatttatcggagagaaatccgataaataagaagcatcaaag

SEQ ID NO: 2222 - RNA, 171 nt, synthetic construct
  misc_feature 1..171: note = gNA Variant Scaffold
  source 1..171: mol_type = other RNA
cgactactgatgagtccgtgaggacgaaacgagtaagctcgtctagtcgcgtgtagcgaagcatactggcgcttttatctcattactttgagagccatcaccagcgactatgtcgtatgggtaaagcgcttatttatcggagagaaatccgataaataagaagcatcaaag

SEQ ID NO: 2223 - RNA, 168 nt, synthetic construct
  misc_feature 1..168: note = gNA Variant Scaffold
  source 1..168: mol_type = other RNA
tactggcgcttttatctcattactttgagagccatcaccagcgactatgtcgtatgggtaaagcgcttatttatcggagagaaatccgataaataagaagcatcaaaggggagccccgctgatgaggtcggggagaccgaaagggacttcggtccctacggggctccc

SEQ ID NO: 2224 - RNA, 144 nt, synthetic construct
  misc_feature 1..144: note = gNA Variant Scaffold
  source 1..144: mol_type = other RNA
ccacccccaccaccacccccacccccaccaccaccctactggcgcttttatctcattactttgagagccatcaccagcgactatgtcgtatgggtaaagcgcttatttatcggagagaaatccgataaataagaagcatcaaag

SEQ ID NO: 2225 - RNA, 157 nt, synthetic construct
  misc_feature 1..157: note = gNA Variant Scaffold
  source 1..157: mol_type = other RNA
tactggcgcttttatctcattactttgagagccatcaccagcgactatgtcgtatgggtaaagcgcttatttatcggagagaaatccgataaataagaagcatcaaagcgactactgatgagtccgtgaggacgaaacgagtaagctcgtctagtcg

SEQ ID NO: 2226 - RNA, 172 nt, synthetic construct
  misc_feature 1..172: note = gNA Variant Scaffold
  source 1..172: mol_type = other RNA
tactggcgcttttatctcattactttgagagccatcaccagcgactatgtcgtatgggtaaagcgcttatttatcggagagaaatccgataaataagaagcatcaaagcgtggttagggccacgttaaatagttgcttaagccctaagcgttgatcttcggatcaggtgcaa

SEQ ID NO: 2227 - RNA, 184 nt, synthetic construct
  misc_feature 1..184: note = gNA Variant Scaffold
  source 1..184: mol_type = other RNA
tactggcgcttttatctcattactttgagagccatcaccagcgactatgtcgtatgggtaaagcgcttatttatcggagagaaatccgataaataagaagcatcaaagggcaataaagcggttacaagcccgcaaaaatagcagagtaatgtcgcgatagcgcggcattaatgcagctttattg

SEQ ID NO: 2228 - RNA, 122 nt, synthetic construct
  misc_feature 1..122: note = gNA Variant Scaffold
  source 1..122: mol_type = other RNA
tactggcgcttttatctcattactattatctcattactttgagagccatcaccagcgactatgtcgtatgggtaaagcgcttatttatcggagagaaatccgataaataagaagcatcaaag

SEQ ID NO: 2229 - RNA, 184 nt, synthetic construct
  misc_feature 1..184: note = gNA Variant Scaffold
  source 1..184: mol_type = other RNA
ggcaataaagcggttacaagcccgcaaaaatagcagagtaatgtcgcgatagcgcggcattaatgcagctttattgtactggcgcttttatctcattactttgagagccatcaccagcgactatgtcgtatgggtaaagcgcttatttatcggagagaaatccgataaataagaagcatcaaag

SEQ ID NO: 2230 - RNA, 185 nt, synthetic construct
  misc_feature 1..185: note = gNA Variant Scaffold
  source 1..185: mol_type = other RNA
tactggcgcttttatctcattactttgagagccatcaccagcgactatgtcgtatgggtaaagcgcttatttatcggagagaaatccgataaataagaagcatcaaagacccgcaaggccgacggcatccgccgccgctggtgcaagtccagccgccccttcgggggcgggcgctcatgggtaac

SEQ ID NO: 2231 - RNA, 63 nt, synthetic construct
  misc_feature 1..63: note = gNA Variant Scaffold
  source 1..63: mol_type = other RNA
tactggcgcttttatctcattactttgagagccatcaccagcgactatgtcgtatgggtaaag

SEQ ID NO: 2232 - RNA, 168 nt, synthetic construct
  misc_feature 1..168: note = gNA Variant Scaffold
  source 1..168: mol_type = other RNA
gggagccccgctgatgaggtcggggagaccgaaagggacttcggtccctacggggctccctactggcgcttttatctcattactttgagagccatcaccagcgactatgtcgtatgggtaaagcgcttatttatcggagagaaatccgataaataagaagcatcaaag

SEQ ID NO: 2233 - RNA, 171 nt, synthetic construct
  misc_feature 1..171: note = gNA Variant Scaffold
  source 1..171: mol_type = other RNA
ccagtactgatgagtccgtgaggacgaaacgagtaagctcgtctactggcgcttttatctcattactggcgcttttatctcattactttgagagccatcaccagcgactatgtcgtatgggtaaagcgcttatttatcggagagaaatccgataaataagaagcatcaaag

SEQ ID NO: 2234 - RNA, 185 nt, synthetic construct
  misc_feature 1..185: note = gNA Variant Scaffold
  source 1..185: mol_type = other RNA
acccgcaaggccgacggcatccgccgccgctggtgcaagtccagccgccccttcgggggcgggcgctcatgggtaactactggcgcttttatctcattactttgagagccatcaccagcgactatgtcgtatgggtaaagcgcttatttatcggagagaaatccgataaataagaagcatcaaag

SEQ ID NO: 2235 - RNA, 160 nt, synthetic construct
  misc_feature 1..160: note = gNA Variant Scaffold
  source 1..160: mol_type = other RNA
cctgtcaccggatgtgctttccggtctgatgagtccgtgaggacgaaacaggtactggcgcttttatctcattactttgagagccatcaccagcgactatgtcgtatgggtaaagcgcttatttatcggagagaaatccgataaataagaagcatcaaag

SEQ ID NO: 2236 - RNA, 100 nt, synthetic construct
  misc_feature 1..100: note = gNA Variant Scaffold
  source 1..100: mol_type = other RNA
gtactggcgcctttatctcattactttgagagccatcaccagcgactatgtcgtagtgggtaaagcgcttacggacttcggtccgtaagaagcatcaaag

SEQ ID NO: 2237 - RNA, 91 nt, synthetic construct
  misc_feature 1..91: note = gNA Variant Scaffold
  source 1..91: mol_type = other RNA
gtactggcgcttttatctgattactttgagagccatcaccagcgactatgtcgtagtgggtaaagctccctcttcggagggagcatcaaag

SEQ ID NO: 2238 - RNA, 89 nt, synthetic construct
  misc_feature 1..89: note = gNA Variant Scaffold
  source 1..89: mol_type = other RNA
actggcgcttttatctgattactttgagagccatcaccagcgactatgtcgtagtgggtaaagctccctcttcggagggagcatcaaag

SEQ ID NO: 2239 - RNA, 97 nt, synthetic construct
  misc_feature 1..97: note = gNA Variant Scaffold
  source 1..97: mol_type = other RNA
actggcgcctttatctcattactttgagagccatcaccagcgactatgtcgtatgggtaaagcgcttacggacttcggtccgtaagaagcatcaaag

SEQ ID NO: 2240 - RNA, 89 nt, synthetic construct
  misc_feature 1..89: note = gNA Variant Scaffold
  source 1..89: mol_type = other RNA
gctggcgcttttatctgattactttgagagccatcaccagcgactatgtcgtagtgggtaaagctccctcttcggagggagcatcaaag

SEQ ID NO: 2241 - RNA, 88 nt, synthetic construct
  misc_feature 1..88: note = gNA Variant Scaffold
  source 1..88: mol_type = other RNA
actggcgcttttatctgattactttgagagccatcaccagcgactatgtcgtatgggtaaagctccctcttcggagggagcatcaaag

SEQ ID NO: 2242 - RNA, 97 nt, synthetic construct
  misc_feature 1..97: note = gNA Variant Scaffold
  source 1..97: mol_type = other RNA
actggcgcctttatctgattactttgagagccatcaccagcgactatgtcgtatgggtaaagcgcttacggacttcggtccgtaagaagcatcaaag

SEQ ID NO: 2243 - RNA, 97 nt, synthetic construct
  misc_feature 1..97: note = gNA Variant Scaffold
  source 1..97: mol_type = other RNA
actggcgcttttatctgattactttgagagccatcaccagcgactatgtcgtatgggtaaagcgcttacggacttcggtccgtaagaagcatcaaag

SEQ ID NO: 2244 - RNA, 98 nt, synthetic construct
  misc_feature 1..98: note = gNA Variant Scaffold
  source 1..98: mol_type = other RNA
actggcgcttttatctgattactttgagagccatcaccagcgactatgtcgtagtgggtaaagcgcttacggacttcggtccgtaagaagcatcaaag

SEQ ID NO: 2245 - RNA, 89 nt, synthetic construct
  misc_feature 1..89: note = gNA Variant Scaffold
  source 1..89: mol_type = other RNA
actggcgcttttatctgattactttgagagccatcaccagcgactatgtcgtattgggtaaagctccctcttcggagggagcatcaaag

SEQ ID NO: 2246 - RNA, 98 nt, synthetic construct
  misc_feature 1..98: note = gNA Variant Scaffold
  source 1..98: mol_type = other RNA
actggcgcttttatctgattactttgagagccatcaccagcgactatgtcgtattgggtaaagcgcttacggacttcggtccgtaagaagcatcaaag

SEQ ID NO: 2247 - RNA, 98 nt, synthetic construct
  misc_feature 1..98: note = gNA Variant Scaffold
  source 1..98: mol_type = other RNA
actggcgcctttatcatcattactttgagagccatcaccagcgactatgtcgtatgggtaaagcgcttacggacttcggtccgtaagaagcatcaaag

SEQ ID NO: 2248 - RNA, 90 nt, synthetic construct
  misc_feature 1..90: note = gNA Variant Scaffold
  source 1..90: mol_type = other RNA
actggcgcttttatctgattactttgagagccatcaccagcgactatgtcgtagtgggtaaagcgccctcttcggagggaagcatcaaag

SEQ ID NO: 2249 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacatgaggatcacccatgtgagcatcaaag

SEQ ID NO: 2250 - RNA, 89 nt, synthetic construct
  misc_feature 1..89: note = gNA Variant Scaffold
  source 1..89: mol_type = other RNA
actggcacttttacctgattactttgagagccaacaccagcgactatgtcgtagtgggtaaagctccctcttcggagggagcatcaaag

SEQ ID NO: 2251 - RNA, 89 nt, synthetic construct
  misc_feature 1..89: note = gNA Variant Scaffold
  source 1..89: mol_type = other RNA
actggcacttttatctgattactttgagagccatcaccagcgactatgtcgtagtgggtaaagctccctcttcggagggagcatcaaag

SEQ ID NO: 2252 - RNA, 89 nt, synthetic construct
  misc_feature 1..89: note = gNA Variant Scaffold
  source 1..89: mol_type = other RNA
actggcccttttatctgattactttgagagccatcaccagcgactatgtcgtagtgggtaaagctccctcttcggagggagcatcaaag

SEQ ID NO: 2253 - RNA, 89 nt, synthetic construct
  misc_feature 1..89: note = gNA Variant Scaffold
  source 1..89: mol_type = other RNA
actggcgcttttacctgattactttgagagccatcaccagcgactatgtcgtagtgggtaaagctccctcttcggagggagcatcaaag

SEQ ID NO: 2254 - RNA, 89 nt, synthetic construct
  misc_feature 1..89: note = gNA Variant Scaffold
  source 1..89: mol_type = other RNA
actggcgcttttatctgattactttgagagccaacaccagcgactatgtcgtagtgggtaaagctccctcttcggagggagcatcaaag

SEQ ID NO: 2255 - RNA, 97 nt, synthetic construct
  misc_feature 1..97: note = gNA Variant Scaffold
  source 1..97: mol_type = other RNA
actggcacctttacctgattactttgagagccaacaccagcgactatgtcgtatgggtaaagcgcttacggacttcggtccgtaagaagcatcaaag

SEQ ID NO: 2256 - RNA, 97 nt, synthetic construct
  misc_feature 1..97: note = gNA Variant Scaffold
  source 1..97: mol_type = other RNA
actggcacctttatctgattactttgagagccatcaccagcgactatgtcgtatgggtaaagcgcttacggacttcggtccgtaagaagcatcaaag

SEQ ID NO: 2257 - RNA, 97 nt, synthetic construct
  misc_feature 1..97: note = gNA Variant Scaffold
  source 1..97: mol_type = other RNA
actggcccctttatctgattactttgagagccatcaccagcgactatgtcgtatgggtaaagcgcttacggacttcggtccgtaagaagcatcaaag

SEQ ID NO: 2258 - RNA, 97 nt, synthetic construct
  misc_feature 1..97: note = gNA Variant Scaffold
  source 1..97: mol_type = other RNA
actggcgcctttatctgattactttgagagccaacaccagcgactatgtcgtatgggtaaagcgcttacggacttcggtccgtaagaagcatcaaag

SEQ ID NO: 2259 - RNA, 151 nt, synthetic construct
  misc_feature 1..151: note = gNA Variant Scaffold
  source 1..151: mol_type = other RNA
actggcgcttttatctgattactttgagagccatcaccagcgactatgtcgtagtgggtaaataggagctgcactatgggcgcagtgtcattgacgctgacggtacaggccagacaattattgtctggtatagtgcagctcctaatcaaag

SEQ ID NO: 2260 - RNA, 90 nt, synthetic construct
  misc_feature 1..90: note = gNA Variant Scaffold
  source 1..90: mol_type = other RNA
gactggcgcttttatctgattactttgagagccatcaccagcgactatgtcgtagtgggtaaagctccctcttcggagggagcatcaaag

SEQ ID NO: 2261 - RNA, 90 nt, synthetic construct
  misc_feature 1..90: note = gNA Variant Scaffold
  source 1..90: mol_type = other RNA
actggcgcctttatctgattactttggagagccatcaccagcgactatgtcgtagtgggtaaagctccctcttcggagggagcatcaaag

SEQ ID NO: 2262 - RNA, 89 nt, synthetic construct
  misc_feature 1..89: note = gNA Variant Scaffold
  source 1..89: mol_type = other RNA
actggcgcatttatctgattactttgtgagccatcaccagcgactatgtcgtagtgggtaaagctccctcttcggagggagcatcaaag

SEQ ID NO: 2263 - RNA, 89 nt, synthetic construct
  misc_feature 1..89: note = gNA Variant Scaffold
  source 1..89: mol_type = other RNA
actggcgcctttatctgattactttgagagccatcaccagcgactatgtcgtagtgggtaaagctccctcttcggagggagcatcaaag

SEQ ID NO: 2264 - RNA, 90 nt, synthetic construct
  misc_feature 1..90: note = gNA Variant Scaffold
  source 1..90: mol_type = other RNA
actggcgcttttatctgattactttggagagccatcaccagcgactatgtcgtagtgggtaaagctccctcttcggagggagcatcaaag

SEQ ID NO: 2265 - RNA, 89 nt, synthetic construct
  misc_feature 1..89: note = gNA Variant Scaffold
  source 1..89: mol_type = other RNA
actggcgcatttatctgattactttgagagccatcaccagcgactatgtcgtagtgggtaaagctccctcttcggagggagcatcaaag

SEQ ID NO: 2266 - RNA, 89 nt, synthetic construct
  misc_feature 1..89: note = gNA Variant Scaffold
  source 1..89: mol_type = other RNA
actggcgcttttatctgattactttgtgagccatcaccagcgactatgtcgtagtgggtaaagctccctcttcggagggagcatcaaag

SEQ ID NO: 2267 - RNA, 90 nt, synthetic construct
  misc_feature 1..90: note = gNA Variant Scaffold
  source 1..90: mol_type = other RNA
actggcgcttttattctgattactttgagagccatcaccagcgactatgtcgtagtgggtaaagctccctcttcggagggagcatcaaag

SEQ ID NO: 2268 - RNA, 88 nt, synthetic construct
  misc_feature 1..88: note = gNA Variant Scaffold
  source 1..88: mol_type = other RNA
acggcgcttttatctgattactttgagagccatcaccagcgactatgtcgtagtgggtaaagctccctcttcggagggagcatcaaag

SEQ ID NO: 2269 - RNA, 89 nt, synthetic construct
  misc_feature 1..89: note = gNA Variant Scaffold
  source 1..89: mol_type = other RNA
actggcgcttttatatgattactttgagagccatcaccagcgactatgtcgtagtgggtaaagctccctcttcggagggagcatcaaag

SEQ ID NO: 2270 - RNA, 90 nt, synthetic construct
  misc_feature 1..90: note = gNA Variant Scaffold
  source 1..90: mol_type = other RNA
actggcgcttttatcttgattactttgagagccatcaccagcgactatgtcgtagtgggtaaagctccctcttcggagggagcatcaaag

SEQ ID NO: 2271 - RNA, 89 nt, synthetic construct
  misc_feature 1..89: note = gNA Variant Scaffold
  source 1..89: mol_type = other RNA
actggcgcttttatctgattactttgagagccagcaccagcgactatgtcgtagtgggtaaagctccctcttcggagggagcatcaaag

SEQ ID NO: 2272 - RNA, 89 nt, synthetic construct
  misc_feature 1..89: note = gNA Variant Scaffold
  source 1..89: mol_type = other RNA
actggcgctgttatctgattacttcgagagccatcaccagcgactatgtcgtagtgggtaaagctccctcttcggagggagcatcgaag

SEQ ID NO: 2273 - RNA, 89 nt, synthetic construct
  misc_feature 1..89: note = gNA Variant Scaffold
  source 1..89: mol_type = other RNA
actggcgctcttatctgattacttcgagagccatcaccagcgactatgtcgtagtgggtaaagctccctcttcggagggagcatcgaag

SEQ ID NO: 2274 - RNA, 89 nt, synthetic construct
  misc_feature 1..89: note = gNA Variant Scaffold
  source 1..89: mol_type = other RNA
actggcgcttgtatctgattactctgagagccatcaccagcgactatgtcgtagtgggtaaagctccctcttcggagggagcatcagag

SEQ ID NO: 2275 - RNA, 89 nt, synthetic construct
  misc_feature 1..89: note = gNA Variant Scaffold
  source 1..89: mol_type = other RNA
actggcgcttctatctgattactctgagagccatcaccagcgactatgtcgtagtgggtaaagctccctcttcggagggagcatcagag

SEQ ID NO: 2276 - RNA, 89 nt, synthetic construct
  misc_feature 1..89: note = gNA Variant Scaffold
  source 1..89: mol_type = other RNA
actggcgctttgatctgattaccttgagagccatcaccagcgactatgtcgtagtgggtaaagctccctcttcggagggagcatcaagg

SEQ ID NO: 2277 - RNA, 89 nt, synthetic construct
  misc_feature 1..89: note = gNA Variant Scaffold
  source 1..89: mol_type = other RNA
actggcgctttcatctgattaccttgagagccatcaccagcgactatgtcgtagtgggtaaagctccctcttcggagggagcatcaagg

SEQ ID NO: 2278 - RNA, 89 nt, synthetic construct
  misc_feature 1..89: note = gNA Variant Scaffold
  source 1..89: mol_type = other RNA
actggcgctgttatctgattactttgagagccatcaccagcgactatgtcgtagtgggtaaagctccctcttcggagggagcatcaaag

SEQ ID NO: 2279 - RNA, 89 nt, synthetic construct
  misc_feature 1..89: note = gNA Variant Scaffold
  source 1..89: mol_type = other RNA
actggcgcttttatctgattactttgagagccatcaccagcgactatgtcgtagtgggtaaagctccctcttcggagggagcatcgaag

SEQ ID NO: 2280 - RNA, 89 nt, synthetic construct
  misc_feature 1..89: note = gNA Variant Scaffold
  source 1..89: mol_type = other RNA
actggcgcttttatctgattacttcgagagccatcaccagcgactatgtcgtagtgggtaaagctccctcttcggagggagcatcaaag

SEQ ID NO: 2281 - RNA, 98 nt, synthetic construct
  misc_feature 1..98: note = gNA Variant Scaffold
  source 1..98: mol_type = other RNA
actggcacttctatctgattactctgagagccatcaccagcgactatgtcgtatgggtaaagccgcttacggacttcggtccgtaagaggcatcagag

SEQ ID NO: 2282 - RNA, 89 nt, synthetic construct
  misc_feature 1..89: note = gNA Variant Scaffold
  source 1..89: mol_type = other RNA
actggcacttctatctgattactctgagagccatcaccagcgactatgtcgtagtgggtaaagctccctcttcggagggagcatcagag

SEQ ID NO: 2283 - RNA, 98 nt, synthetic construct
  misc_feature 1..98: note = gNA Variant Scaffold
  source 1..98: mol_type = other RNA
actggcacctttatctgattactttgagagccatcaccagcgactatgtcgtatgggtaaagccgcttacggacttcggtccgtaagaggcatcaaag

SEQ ID NO: 2284 - RNA, 98 nt, synthetic construct
  misc_feature 1..98: note = gNA Variant Scaffold
  source 1..98: mol_type = other RNA
actggcacttgtatctgattactctgagagccatcaccagcgactatgtcgtatgggtaaagccgcttacggacttcggtccgtaagaggcatcagag

SEQ ID NO: 2285 - RNA, 89 nt, synthetic construct
  misc_feature 1..89: note = gNA Variant Scaffold
  source 1..89: mol_type = other RNA
actggcacttgtatctgattactctgagagccatcaccagcgactatgtcgtagtgggtaaagctccctcttcggagggagcatcagag

SEQ ID NO: 2286 - RNA, 97 nt, synthetic construct
  misc_feature 1..97: note = gNA Variant Scaffold
  source 1..97: mol_type = other RNA
actggcacttttatctgattactttgagagccatcaccagcgactatgtcgtatgggtaaagcgcttacggacttcggtccgtaagaagcatcaaag

SEQ ID NO: 2287 - RNA, 97 nt, synthetic construct
  misc_feature 1..97: note = gNA Variant Scaffold
  source 1..97: mol_type = other RNA
actggcacttctatctgattactctgagagccatcaccagcgactatgtcgtatgggtaaagcgcttacggacttcggtccgtaagaagcatcagag

SEQ ID NO: 2288 - RNA, 98 nt, synthetic construct
  misc_feature 1..98: note = gNA Variant Scaffold
  source 1..98: mol_type = other RNA
actggcgcttctatctgattactctgagagccatcaccagcgactatgtcgtatgggtaaagccgcttacggacttcggtccgtaagaggcatcagag

SEQ ID NO: 2289 - RNA, 98 nt, synthetic construct
  misc_feature 1..98: note = gNA Variant Scaffold
  source 1..98: mol_type = other RNA
actggcacttctatctgattactctgagcgccatcaccagcgactatgtcgtatgggtaaagccgcttacggacttcggtccgtaagaggcatcagag

SEQ ID NO: 2290 - RNA, 98 nt, synthetic construct
  misc_feature 1..98: note = gNA Variant Scaffold
  source 1..98: mol_type = other RNA
actggcgcttctatctgattactctgagcgccatcaccagcgactatgtcgtatgggtaaagccgcttacggacttcggtccgtaagaggcatcagag

SEQ ID NO: 2291 - RNA, 98 nt, synthetic construct
  misc_feature 1..98: note = gNA Variant Scaffold
  source 1..98: mol_type = other RNA
actggcgcttctatctgattactctgagcgccatcaccagcgactatgtcgtatgggtaaagcgccttacggacttcggtccgtaaggagcatcagag

SEQ ID NO: 2292 - RNA, 99 nt, synthetic construct
  misc_feature 1..99: note = gNA Variant Scaffold
  source 1..99: mol_type = other RNA
actggcgcttctatctgattactctgagcgccatcaccagcgactatgtcgtagtgggtaaagccgcttacggacttcggtccgtaagaggcatcagag

SEQ ID NO: 2293 - RNA, 98 nt, synthetic construct
  misc_feature 1..98: note = gNA Variant Scaffold
  source 1..98: mol_type = other RNA
acgggactttctatctgattactctgaagtccctcaccagcgactatgtcgtatgggtaaagccgcttacggacttcggtccgtaagaggcatcagag

SEQ ID NO: 2294 - RNA, 98 nt, synthetic construct
  misc_feature 1..98: note = gNA Variant Scaffold
  source 1..98: mol_type = other RNA
acctgtagttctatctgattactctgactacagtcaccagcgactatgtcgtatgggtaaagccgcttacggacttcggtccgtaagaggcatcagag

SEQ ID NO: 2295 - RNA, 113 nt, synthetic construct
  misc_feature 1..113: note = gNA Variant Scaffold
  source 1..113: mol_type = other RNA
actggcgcttttatctgattactttgagagccatcaccagcgactatgtcgtagtgggtaaagctgcacggtgggcgcagcttcggctgacggtacaccgtgcagcatcaaag

SEQ ID NO: 2296 - RNA, 143 nt, synthetic construct
  misc_feature 1..143: note = gNA Variant Scaffold
  source 1..143: mol_type = other RNA
actggcgcttttatctgattactttgagagccatcaccagcgactatgtcgtagtgggtaaagctgcacggtgggcgcagcttcggctgacggtacaccggtgggcgcagcttcggctgacggtacaccgtgcagcatcaaag

SEQ ID NO: 2297 - RNA, 173 nt, synthetic construct
  misc_feature 1..173: note = gNA Variant Scaffold
  source 1..173: mol_type = other RNA
actggcgcttttatctgattactttgagagccatcaccagcgactatgtcgtagtgggtaaagctgcacggtgggcgcagcttcggctgacggtacaccggtgggcgcagcttcggctgacggtacaccggtgggcgcagcttcggctgacggtacaccgtgcagcatcaaag

SEQ ID NO: 2298 - RNA, 203 nt, synthetic construct
  misc_feature 1..203: note = gNA Variant Scaffold
  source 1..203: mol_type = other RNA
actggcgcttttatctgattactttgagagccatcaccagcgactatgtcgtagtgggtaaagctgcacggtgggcgcagcttcggctgacggtacaccggtgggcgcagcttcggctgacggtacaccggtgggcgcagcttcggctgacggtacaccggtgggcgcagcttcggctgacggtacaccgtgcagcatcaaag

SEQ ID NO: 2299 - RNA, 233 nt, synthetic construct
  misc_feature 1..233: note = gNA Variant Scaffold
  source 1..233: mol_type = other RNA
actggcgcttttatctgattactttgagagccatcaccagcgactatgtcgtagtgggtaaagctgcacggtgggcgcagcttcggctgacggtacaccggtgggcgcagcttcggctgacggtacaccggtgggcgcagcttcggctgacggtacaccggtgggcgcagcttcggctgacggtacaccggtgggcgcagcttcggctgacggtacaccgtgcagcatcaaag

SEQ ID NO: 2300 - RNA, 97 nt, synthetic construct
  misc_feature 1..97: note = gNA Variant Scaffold
  source 1..97: mol_type = other RNA
actggcgcttttatctgattactttgagagccatcaccagcgactatgtcgtagtgggtaaagctgcacctagcggaggctaggtgcagcatcaaag

SEQ ID NO: 2301 - RNA, 118 nt, synthetic construct
  misc_feature 1..118: note = gNA Variant Scaffold
  source 1..118: mol_type = other RNA
actggcgcttttatctgattactttgagagccatcaccagcgactatgtcgtagtgggtaaagctgcacctcggcttgctgaagcgcgcacggcaagaggcgaggtgcagcatcaaag

SEQ ID NO: 2302 - RNA, 192 nt, synthetic construct
  misc_feature 1..192: note = gNA Variant Scaffold
  source 1..192: mol_type = other RNA
actggcgcttttatctgattactttgagagccatcaccagcgactatgtcgtagtgggtaaagctgcacctctctcgacgcaggactcggcttgctgaagcgcgcacggcaagaggcgaggggcggcgactggtgagtacgccaaaaattttgactagcggaggctagaaggagagaggtgcagcatcaaag

SEQ ID NO: 2303 - RNA, 156 nt, synthetic construct
  misc_feature 1..156: note = gNA Variant Scaffold
  source 1..156: mol_type = other RNA
actggcgcttttatctgattactttgagagccatcaccagcgactatgtcgtagtgggtaaagctgcacggtgcccgtctgttgtgtcgagagacgccaaaaattttgactagcggaggctagaaggagagagatgggtgccgtgcagcatcaaag

SEQ ID NO: 2304 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctgcacatggagaggagatgtgcagcatcaaag

SEQ ID NO: 2305 - RNA, 91 nt, synthetic construct
  misc_feature 1..91: note = gNA Variant Scaffold
  source 1..91: mol_type = other RNA
actggcgcttttatctgattactttgagagccatcaccagcgactatgtcgtagtgggtaaagctgcacatggagatgtgcagcatcaaag

SEQ ID NO: 2306 - RNA, 106 nt, synthetic construct
  misc_feature 1..106: note = gNA Variant Scaffold
  source 1..106: mol_type = other RNA
actggcgcttttatctgattactttgagagccatcaccagcgactatgtcgtagtgggtaaagcttgggcgcagcgtcaatgacgctgacggtacaagcatcaaag

SEQ ID NO: 2307 - RNA, 145 nt, synthetic construct
  misc_feature 1..145: note = gNA Variant Scaffold
  source 1..145: mol_type = other RNA
actggcgcttttatctgattactttgagagccatcaccagcgactatgtcgtagtgggtaaagctgcactatgggcgcagcgtcaatgacgctgacggtacaggccacatgaggatcacccatgtggtatagtgcagcatcaaag

SEQ ID NO: 2308 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagctcatgaggatcacccatgagctgacggtacaggccacatgaggatcacccatgtggtatagtgcagcatcaaag

SEQ ID NO: 2309 - RNA, 151 nt, synthetic construct
  misc_feature 1..151: note = gNA Variant Scaffold
  source 1..151: mol_type = other RNA
actggcgcttttatctgattactttgagagccatcaccagcgactatgtcgtagtgggtaaagctgcactatgggcgcagcgtcaatgacgctgacggtacaggccacatggcagtcgtaacgacgcgggtggtatagtgcagcatcaaag

SEQ ID NO: 2310 - RNA, 172 nt, synthetic construct
  misc_feature 1..172: note = gNA Variant Scaffold
  source 1..172: mol_type = other RNA
actggcgcttttatctgattactttgagagccatcaccagcgactatgtcgtagtgggtaaagctgcactatgggcgcagcaaacatggcagtcctaaggacgcgggttttgctgacggtacaggccacatggcagtcgtaacgacgcgggtggtatagtgcagcatcaaag

SEQ ID NO: 2311 - RNA, 159 nt, synthetic construct
  misc_feature 1..159: note = gNA Variant Scaffold
  source 1..159: mol_type = other RNA
actggcgcttttatctgattactttgagagccatcaccagcgactatgtcgtagtgggtaaagctgcactatgggcgcagacatggcagtcgtaacgacgcgggtctgacggtacaggccacatgaggatcacccatgtggtatagtgcagcatcaaag

SEQ ID NO: 2312 - RNA, 108 nt, synthetic construct
  misc_feature 1..108: note = gNA Variant Scaffold
  source 1..108: mol_type = other RNA
actggcgcttttatctgattactttgagagccatcaccagcgactatgtcgtagtgggtaaagctgcactaaggagtttatatggaaacccttagtgcagcatcaaag

SEQ ID NO: 2313 - RNA, 242 nt, synthetic construct
  misc_feature 1..242: note = gNA Variant Scaffold
  source 1..242: mol_type = other RNA
actggcgcttttatctgattactttgagagccatcaccagcgactatgtcgtagtgggtaaagctcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctgagcatcaaag

SEQ ID NO: 2314 - RNA, 98 nt, synthetic construct
  misc_feature 1..98: note = gNA Variant Scaffold
  source 1..98: mol_type = other RNA
actggcgcttttatctgattactttgagagccatcaccagcgactatgtcgtagtgggtaaagctgcacgccctgaagaagggcgtgcagcatcaaag

SEQ ID NO: 2315 - RNA, 111 nt, synthetic construct
  misc_feature 1..111: note = gNA Variant Scaffold
  source 1..111: mol_type = other RNA
actggcgcttttatctgattactttgagagccatcaccagcgactatgtcgtagtgggtaaagctgcacggctcgtgtagctcattagctccgagccgtgcagcatcaaag

SEQ ID NO: 2316 - RNA, 113 nt, synthetic construct
  misc_feature 1..113: note = gNA Variant Scaffold
  source 1..113: mol_type = other RNA
actggcgcttttatctgattactttgagagccatcaccagcgactatgtcgtagtgggtaaagctgcacccgtgtgcatccgcagtgtcggatccacgggtgcagcatcaaag

SEQ ID NO: 2317 - RNA, 112 nt, synthetic construct
  misc_feature 1..112: note = gNA Variant Scaffold
  source 1..112: mol_type = other RNA
actggcgcttttatctgattactttgagagccatcaccagcgactatgtcgtagtgggtaaagctgcacggaatccattgcactccggatttcactaggtgcagcatcaaag

SEQ ID NO: 2318 - RNA, 103 nt, synthetic construct
  misc_feature 1..103: note = gNA Variant Scaffold
  source 1..103: mol_type = other RNA
actggcgcttttatctgattactttgagagccatcaccagcgactatgtcgtagtgggtaaagctgcacatgcatgtctaagacagcatgtgcagcatcaaag

SEQ ID NO: 2319 - RNA, 106 nt, synthetic construct
  misc_feature 1..106: note = gNA Variant Scaffold
  source 1..106: mol_type = other RNA
actggcgcttttatctgattactttgagagccatcaccagcgactatgtcgtagtgggtaaagctgcacaaaacataaggaaaacctatgttgtgcagcatcaaag

SEQ ID NO: 2320 - RNA, 153 nt, synthetic construct
  misc_feature 1..153: note = gNA Variant Scaffold
  source 1..153: mol_type = other RNA
actggcgcttctatctgattactctgagcgccatcaccagcgactatgtcgtagtgggtaaagccgcttacggactatgggcgcagcgtcaatgacgctgacggtacaggccagacaattattgtctggtatagtccgtaagaggcatcagag

SEQ ID NO: 2321 - RNA, 147 nt, synthetic construct
  misc_feature 1..147: note = gNA Variant Scaffold
  source 1..147: mol_type = other RNA
actggcgcttctatctgattactctgagcgccatcaccagcgactatgtcgtagtgggtaaagccgcttacgggtgggcgcagcgtcaatgacgctgacggtacaggccagacaattattgtctggtacccgtaagaggcatcagag

SEQ ID NO: 2322 - RNA, 157 nt, synthetic construct
  misc_feature 1..157: note = gNA Variant Scaffold
  source 1..157: mol_type = other RNA
actggcgcttctatctgattactctgagcgccatcaccagcgactatgtcgtagtgggtaaagccgcttacggactatgggcgcagcgtcaatgacgctgacggtacaggccacatgaggatcacccatgtggtatagtccgtaagaggcatcagag

SEQ ID NO: 2323 - RNA, 143 nt, synthetic construct
  misc_feature 1..143: note = gNA Variant Scaffold
  source 1..143: mol_type = other RNA
actggcgcttttatctgattactttgagagccatcaccagcgactatgtcgtagtgggtaaagctccctatgggcgcagcgtcaatgacgctgacggtacaggccacatgaggatcacccatgtggtatagggagcatcaaag

SEQ ID NO: 2324 - RNA, 167 nt, synthetic construct
  misc_feature 1..167: note = gNA Variant Scaffold
  source 1..167: mol_type = other RNA
actggcgcttctatctgattactctgagcgccatcaccagcgactatgtcgtagtgggtaaagccgcttacggactatgggcgcagctcatgaggatcacccatgagctgacggtacaggccacatgaggatcacccatgtggtatagtccgtaagaggcatcagag

SEQ ID NO: 2325 - RNA, 153 nt, synthetic construct
  misc_feature 1..153: note = gNA Variant Scaffold
  source 1..153: mol_type = other RNA
actggcgcttttatctgattactttgagagccatcaccagcgactatgtcgtagtgggtaaagctccctatgggcgcagctcatgaggatcacccatgagctgacggtacaggccacatgaggatcacccatgtggtatagggagcatcaaag

SEQ ID NO: 2326 - RNA, 163 nt, synthetic construct
  misc_feature 1..163: note = gNA Variant Scaffold
  source 1..163: mol_type = other RNA
actggcgcttctatctgattactctgagcgccatcaccagcgactatgtcgtagtgggtaaagccgcttacggactatgggcgcagcgtcaatgacgctgacggtacaggccacatggcagtcgtaacgacgcgggtggtatagtccgtaagaggcatcagag

SEQ ID NO: 2327 - RNA, 149 nt, synthetic construct
  misc_feature 1..149: note = gNA Variant Scaffold
  source 1..149: mol_type = other RNA
actggcgcttttatctgattactttgagagccatcaccagcgactatgtcgtagtgggtaaagctccctatgggcgcagcgtcaatgacgctgacggtacaggccacatggcagtcgtaacgacgcgggtggtatagggagcatcaaag

SEQ ID NO: 2328 - RNA, 184 nt, synthetic construct
  misc_feature 1..184: note = gNA Variant Scaffold
  source 1..184: mol_type = other RNA
actggcgcttctatctgattactctgagcgccatcaccagcgactatgtcgtagtgggtaaagccgcttacggactatgggcgcagcaaacatggcagtcctaaggacgcgggttttgctgacggtacaggccacatggcagtcgtaacgacgcgggtggtatagtccgtaagaggcatcagag

SEQ ID NO: 2329 - RNA, 170 nt, synthetic construct
  misc_feature 1..170: note = gNA Variant Scaffold
  source 1..170: mol_type = other RNA
actggcgcttttatctgattactttgagagccatcaccagcgactatgtcgtagtgggtaaagctccctatgggcgcagcaaacatggcagtcctaaggacgcgggttttgctgacggtacaggccacatggcagtcgtaacgacgcgggtggtatagggagcatcaaag

SEQ ID NO: 2330 - RNA, 171 nt, synthetic construct
  misc_feature 1..171: note = gNA Variant Scaffold
  source 1..171: mol_type = other RNA
actggcgcttctatctgattactctgagcgccatcaccagcgactatgtcgtagtgggtaaagccgcttacggactatgggcgcagacatggcagtcgtaacgacgcgggtctgacggtacaggccacatgaggatcacccatgtggtatagtccgtaagaggcatcagag

SEQ ID NO: 2331 - RNA, 157 nt, synthetic construct
  misc_feature 1..157: note = gNA Variant Scaffold
  source 1..157: mol_type = other RNA
actggcgcttttatctgattactttgagagccatcaccagcgactatgtcgtagtgggtaaagctccctatgggcgcagacatggcagtcgtaacgacgcgggtctgacggtacaggccacatgaggatcacccatgtggtatagggagcatcaaag

SEQ ID NO: 2332 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacctgaggatcacccaggtgctgacggtacaggccacctgaggatcacccaggtggtatagtgcagcatcaaag

SEQ ID NO: 2333 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcgcatgaggatcacccatgcgctgacggtacaggccgcatgaggatcacccatgcggtatagtgcagcatcaaag

SEQ ID NO: 2334 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcgcctgaggatcacccaggcgctgacggtacaggccgcctgaggatcacccaggcggtatagtgcagcatcaaag

SEQ ID NO: 2335 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcgcctgagcatcagccaggcgctgacggtacaggccgcctgagcatcagccaggcggtatagtgcagcatcaaag

SEQ ID NO: 2336 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacatgagcatcagccatgtgctgacggtacaggccacatgagcatcagccatgtggtatagtgcagcatcaaag

SEQ ID NO: 2337 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacatgagtatcaaccatgtgctgacggtacaggccacatgagtatcaaccatgtggtatagtgcagcatcaaag

SEQ ID NO: 2338 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacatgagaatcagccatgtgctgacggtacaggccacatgagaatcagccatgtggtatagtgcagcatcaaag

SEQ ID NO: 2339 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcccttgaggatcacccatgtgctgacggtacaggccccttgaggatcacccatgtggtatagtgcagcatcaaag

SEQ ID NO: 2340 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacttgaggatcacccatgtgctgacggtacaggccacttgaggatcacccatgtggtatagtgcagcatcaaag

SEQ ID NO: 2341 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacctgaggatcacccatgtgctgacggtacaggccacctgaggatcacccatgtggtatagtgcagcatcaaag

SEQ ID NO: 2342 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacatgaggatcacctatgtgctgacggtacaggccacatgaggatcacctatgtggtatagtgcagcatcaaag

SEQ ID NO: 2343 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacattaggatcaccaatgtgctgacggtacaggccacattaggatcaccaatgtggtatagtgcagcatcaaag

SEQ ID NO: 2344 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacattaggatcaccgatgtgctgacggtacaggccacattaggatcaccgatgtggtatagtgcagcatcaaag

SEQ ID NO: 2345 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacattaggatcacctatgtgctgacggtacaggccacattaggatcacctatgtggtatagtgcagcatcaaag

SEQ ID NO: 2346 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacatgaggattacccatgtgctgacggtacaggccacatgaggattacccatgtggtatagtgcagcatcaaag

SEQ ID NO: 2347 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacatgaggataacccatgtgctgacggtacaggccacatgaggataacccatgtggtatagtgcagcatcaaag

SEQ ID NO: 2348 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacatgaggatgacccatgtgctgacggtacaggccacatgaggatgacccatgtggtatagtgcagcatcaaag

SEQ ID NO: 2349 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacatgaggaccacccatgtgctgacggtacaggccacatgaggaccacccatgtggtatagtgcagcatcaaag

SEQ ID NO: 2350 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcagatgaggatcacccatgggctgacggtacaggccagatgaggatcacccatggggtatagtgcagcatcaaag

SEQ ID NO: 2351 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacatggggatcacccatgtgctgacggtacaggccacatggggatcacccatgtggtatagtgcagcatcaaag

SEQ ID NO: 2352 - RNA, 155 nt, synthetic construct
  misc_feature 1..155: note = gNA Variant Scaffold
  source 1..155: mol_type = other RNA
actggcgcttttatctgattactttgagagccatcaccagcgactatgtcgtagtgggtaaagctgcactatgggcgcagcacatgaggatcacccatgtgctgacggtacaggccacatgaggatcacccatgtggtatagtgcagcatcaaag

SEQ ID NO: 2353 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacctgaggatcacccaggtgagcatcaaag

SEQ ID NO: 2354 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcgcatgaggatcacccatgcgagcatcaaag

SEQ ID NO: 2355 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcgcctgaggatcacccaggcgagcatcaaag

SEQ ID NO: 2356 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcgcctgagcatcagccaggcgagcatcaaag

SEQ ID NO: 2357 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacatgagcatcagccatgtgagcatcaaag

SEQ ID NO: 2358 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacatgagtatcaaccatgtgagcatcaaag

SEQ ID NO: 2359 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacatgagaatcagccatgtgagcatcaaag

SEQ ID NO: 2360 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcccttgaggatcacccatgtgagcatcaaag

SEQ ID NO: 2361 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacttgaggatcacccatgtgagcatcaaag

SEQ ID NO: 2362 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacctgaggatcacccatgtgagcatcaaag

SEQ ID NO: 2363 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacatgaggatcacctatgtgagcatcaaag

SEQ ID NO: 2364 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacattaggatcaccaatgtgagcatcaaag

SEQ ID NO: 2365 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacattaggatcaccgatgtgagcatcaaag

SEQ ID NO: 2366 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacattaggatcacctatgtgagcatcaaag

SEQ ID NO: 2367 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacatgaggattacccatgtgagcatcaaag

SEQ ID NO: 2368 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacatgaggataacccatgtgagcatcaaag

SEQ ID NO: 2369 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacatgaggatgacccatgtgagcatcaaag

SEQ ID NO: 2370 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacatgaggaccacccatgtgagcatcaaag

SEQ ID NO: 2371 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcagatgaggatcacccatgggagcatcaaag

SEQ ID NO: 2372 - RNA, 96 nt, synthetic construct
  misc_feature 1..96: note = gNA Variant Scaffold
  source 1..96: mol_type = other RNA
actggcgcttttatctgattactttgagagccatcaccagcgactatgtcgtagtgggtaaagctcacatggggatcacccatgtgagcatcaaag

SEQ ID NO: 2373 - RNA, 309 nt, synthetic construct
  misc_feature 1..309: note = gNA Variant Scaffold
  source 1..309: mol_type = other RNA
actggcgcttttatctgattactttgagagccatcaccagcgactatgtcgtagtgggtaaagctaggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctagcatcaaag

SEQ ID NO: 2374 - RNA, 100 nt, synthetic construct
  misc_feature 1..100: note = gNA Variant Scaffold
  source 1..100: mol_type = other RNA
actggcgcttttatctgattactttgagagccatcaccagcgactatgtcgtagtgggtaaagctccccgtacaccatcagggtacggggagcatcaaag

SEQ ID NO: 2375 - RNA, 99 nt, synthetic construct
  misc_feature 1..99: note = gNA Variant Scaffold
  source 1..99: mol_type = other RNA
actgggccttctatctgattactctgaggcccatcaccagcgactatgtcgtagtgggtaaagcctcttagggacttcggtccctaagaggcatcagag

SEQ ID NO: 2376 - RNA, 99 nt, synthetic construct
  misc_feature 1..99: note = gNA Variant Scaffold
  source 1..99: mol_type = other RNA
actgggccttctatctgattactctgaggcccatcaccagcgactatgtcgtagtgggtaaagccgcttagggacttcggtccctaagaggcatcagag

SEQ ID NO: 2377 - RNA, 97 nt, synthetic construct
  misc_feature 1..97: note = gNA Variant Scaffold
  source 1..97: mol_type = other RNA
actgggccttctatctgattactctgaggcccatcaccagcgactatgtcgtagtgggtaaagcccttagggacttcggtccctaagggcatcagag

SEQ ID NO: 2378 - RNA, 15 nt, synthetic construct
  misc_feature 1..15: note = stem loop
  source 1..15: mol_type = other RNA
gctgacggtacaggc

SEQ ID NO: 2379 - DNA, 13 bp, synthetic construct
  misc_feature 1..13: note = scaffold insert
  source 1..13: mol_type = other DNA
atggagaggagat

SEQ ID NO: 2380 - RNA, 141 nt, synthetic construct
  misc_feature 1..141: note = gNA Variant Scaffold
  source 1..141: mol_type = other RNA
actggcgcttttatctgattactttgagagccatcaccagcgactatgtcgtagtgggtaaagctgcactatgggcgcagcgtcaatgacgctgacggtacaggccagacaattattgtctggtatagtgcagcatcaaag

SEQ ID NO: 2381 - protein, 81 aa, Homo sapiens
GPLEHLCCDLEEEPQSLQEKAQSAPWVPAIPQEGNTGDWEMAAALLAAGSQGLVTIKDVSLCFSQEEWRSLDPSQTDFYGE

SEQ ID NO: 2382 - protein, 81 aa, Homo sapiens
MLENYGHLVSLGLSISKPDVVSLLEQGKEPWLGKREVKRDLFSVSESSGEIKDFSPKNVIYDDSSQYLIMERILSQGPVYS

SEQ ID NO: 2383 - protein, 81 aa, Homo sapiens
MDVFVDFTWEEWQLLDPAQKCLYRSVMLENYSNLVSLGYQHTKPDIIFKLEQGEELCMVQAQVPNQTCPNTVWKIDDLMDW

SEQ ID NO: 2384 - protein, 81 aa, Homo sapiens
MLENYRNLVSLGLVVSKPDLITFLEQRKEPWNVKSEETVAIQPDVFSHYNKDLLTEHCTEASFQKVISRRHGSCDLENLHL

SEQ ID NO: 2385 - protein, 81 aa, Homo sapiens
MGLLTFRDVAIEFSREEWEHLDSDQKLLYGDVMLENYGNLVSLGLAVSKPDLITFLEQRKEPWNVKSAETVAIQPDIFSHD

SEQ ID NO: 2386 - protein, 81 aa, Homo sapiens
MDTVVFEDVVVDFTLEEWALLNPAQRKLYRDVMLETFKHLASVDNEAQLKASGSISQQDTSGEKLSLKQKIEKFTRKNIWA

SEQ ID NO: 2387 - protein, 81 aa, Homo sapiens
MDSVVFEDVAVDFTLEEWALLDSAQRDLYRDVMLETFRNLASVDDGTQFKANGSVSLQDMYGQEKSKEQTIPNFTGNNSCA

SEQ ID NO: 2388 - protein, 80 aa, Homo sapiens
MDSVVFEDVAVNFTQEEWALLGPSQKKLYRDVMQETFVNLASIGENWEEKNIEDHKNQGRKLRDGVLPCCPDWSQTPELK

SEQ ID NO: 2389 - protein, 81 aa, Homo sapiens
MDSVVFEDVAVNFTQEEWALLGPSQKKLYRDVMQETFVNLASIGENWEEKNIEDHKNQGRKLRSHMVERLCERKEGSQFGE

SEQ ID NO: 2390 - protein, 81 aa, Homo sapiens
MGPLQFRDVAIEFSLEEWHCLDTAQRNLYRDVMLENYRNLVFLGIVVSKPDLVTCLEQGKKPLTMERHEMIAKPPVMSSHF

SEQ ID NO: 2391 - protein, 81 aa, Homo sapiens
MGPLQFRDVAIEFSLEEWHCLDTAQRNLYRNVMLENYSNLVFLGIVVSKPDLIAHLEQGKKPLTMKRHEMVANPSVICSHF

SEQ ID NO: 2392 - protein, 81 aa, Homo sapiens
MGPLTFTDVAIEFSLEEWQCLDTAQQNLYRNVMLENYRNLVFLGIAVSKPDLITCLEKEKEPCKMKRHEMVDEPPVVCSHF

SEQ ID NO: 2393 - protein, 81 aa, Homo sapiens
MGPLTIRDVTVEFSLEEWHCLDTAQQNLYRDVMLENYRNLVFLGIAVSKPDLITCLEQGKEPCNMKRHEMVAKPPVMCSHI

SEQ ID NO: 2394 - protein, 81 aa, Homo sapiens
MGPLTFMDVAIEFSVEEWQCLDTAQQNLYRNVMLENYRNLVFLGIAVSKPDLITCLEQGKEPWNMERHEMVAKPPGMCCYF

SEQ ID NO: 2395 - protein, 81 aa, Homo sapiens
MGLLTFRDVAIEFSLEEWQCLDTAQRNLYKNVILENYRNLVFLGIAVSKQDLITCLEQEKEPLTVKRHEMVNEPPVMCSHF

SEQ ID NO: 2396 - protein, 81 aa, Homo sapiens
MEPLKFRDVAIEFSLEEWQCLDTIQQNLYRNVMLENYRNLVFLGIVVSKPDLITCLEQEKEPWTRKRHRMVAEPPVICSHF

SEQ ID NO: 2397 - protein, 81 aa, Homo sapiens
MGLLTFRDVAIEFSLEEWQCLDTAQKNLYRNVMLENYRNLAFLGIAVSKPDLIICLEKEKEPWNMKRDEMVDEPPGICPHF

SEQ ID NO: 2398 - protein, 81 aa, Homo sapiens
MLENYRNLAFLGIAVSKPDLITCLEQGKEPWNMKRHEMVDEPPGMCPHFAQDLWPEQGMEDSFQKAILRRYGKYGHENLQL

SEQ ID NO: 2399 - protein, 81 aa, Homo sapiens
MSQVTFSDVAIDFSHEEWACLDSAQRDLYKDVMVQNYENLVSVAGLSVTKPYVIMLLEDGKEPWMMEKKLSKDWESRWENK

SEQ ID NO: 2400 - protein, 81 aa, Homo sapiens
MSQVTFSDVAIDFSHEEWACLDSAQRDLYKDVMVQNYENLVSVAGLSVTKPYVIMLLEDGKEPWMMEKKLSKAYPFPLSHS

SEQ ID NO: 2401 - protein, 81 aa, Homo sapiens
MSQVTFSDVAIDFSHEEWACLDSAQRDLYKDVMVQNYENLVSVGLSVTKPYVIMLLEDGKEPWMMEKKLSKAYPFPLSHSV

SEQ ID NO: 2402 - protein, 81 aa, Homo sapiens
PSQNYDLPQKKQEKMTKFQEAVTFKDVAVVFSREELRLLDLTQRKLYRDVMVENFKNLVAVGHLPFQPDMVSQLEAEEKLW

SEQ ID NO: 2403 - protein, 81 aa, Homo sapiens
MLENYSNLVSVGYQASKPDALFKLEQGEPWTVENEIHSQICPEIKKVDNHLQMHSQKQRCLKRVEQCHKHNAFGNIIHQRK

SEQ ID NO: 2404 - protein, 81 aa, Homo sapiens
RDPAQVPVAADLLTDHEEGYVTFEDVAVYFSQEEWRLLDDAQRLLYRNVMLENFTLLASLGKVLTPHPSILSWARLFLLFL

SEQ ID NO: 2405 - protein, 81 aa, Homo sapiens
MAAAALRAPTQDEWGLLDEAQRLLYLEVMLENFALVASLGCGHGTEDEETPSDQNVSVGVSQSKAGSSTQKTQSCEMCVPV

SEQ ID NO: 2406 - protein, 81 aa, Homo sapiens
MLENYRNLVSVEHQLSKPDVVSQLEEAEDFWPVERGIPQDTIPEYPELQLDPKLDPLPAESPLMNIEVVEVLTLNQEVAGP

SEQ ID NO: 2407 - protein, 81 aa, Homo sapiens
MAFEDVAVYFSQEEWGLLDTAQRALYRRVMLDNFALVASLGLSTSRPRVVIQLERGEEPWVPSGTDTTLSRTTYRRRNPGS

SEQ ID NO: 2408 - protein, 81 aa, Homo sapiens
TQNHKAKGLPSNDTDCPQKKEGKAQIVVPVTFRDVTVIFTEAEWKRLSPEQRNLYKEVMLENYRNLLSLDGGQEQQDAAAY

SEQ ID NO: 2409 - protein, 81 aa, Homo sapiens
KNGENVETMKKLTQNHKAKGLPSNDTDCPQKKEGKAQIVVPVTFRDVTVIFTEAEWKRLSPEQRNLYKEVMLENYRNLLSL

SEQ ID NO: 2410 - protein, 81 aa, Homo sapiens
MAFRDVAVDFTQDEWRLLSPAQRTLYREVMLENYSNLVSLGISFSKPELITQLEQGKETWREEKKCSPATCPADPEPELYL

SEQ ID NO: 2411 - protein, 81 aa, Homo sapiens
LAGQSDTPAAQMPALFPREGCPGDQVTPTRSLTAQLQETMTFKDVEVTFSQDEWGWLDSAQRNLYRDVMLENYRNMASLGK

SEQ ID NO: 2412 - protein, 81 aa, Homo sapiens
MGPLTFRDVKIEFSLEEWQCLDTAQRNLYRDVMLENYRNLVFLGIAVSKPDLITWLEQGKEPWNLKRHEMVDKTPVMCSHF

SEQ ID NO: 2413 - protein, 81 aa, Homo sapiens
MGVLTFRDVAVEFSPEEWECLDSAQQRLYRDVMLENYGNLVSLGLAIFKPDLMTCLEQRKEPWKVKRQEAVAKHPAGSFHF

SEQ ID NO: 2414 - protein, 81 aa, Homo sapiens
MRVLTFRDVAVEFSPEEWECLDSAQQRLYRDVMLENYGNLFSLGLAIFKPDLITYLEQRKEPWNARRQKTVAKHPAGSLHF

SEQ ID NO: 2415 - protein, 81 aa, Homo sapiens
MEVVTFGDVAVHFSREEWQCLDPGQRALYREVMLENHSSVAGLGFLVFKPELISRLEQGEEPWVLDLQGAEGTEAPRTSKT

SEQ ID NO: 2416 - protein, 81 aa, Homo sapiens
MGLLTFRDVAVEFSLEEWEHLEPAQKNLYQDVMLENYRNLVSLGLVVSKPDLITFLEQRKEPWNVKSEETVAIQPDVFSHY

SEQ ID NO: 2417 - protein, 81 aa, Homo sapiens
MGPLQFRDVAIEFSLEEWHCLDTAQRNLYRNVMLENYRNLVFLGIVVSKPDLITCLEQGKKPLTMKKHEMVANPSVTCSHF

SEQ ID NO: 2418 - protein, 81 aa, Homo sapiens
MASPSPPPESKEEWDYLDPAQRSLYKDVMMENYGNLVSLDVLNRDKDEKPTVKQEIEEIEEEVEPQGVIVTRIKSEIDQDP

SEQ ID NO: 2419 - protein, 81 aa, Homo sapiens
MDSVVFEDVAVDFTLEEWALLDSAQRDLYRDVMLETFRNLASVGCEMWERTNGSVSLQDMYGQEKSKEQTIPNFTGNNSCA

SEQ ID NO: 2420 - protein, 81 aa, Homo sapiens
MLENYRNLVFLGIALTKPDLITCLEQGKEPWNIKRHEMVAKPPVICSHFPQDLWAEQDIKDSFQEAILKKYGKYGHDNLQL

SEQ ID NO: 2421 - protein, 81 aa, Homo sapiens
MGALTFRDVAIEFSLEEWQCLDSTQQNLYRNVMLENYRNLVFLGIAAFKPDLIIFLEQGKEPWNMKRHEMVEEPPVICSHF

SEQ ID NO: 2422 - protein, 81 aa, Homo sapiens
MGPLTFTDVAIKFSLEEWQFLDTAQQNLYRDVMLENYRNLVFLGVGVSKPDLITCLEQGKEPWNMKRHKMVAKPPVVCSHF

SEQ ID NO: 2423 - protein, 81 aa, Homo sapiens
MGSLTFRDVAIQFSLEEWQCLDTAQQNLYRNVMLENYRNLVFLGIAAPKPDLIIFLEQGKEPWNMKRHELVKEPPVICSHF

SEQ ID NO: 2424 - protein, 81 aa, Homo sapiens
MGALTFRDVAIEFSLEEWQCLDTEQQNLYRNVMLDNYRNLVFLGIAVSKPDLITCLEQEKEPWNLKTHDMVAKPPVICSHI

SEQ ID NO: 2425 - protein, 81 aa, Homo sapiens
MTFEDVAVYFSQEEWGLLDTAQRALYRHVMLENFTLVTSLGLSTSRPRVVIQLERGEEPWVPSGKDMTLARNTYGRLNSGS

SEQ ID NO: 2426 - protein, 81 aa, Homo sapiens
MYFSQEEWELLDPTQKALYNDVMQENYETVISLALFVLPKPKVISCLEQGEEPWVQVSPEFKDSAGKSPTGLKLKNDTENH

SEQ ID NO: 2427 - protein, 81 aa, Homo sapiens
MDSVVFEDVAVDFTLEEWALLDSAQRDLYRDVMLETFQNLASVDDETQFKASGSVSQQDIYGEKIPKESKIATFTRNVSWA

SEQ ID NO: 2428 - protein, 81 aa, Homo sapiens
MELLTFKDVAIEFSPEEWKCLDTSQQNLYRDVMLENYRNLVSLGVSISNPDLVTSLEQRKEPYNLKIHETAARPPAVCSHF

SEQ ID NO: 2429 - protein, 81 aa, Homo sapiens
KEALMAFRDVAVAFTQKEWKLLSSAQRTLYREVMLENYSHLVSLGIAFSKPKLIEQLEQGDEPWREENEHLLDLCPEPRTE

SEQ ID NO: 2430 - protein, 81 aa, Homo sapiens
EQGLVTFEDVAVDFTQEEWQYLNPPQRTLYRDVMLETYSNLVFVGQQVTKPNLILKLEVEECPAEGKIPFWNFPEVCQVDE

SEQ ID NO: 2431 - protein, 81 aa, Homo sapiens
SGSVTFEDVAVYFSWEEWDLLDEAQKHLYFDVMLENFALTSSLGCWCGVEHEETPSEQRISGERVPQFRTSKEGSSSQNAD

SEQ ID NO: 2432 - protein, 81 aa, Homo sapiens
MLENYKNLATVGYQLFKPSLISWLEQEESRTVQRGDFQASEWKVQLKTKELALQQDVLGEPTSSGIQMIGSHNGGEVSDVK

SEQ ID NO: 2433 - protein, 81 aa, Homo sapiens
AQVSVTFEDVAVTFTQEEWGQLDAAQRTLYQEVMLETCGLLMSLGCPLFKPELIYQLDHRQELWMATKDLSQSSYPGDNTK

SEQ ID NO: 2434 - protein, 81 aa, Homo sapiens
PQGRLTFMDVAIEFSQEEWKSLDPGQRALYRDVMLENYRNLVFLGICLPDLSIISMLKQRREPLILQSQVKIVKNTDGREC

SEQ ID NO: 2435 - protein, 81 aa, Homo sapiens
DSVTFEDVAVDFTQEEWTLLDQTQRNLYRDVMLENYKNLVAVDWESHINTKWSAPQQNFLQGKTSSVVEMERNHFGEELFD

SEQ ID NO: 2436 - protein, 81 aa, Homo sapiens
YQDSVTFDDVAVDFTPEEWALLDTTEKYLYRDVMLENYMNLASVEWEIQPRTKRSSLQQGFLKNQIFSGIQMTRGYSGWKL

SEQ ID NO: 2437 - protein, 81 aa, Homo sapiens
ARGCVVFEDVFVYFSREEWELLDDAQRLLYHDVMLENFALLASLGIAFSRSRAVMKLERGEEPWVYDQVDMTSATEREAQR

SEQ ID NO: 2438 - protein, 81 aa, Homo sapiens
LQESFSFDDLSVDFTQKEWQLLDPSQKNLYKDVMLENYSSLVSLGYEVMKPDVIFKLEQGEEPWVGDGEIPSSDSPEVWKV

SEQ ID NO: 2439 - protein, 81 aa, Homo sapiens
MGSLTFRDVAIEFSLEEWQCLDTAQQNLYRNVMLENYRNLVFLGIAAFKPDLIIFLEEGKESWNMKRHEMVEESPVICSHF

SEQ ID NO: 2440 - protein, 81 aa, Homo sapiens
FQEAVTFKDVIVDFTQEEWKQLDPGQRDLFRDVTLENYTHLVSIGLQVSKPDVISQLEQGTEPWIMEPSIPVGTCADWETR

SEQ ID NO: 2441 - protein, 81 aa, Homo sapiens
FQEAVTFKDVAVAFTEEELGLLDSAQRKLYRDVMLENFRNLVSVGHQSFKPDMISQLEREEKLWMKELQTQRGKHSGDRNQ

SEQ ID NO: 2442 - protein, 81 aa, Homo sapiens
QGTVTFEDVAVNFSQEEWCLLSEAQRCLYRDVMLENLALISSLGCWCGSKDEEAPCKQRISVQRESQSRTPRAGVSPKKAH

SEQ ID NO: 2443 - protein, 81 aa, Homo sapiens
SQGLVTIKDVSLCFSQEEWRSLDPSQTDFYGEYVMQENCGIVVSLRFPIPKLDMLSQLEGGEEQWVPDPQDLEERDILRVT

SEQ ID NO: 2444 - protein, 81 aa, Homo sapiens
SQESVSFKDVTVGFTQEEWQHLDPSQRALYRDVMLENYSNLVSVGYCVHKPEVIFRLQQGEEPWKQEEEFPSQSFPVWTAD

SEQ ID NO: 2445 - protein, 81 aa, Homo sapiens
AQGCVTFEDVTIYFSQEEWVLLDEAQRLLYCDVMLENFALIASLGLISFRSHIVSQLEMGKEPWVPDSVDMTSAMARGAYG

SEQ ID NO: 2446 - protein, 81 aa, Homo sapiens
CQELVTFEDVAVYFSLEEWERLEADQRGLYQEVMQENYGILVSLGYPIPKPDLIFRLEQGEEPWVPDSPRPEEGDIVTGVY

SEQ ID NO: 2447 - protein, 81 aa, Homo sapiens
FQIPVSFQDLTVNFTQEEWQQLDPAQRLLYRDVMLENYSNLVSVGYHVSKPDVIFKLEQGEEPWIVEEFSNQNYPDIDDAL

SEQ ID NO: 2448 - protein, 81 aa, Homo sapiens
SLKKLTFEDVAIDFTQEEWAMMDTSKRKLYRDVMLENISHLVSLGYQISKSYIILQLEQGKELWREGRVFLQDQNPNRESA

SEQ ID NO: 2449 - protein, 81 aa, Homo sapiens
FQASVSFQDVTVEFSQEEWQHMGPVERTLYRDVMLENYSHLVSVGYCFTKPELIFTLEQGEDPWLLEKEKGFLSRNSPEDS

SEQ ID NO: 2450 - protein, 81 aa, Homo sapiens
EMGLLTFRDIAIEFSLAEWQCLDHAQQNLYRDVMLENYRNLFSLGMTVSKPDLIACLEQNKEPQNIKRNEMAAKHPVTCSH

SEQ ID NO: 2451 - protein, 81 aa, Homo sapiens
MDSVSFEDVAVNFTLEEWALLDSSQKKLYEDVMQETFKNLVCLGKKWEDQDIEDDHRNQGKNRRCHMVERLCESRRGSKCG

SEQ ID NO: 2452 - protein, 81 aa, Homo sapiens
ITAFVAFRDVAVYFTQEEWRLLSPAQRTLHREVMLETYNHLVSLEIPSSKPKLIAQLERGEAPWREERKCPLDLCPESKPE

SEQ ID NO: 2453 - protein, 81 aa, Homo sapiens
MAEEFVTLKDVGMDFTLGDWEQLGLEQGDTFWDTALDNCQDLFLLDPPRPNLTSHPDGSEDLEPLAGGSPEATSPDVTETK

SEQ ID NO: 2454 - protein, 81 aa, Homo sapiens
SLGSVTFTDVAIDFSQDEWEWLNLAQRSLYKKVMLENYRNLVSVGLCISKPDVISLLEQEKDPWVIKGGMNRGLCPDLECV

SEQ ID NO: 2455 - protein, 81 aa, Homo sapiens
EMESLQFRDVAVEFSLEEWHCLDTAQQNLYRDVMLENYRHLVFLGIIVSKPDLITCLEQGIKPLTMKRHEMIAKPPVVCSH

SEQ ID NO: 2456 - protein, 81 aa, Homo sapiens
QEMPLTFQDVAVYFSQAEGRQLGPQQRALYRDVMLENYGNVASLGFPVPKPELISQLEQGKELWVLNLLGAEEPDILKSCQ

SEQ ID NO: 2457 - protein, 81 aa, Homo sapiens
AQESITLEDVAVDFTWEEWQLLGAAQKDLYRDVMLENYSNLVAVGYQASKPDALFKLEQGEQLWTIEDGIHSGACSDIWKV

SEQ ID NO: 2458 - protein, 81 aa, Homo sapiens
DSVAFEDVAVNFTLEEWALLDPSQKNLYRDVMRETFRNLASVGKQWEDQNIEDPFKIPRRNISHIPERLCESKEGGQGEET

SEQ ID NO: 2459 - protein, 81 aa, Homo sapiens
QGRLTFRDVAIEFSLEEWKCLNPAQRALYRAVMLENYRNLEFVDSSLKSMMEFSSTRHSITGEVIHTGTLQRHKSHHIGDF

SEQ ID NO: 2460 - protein, 81 aa, Homo sapiens
VAFEDVAIYFSQEEWELLDEMQRLLYRDVMLENFAVMASLGCWCGAVDEGTPSAESVSVEELSQGRTPKADTSTDKSHPCE

SEQ ID NO: 2461 - protein, 81 aa, Homo sapiens
LKGLVTFEDVAVEFTQEEWALLDPAQRTLYRDVMLENCRNLASLGNQVDKPRLISQLEQEDKVMTEERGILSGTCPDVENP

SEQ ID NO: 2462 - protein, 81 aa, Homo sapiens
SQAPVTFEDMAMYLTREEWRPLDAAQRDLYRDVMQENYGNVVSLDFEIRSENEVNPKQEISEDVQFGTTSERPAENAEENP

SEQ ID NO: 2463 - protein, 81 aa, Homo sapiens
YQEMVTFEDVAVHFTKTEWTGLSPAQRALYRSVMLENFGNLTALGYPVPKPALISLLERGDMAWGLEAQDDPPAERTKNVC

SEQ ID NO: 2464 - protein, 81 aa, Homo sapiens
CQESVTFEDVAVVFTDEEWSRLVPIQRDLYKEVMLENYNSIVSLGLPVPQPDVIFQLKRGDKPWMVDLHGSEEREWPESVS

SEQ ID NO: 2465 - protein, 81 aa, Homo sapiens
LQASVSFEDVTVDFSKEEWQHLDPAQRRLYWDVTLENYSHLLSVGYQIPKSEAAFKLEQGEGPWMLEGEAPHQSCSGEAIG

SEQ ID NO: 2466 - protein, 81 aa, Homo sapiens
MGSLTFWDVTIEFALEEWQCLDMAQQNLYRNVMLENYRNLVFLGIAVSKLDLITCLKQGKEPWNMKRHEMVTKPPVISSHF

SEQ ID NO: 2467 - protein, 81 aa, Homo sapiens
PLETVTFKDVAVDLTQEEWEQMKPAQRNLYRDVMLENYSNLVTVGCQVTKPDVIFKLEQEEEPWVMEEEMFGRHCPEVWEV

SEQ ID NO: 2468 - protein, 81 aa, Homo sapiens
SQASVSFQDVTVEFTREEWQHLGPVERTLYRDVMLENYSHLISVGYCITKPKVISKLEKGEEPWSLEDEFLNQRYPGYFKV

SEQ ID NO: 2469 - protein, 81 aa, Homo sapiens
TARSQETVTFKDVAMDFTPEEWGKLDPAQRDVMLENYRNLVSLWLPVSKPESYNLENGKEPLKLERKAPKSSYSDMETRPQ

SEQ ID NO: 2470 - protein, 81 aa, Homo sapiens
YQIPVSFKDVVVGFTQEEWHRLSPAQRALYRDVMLETYSNLVSVGYEGTKPDVILRLEQEEAPWIGEAACPGCHCWEDIWR

SEQ ID NO: 2471 - protein, 81 aa, Homo sapiens
YQYSVTFEDTAVDFTQEEWILLDPVQRNLYRDVMLENYENVAKVGFQLFKPSVISWLEEEELRTLQQGVLQDWAIKHQTSV

SEQ ID NO: 2472 - protein, 81 aa, Homo sapiens
AQEPVTFRDVAVFFSQDEWLHLDSAQRALYREVMLENYSSLVSLGIPFSMPKLIHQLQQGEDPCMVEREVPSDTRLGFKTW

SEQ ID NO: 2473 - protein, 81 aa, Homo sapiens
PQVSLTFEDVAVLFTRDEWRKLAPSQRNLYRDVMLENYRNLVSLGLPFTKPKVISLLQQGEDPWEVEKDGSGVSSLGSKSS

SEQ ID NO: 2474 - protein, 81 aa, Homo sapiens
SYEGSVSFRDVAIDFSREEWRHLDLSQRNLYRDVMLETYSHLLSVGYQVPKPEVVMLEQGKEPWALQGERPRHSCPGEKLW

SEQ ID NO: 2475 - protein, 81 aa, Homo sapiens
LQELVSFEEVAVHFTWEEWQDLDDAQRTLYRDVMLETYSSLVSLGHCITKPEMIFKLEQGAEPWIVEETPNLRLSAVQIID

SEQ ID NO: 2476 - protein, 81 aa, Homo sapiens
EPGAVSFADVAVYFCREEWGCLRPAQRALYRDVMRETYGHLSALGIGGNKPALISWVEEEAELWGPAAQDPEVAKCQTQTD

SEQ ID NO: 2477 - protein, 81 aa, Homo sapiens
EMGLLTFRDIAIEFSLEEWQCLDCAQRNLYRDVMLENYRNLVSLGIAVSKPDLITCLEQNKESQNIKRNEMVAKHPVTRSH

SEQ ID NO: 2478 - protein, 81 aa, Homo sapiens
VFEELVTFEDVLVDFSPEELSSLSAAQRNLYREVMLENYRNLVSLGHQFSKPDIISRLEEEESYAMETDSRHTVICQGESH

SEQ ID NO: 2479 - protein, 81 aa, Homo sapiens
VTLRDVVINFSQEEWEYLDSAQRNLYWDVMMENYSNLLSLDLESRNETKHLSVGKDIIQNTGSQWEVMESSKLCGLEGSIF

SEQ ID NO: 2480 - protein, 81 aa, Homo sapiens
PQGLLTFRDVAIEFSQEEWKCLDPAQRTLYRDVMLENYRNLVSLDISSKCMMEFSSIGKGNTEVIHTGTLQRLASHHIGEC

SEQ ID NO: 2481 - protein, 81 aa, Homo sapiens
WSQMPVTFEDVALYLSREEWGRLDHTQQNFYRDVLQKKNGLSLGFPFSRPFWAPQAHGKGEASGSSRQAGDEKEWRGACTG

SEQ ID NO: 2482 - protein, 81 aa, Homo sapiens
AQMLVTFKDVAVTFTREEWRQLDLAQRTLYREVMLETCGLLVSLGHRVPKPELVHLLEHGQELWIVKRGLSHATCAGDRAQ

SEQ ID NO: 2483 - protein, 81 aa, Homo sapiens
LRGLVTFEDVAVEFTQEEWALLDPAQRTLYRDVMLENCRNLASLGCRVNKPSLISQLEQDKKVVTEERGILPSTCPDLETL

SEQ ID NO: 2484 - protein, 81 aa, Homo sapiens
EEGYVTFEDVAVYFSQEEWRLLDDAQRLLYRNVMLENFTLLASLGLASSKTHEITQLESWEEPFMPAWEVVTSAIPRGCWH

SEQ ID NO: 2485 - protein, 81 aa, Homo sapiens
RPGAVSFADVAVYFSPEEWECLRPAQRALYRDVMRETFGHLGALGFSVPKPAFISWVEGEVEAWSPEAQDPDGESSAAFSR

SEQ ID NO: 2486 - protein, 81 aa, Homo sapiens
SLEKVTFEDVAIDFTQEEWDMMDTSKRKLYRDVMLENISHLVSLGYQISKSYIILQLEQGKELWWEGRVFLQDQNPDRESA

SEQ ID NO: 2487 - protein, 81 aa, Homo sapiens
VHGSVTFRDVAIDFSQEEWECLQPDQRTLYRDVMLENYSHLISLGSSISKPDVITLLEQEKEPWIVVSKETSRWYPDLESK

SEQ ID NO: 2488 - protein, 81 aa, Homo sapiens
QGLLTFRDVAIEFSQEEWKCLDPAQRTLYRDVMLENYRNLVSLDISSKCMMKEFSSTAQGNREVFHAGTSQRHESHHNGDF

SEQ ID NO: 2489 - protein, 81 aa, Homo sapiens
SQGSVTFRDVAIDFSQEEWKWLQPAQRDLYRCVMLENYGHLVSLGLSISKPDVVSLLEQGKEPWLGKREVKRDLFSVSESS

SEQ ID NO: 2490 - protein, 81 aa, Homo sapiens
DSISLEDVAVNFTLEEWALLDPGQRNIYRDVMRATFKNLACIGEKWKDQDIEDEHKNQGRNLRSPMVEALCENKEDCPCGK

SEQ ID NO: 2491 - protein, 81 aa, Homo sapiens
EMGLLTFRDVAIEFSLEEWQHLDIAQQNLYRNVMLENYRNLAFLGIAVSKPDLITCLEQGKEPWNMKRHEMVDEPPGMCPH

SEQ ID NO: 2492 - protein, 81 aa, Homo sapiens
SQGTVTFKDVAIDFTQEEWKRLDPAQRKLYRNVMLENYNNLITVGYPFTKPDVIFKLEQEEEPWVMEEEVLRRHWQGEIWG

SEQ ID NO: 2493 - protein, 81 aa, Homo sapiens
LQGSVSFKDVTVDFTQEEWQQLDPAQKALYRDVMLENYCHFVSVGFHMAKPDMIRKLEQGEELWTQRIFPSYSYLEEDGKT

SEQ ID NO: 2494 - protein, 81 aa, Homo sapiens
NCYQDAVTFDDVAVDFTQEEWTLLDPSQRDLYRDVMLENYENLASVEWRLKTKGPALRQDRSWFRASNETQTARSHNGGQL

SEQ ID NO: 2495 - protein, 81 aa, Homo sapiens
MTLLTFRDVAIEFSLEEWKCLDLAQQNLYRDVMLENYRNLFSVGLTVCKPGLITCLEQRKEPWNVKRQEAADGHPEMGFHH

SEQ ID NO: 2496 - protein, 81 aa, Homo sapiens
TLKEAVTFKDVAVVFTEEELRLLDLAQRKLYREVMLENFRNLLSVGHQSLHRDTFHFLKEEKFWMMETATQREGNLGGKIQ

SEQ ID NO: 2497 - protein, 81 aa, Homo sapiens
IQGPLTFGDVAVAFTRIEWRHLDAAQRALYRDVMLENYGNLVSVGLLSSKPKLITQLEQGAEPWTEVREAPSGTHAVEDYW

SEQ ID NO: 2498 - protein, 81 aa, Homo sapiens
FQEAVTFKDVAVVFSREELRLLDLTQRKLYRDVMVENFKNLVAVGHLPFQPDMVSQLEAEEKLWMMETETQRSSKHQNKME

SEQ ID NO: 2499 - protein, 81 aa, Homo sapiens
VTFRDVAIDFSQEEWECLDPAQRDLYVDVMLENYSNLVSLDLESKTYETKKIFSENDIFEINFSQWEMKDKSKTLGLEASI

SEQ ID NO: 2500 - protein, 81 aa, Homo sapiens
AQESVTFEDVAVNFTNREWQCLTYAQRHLYKDVMLENYGNMVSLGFPFPKPPLISHLEREVDPCVQDPQDRESLSCSYPVS

SEQ ID NO: 2501 - protein, 81 aa, Homo sapiens
CYQDSVTFDDVAVDFTQEEWTLLDSTQRSLYSDVMLENYKNLATVGGQIIKPSLISWLEQEESRTVQGGVLQGWEMRLETQ

SEQ ID NO: 2502 - protein, 81 aa, Homo sapiens
AQSSVTFEDVAVNFSLEEWSLLNEAQRCLYRDVMLETLTLISSLGCWHGGEDEAAPSKQSTCIHIYKDQGGHSGERPYECG

SEQ ID NO: 2503 - protein, 81 aa, Homo sapiens
IQGQVNFEDVFVYFSQEEWVLLDEAQRLLYRDVMLENFALMASLGHTSFMSHIVASLVMGSEPWVPDWVDMTLAVATETPG

SEQ ID NO: 2504 - protein, 81 aa, Homo sapiens
SQEQVSFKDVCVDFTQEEWYLLDPAQKILYRDVILENYSNLVSVGYCITKPEVIFKIEQGEEPWILEKGFPSQCHPERKWK

SEQ ID NO: 2505 - protein, 81 aa, Homo sapiens
EKETLTFRDVAIEFSLEEWECLNPAQQNLYMNVMLENYKNLVFLGVAVSKQDPVTCLEQEKEPWNMKRHEMVDEPPAMCSY

SEQ ID NO: 2506 - protein, 81 aa, Homo sapiens
SQEPVTFEDVAVDFTQEEWQQLNPAQKTLHRDVMLETYNHLVSVGCSGIKPDVIFKLEHGKDPWIIESELSRWIYPDRVKG

SEQ ID NO: 2507 - protein, 81 aa, Homo sapiens
ARDLVMFRDVAVDFSQEEWECLNSYQRNLYRDVILENYSNLVSLAGCSISKPDVITLLEQGKEPWMVVRDEKRRWTLDLES

SEQ ID NO: 2508 - protein, 81 aa, Homo sapiens
PKVPVSFEDVSVYFTKTEWKLLDLRQKVLYKRVMLENYSHLVSLGFSFSKPHLISQLERGEGPWVADIPRTWATAGLHIGD

SEQ ID NO: 2509 - protein, 81 aa, Homo sapiens
EMGLLTFRDVAIEFSPEEWQCLDTAQQNLYRNVMLENYRNLAFLGIALSKPDLITYLEQGKEPWNMKQHEMVDEPTGICPH

SEQ ID NO: 2510 - protein, 81 aa, Homo sapiens
FEGSVSFEDVAVDFTRQEWHRLDPAQRTMHKDVMLETYSNLASVGLCVAKPEMIFKLERGEELWILEEESSGHGYSGSLSL

SEQ ID NO: 2511 - protein, 81 aa, Homo sapiens
MGPLQFRDVAIEFSLEEWHCLDAAQRNLYRDVMLENYRNLIFLGIVVSKPNLITCLEQGKKPLTMKRHEMIAKPPVMYSHF

SEQ ID NO: 2512 - protein, 81 aa, Homo sapiens
PQASVCFEDVAMAFTQEEWEQLDLAQRTLYREVTLETWEHIVSLGLFLSKSDVISQLEQEEDLCRAEQEAPRDWKATLEEN

SEQ ID NO: 2513 - protein, 81 aa, Homo sapiens
FQAKLTFEDVAVLLSQDEWDRLCPAQRGLYRNVMMETYGNVVSLGLPGSKPDIISQLERGEDPWVLDRKGAKKSQGLWSDY

SEQ ID NO: 2514 - protein, 81 aa, Homo sapiens
VQEPVTFKDVAVDFTQEEWGQLDLVQRTLYRDVMLETYGHLLSVGNQIAKPEVISLLEQGEEPWSVEQACPQRTCPEWVRN

SEQ ID NO: 2515 - protein, 81 aa, Homo sapiens
FQESVTFQDVAVDFTAEEWQLLDCAERTLYWDVMLENYRNLISVGCPITKTKVILKVEQGQEPWMVEGANPHESSPESDYP

SEQ ID NO: 2516 - protein, 81 aa, Homo sapiens
MELLTFRDVAIEFSPEEWKCLDPAQQNLYRDVMLENYRNLISLGVAISNPDLVIYLEQRKEPYKVKIHETVAKHPAVCSHF

SEQ ID NO: 2517 - protein, 81 aa, Homo sapiens
RPRALKFVDVAVYFSPEEWGCLRPAQRALYRDVMRETYGHLGALGCAGPKPALISWLERNTDDWEPAALDPQEYPRGLTVQ

SEQ ID NO: 2518 - protein, 81 aa, Homo sapiens
QGLLTFRDVAIEFSQEEWKCLDPAQRTLYRDVMLENYRNLVSLDISSKCTMKEFLSTAQGNREVFHAGTLQIHESHHNGDF

SEQ ID NO: 2519 - protein, 81 aa, Homo sapiens
MELLTFRDVAIEFSPEEWKCLDPDQQNLYRDVMLENYRNLVSLGVAISNPDLVTCLEQRKEPYNVKIHKIVARPPAMCSHF

SEQ ID NO: 2520 - protein, 81 aa, Homo sapiens
GPLTFRDVAIEFSQEEWKSLDPVQKALYWDVMLENYRNLVFLGILPKCMTKELPPIGNSNTGEKCQTVTLERHECYDVENF

SEQ ID NO: 2521 - protein, 81 aa, Homo sapiens
MLENYGNVASLGFPLLKPAVISQLEGGSELGGSSPLAAGTGLQGLQTDIQTDNDLTKEMYEGKENVSFELQRDFSQETDFS

SEQ ID NO: 2522 - protein, 81 aa, Homo sapiens
SKDLVTFGDVAVNFSQEEWEWLNPAQRNLYRKVMLENYRSLVSLGVSVSKPDVISLLEQGKEPWMVKKEGTRGPCPDWEYV

SEQ ID NO: 2523 - protein, 81 aa, Homo sapiens
ARVPLTFSDVAIDFSQEEWEYLNSDQRDLYRDVMLENYTNLVSLDFNFTTESNKLSSEKRNYEVNAYHQETWKRNKTFNLM

SEQ ID NO: 2524 - protein, 81 aa, Homo sapiens
SQESVTFQDVAVDFTEKEWPLLDSSQRKLYKDVMLENYSNLTSLGYQVGKPSLISHLEQEEEPRTEERGAHQGACADWETP

SEQ ID NO: 2525 - protein, 81 aa, Homo sapiens
GEGSLSFEDVAVGFTREEWQFLDQSQKVLYKEVMLENYINLVSIGYRGTKPDSLFKLEQGEPPGIAEGAAHSQICPGFVIQ

SEQ ID NO: 2526 - protein, 81 aa, Homo sapiens
MGPLQFRDVAIEFSLEEWHCLDTAQRNLYRNVMLENYSNLVFLGITVSKPDLITCLEQGRKPLTMKRNEMIAKPSVMCSHF

SEQ ID NO: 2527 - protein, 81 aa, Homo sapiens
AQESLTLEDVAVDFTWEEWQFLSPAQKDLYRDVMLENYSNLVSVGYQAGKPDALTKLEQGEPLWTLEDEIHSPAHPEIEKA

SEQ ID NO: 2528 - protein, 81 aa, Homo sapiens
VKESVTFKDVAIDFTLEEWRLMDPTQRNLHKDVMLENYRNLVSLGLAVSKPDMISHLENGKGPWVTVREISRIPYPDMEPK

SEQ ID NO: 2529 - protein, 81 aa, Homo sapiens
MLENYGAVASLAAFPFPKPALISQLERGETPWCSVPRGALDGEAPRGISSGYPFLKPAGISHPEQVEEPLNLKLQGEGPSL

SEQ ID NO: 2530 - protein, 81 aa, Homo sapiens
AQVSVTFDDVAVTFTQEEWGQLDLAQRTLYQEVMLENCGLLVSLGCPVPRPELIYHLEHGQEPWTRKEDLSQGTCPGDKGK

SEQ ID NO: 2531 - protein, 81 aa, Homo sapiens
EKGPLTFRDVVIEFSQEEWQCLDTAQQDLYRKVMLENFRNLVFLGIDVSKPDLITCLEQGKDPWNMKRHSMVATPPESGVL

SEQ ID NO: 2532 - protein, 81 aa, Homo sapiens
CWGLLSFKDISMEFTWDEWQLLDSTQKYLYRDVILENYHNLISVGYHGTKPDLIFKLEQGEDPWIINAKISRQSCPDGWEE

SEQ ID NO: 2533 - protein, 81 aa, Homo sapiens
AHGSVTFRDVAIDFSQEEWEFLDPAQRDLYRDVMWENYSNFISLGPSISKPDVITLLDEERKEPGMVVREGTRRYCPDLES

SEQ ID NO: 2534 - protein, 81 aa, Homo sapiens
SQASVSFKDVTIEFTQEEWQQMAPVQKNLYRDVMLENYSNLVSVGYCCFKPEVIFKLEQGEEPWFSEEEFSNQSHPKDYRG

SEQ ID NO: 2535 - protein, 81 aa, Homo sapiens
MTFEDVAVEFSQWEWGQLNPAQKDLYREVMLENFRNLAILGLLVSKPYVICQLEEGGEPFMVEREISTGAHSDWKRRSKSK

SEQ ID NO: 2536 - protein, 81 aa, Homo sapiens
GLLTFEDVAVFFTQEEWDYLDPAQRSLYKDVMMENYGNLVSLDVLNRDKDEEPTVKQEIEEIEEEVEPQGVIVTRIKSEID

SEQ ID NO: 2537 - protein, 81 aa, Homo sapiens
PQGLLTFRDVAIEFSQEEWKCLDPAQRTLYRDVMLENYRNLVSLDISSKCMLKTLSSTGQGNTEVIHTGTLHRQASHHIGE

SEQ ID NO: 2538 - protein, 81 aa, Homo sapiens
PQESVTFEDVAVYFTQNQWASLDPAQRALYGEVMLENYANVASLVAFPFPKPALISHLERGEAPWGPDPWDTEILRGISQG

SEQ ID NO: 2539 - protein, 81 aa, Homo sapiens
SCEPVTFEDVTLGFTPEEWGLLDLKQKSLYREVMLENYRNLVSVEHQLSKPDVVSQLEEAEDFWPVERGIPQDTIPEYPEL

SEQ ID NO: 2540 - protein, 81 aa, Homo sapiens
MELVTFRDVAIEFSPEEWKCLDPAQQNLYRDVMLENYRNLVSLGFVISNPDLVTCLEQIKEPCNLKIHETAAKPPAICSPF

SEQ ID NO: 2541 - protein, 81 aa, Homo sapiens
SQGLLTFRDVAIEFSQEEWKCLDPAQRTLYRDVMLENYRNLVSLDISSKCMMNTLSSTGQGNTEVIHTGTLQRQASYHIGA

SEQ ID NO: 2542 - protein, 81 aa, Homo sapiens
PQESVAFEDVAVYFTTKEWAIMVPAERALYRDVMLENYEAVAFVVPPTSKPALVSHLEQGKESCFTQPQGVLSRNDWRAGW

SEQ ID NO: 2543 - protein, 81 aa, Homo sapiens
LQGPVSFKDVAVDFTQEEWQQLDPDEKITYRDVMLENYSHLVSVGYDTTKPNVIIKLEQGEEPWIMGGEFPCQHSPEAWRV

SEQ ID NO: 2544 - protein, 81 aa, Homo sapiens
GWVPALFDEVAIYFSDEEWEVLTEQQKALYREVMRMNYETVLSLEFPFPKPDMITRLEGEEESQNSDEWQLQGGTSAENEE

SEQ ID NO: 2545 - protein, 81 aa, Homo sapiens
GPVSFKDVAVDFTQEEWRQLDPDEKIAYGDVMLENYSHLVSVGYDYHQAKHHHGVEVKEVEQGEEPWIMEGEFPCQHSPEP

SEQ ID NO: 2546 - protein, 81 aa, Homo sapiens
SQELLTFKDVSVDFTQEEWGQLAPAHRNLYREVMLENYGNLVSVGCQLSKPGVISQLEKGEEPWLMERDISGVPSSDLKSK

SEQ ID NO: 2547 - protein, 81 aa, Homo sapiens
PRLPLTFEDVAIYFSEQEWQDLEAWQKELYKHVMRSNYETLVSLDDGLPKPELISWIEHGGEPFRKWRESQKSGNIICSSV

SEQ ID NO: 2548 - protein, 81 aa, Homo sapiens
NFWILRLPPGSKGESPKEWGKLEDWQKELYKHVMRGNYETLVSLDYAISKPEVLSQIEQGKEPCNWRRPGPKIPDVPVDPS

SEQ ID NO: 2549 - protein, 81 aa, Homo sapiens
PQGHLTFRDVAIEFSQAEWKCLDPAQRALYKDVMLENYRNLVSLGISLPDLNINSMLEQRREPWSGESEVKIAKNSDGREC

SEQ ID NO: 2550 - protein, 81 aa, Homo sapiens
VTFEDVTIIFTWEEWKFLDSSQKRLYREVMWENYTNVMSVENWNESYKSQEEKFRYLEYENFSYWQGWWNAGAQMYENQNY

SEQ ID NO: 2551 - protein, 81 aa, Homo sapiens
MFKEAVTFKDVAVAFTEEELGLLGPAQRKLYRDVMVENFRNLLSVGHPPFKQDVSPIERNEQLWIMTTATRRQGNLGEKNQ

SEQ ID NO: 2552 - protein, 81 aa, Homo sapiens
SAQGMTFEDVAIYFSQEEWELLDESQRFLYCDVMLENFAHVTSLGYCHGMENEAIASEQSVSIQVRTSKGNTPTQKTHLSE

SEQ ID NO: 2553 - protein, 81 aa, Homo sapiens
MELLTFRDVAIEFSPEEWKCLDPAQQNLYRDVMLENYRNLVSLAVYSYYNQGILPEQGIQDSFKKATLGRYGSCGLENICL

SEQ ID NO: 2554 - protein, 81 aa, Homo sapiens
MFKEAVTFKDVAVVFTEEELGLLDVSQRKLYRDVMLENFRNLLSVGHQLSHRDTFHFQREEKFWIMETATQREGNSGGKIQ

SEQ ID NO: 2555 - protein, 81 aa, Homo sapiens
QGLLTFRDVAIEFSQEEWKCLDPAQRTLYRDVMLENYRNLVSLDISSKCMMKEFSSTAQGNTEVIHTGTLQRHERHHIGDF

SEQ ID NO: 2556 - protein, 81 aa, Homo sapiens
MESVTFEDVAVEFIQEWALLDSARRSLCKYRMLDQCRTLASRGTPPCKPSCVSQLGQRAEPKATERGILRATGVAWESQLK

SEQ ID NO: 2557 - protein, 81 aa, Homo sapiens
QGRLTFRDVAIEFSLAEWKFLNPAQRALYREVMLENYRNLEAVDISSKRMMKEVLSTGQGNTEVIHTGMLQRHESYHTGDF

SEQ ID NO: 2558 - protein, 81 aa, Homo sapiens
AQESLTLEDVAVDFTWEEWQFLSPAQKDLYRDVMLENYSNLVAVGYQASKPDALSKLERGEETCTTEDEIYSRICSEIRKI

SEQ ID NO: 2559 - protein, 81 aa, Homo sapiens
SKAPITFGDLAIYFSQEEWEWLSPIQKDLYEDVMLENYRNLVSLGLSFRRPNVITLLEKGKAPWMVEPVRRRRAPDSGSKC

SEQ ID NO: 2560 - protein, 81 aa, Homo sapiens
GTVTFEDVAVNFTWEEWNLLSEAQRCLYRDVTLENLALISSLGCWCGVEDEAAPSKQSIYIQRETQVRTPMAGVSPKKAHP

SEQ ID NO: 2561 - protein, 81 aa, Homo sapiens
RSQESLTFQDVAVDFTREEWDQLYPAQKNLYRDVMLENYRNLVALGYQLCKPEVIAQLELEEEWVIERDSLLDTHPDGENR

SEQ ID NO: 2562 - protein, 81 aa, Homo sapiens
KSLESVSFKDVTVDFSRDEWQQLDLAQKSLYREVMLENYFNLISVGCQVPKPEVIFSLEQEEPCMLDGEIPSQSRPDGDIG

SEQ ID NO: 2563 - protein, 81 aa, Homo sapiens
AVTFKDVAVIFTEEELGLLDPAQRKLYRDVMLENFRNLLSVGGKIQTEMETVPEAGTHEEFSCKQIWEQIASDLTRSQDTT

SEQ ID NO: 2564 - protein, 81 aa, Homo sapiens
KSQESLTLEDVAVEFTWEEWQLLGPAQKDLYRDVMLENYSNLVSVGYQASKPDALFKLEQGEPWTVENEIHSQICPEIKKV

SEQ ID NO: 2565 - protein, 81 aa, Homo sapiens
EMGLLTFRDVVIEFSLEEWQCLDHAQQNLYRDVMLENYRNLVSLGIAVSKPDLITCLEQNKEPWNIKRNEMVTKHPVMCSH

SEQ ID NO: 2566 - protein, 81 aa, Homo sapiens
EMGPLTFRDVAIEFSLEEWQCLDTAQRNLYRKVMFENYRNLVFLGIAVSKPHLITCLEQGKEPWNRKRQEMVAKPPVIYSH

SEQ ID NO: 2567 - protein, 81 aa, Homo sapiens
GTVTFEDVAVNFSQEEWSLLSEAQRCLYHDVMLENLTLISSLGCWYGAKDETPSKQTLSIQQESPLRTHWTGVCTKKVHLW

SEQ ID NO: 2568 - protein, 81 aa, Homo sapiens
GKELLSFEDVAMYFTREEWGHLNWGQKDLYRDVMLENYRNMVLLGFQFPKPEMICQLENWDEQWILDLPRTGNRKASGSAC

SEQ ID NO: 2569 - protein, 81 aa, Homo sapiens
GHLTFRDVAIEFSLEEWKCLDPTQRALYRAMMLENYRNLHSVDISSKCMMKKFSSTAQGNTEVDTGTLERHESHHIGDFCF

SEQ ID NO: 2570 - protein, 81 aa, Homo sapiens
ALRSVMFSDVSIDFSPEEWEYLDLEQKDLYRDVMLENYSNLVSLGCFISKPDVISSLEQGKEPWKVVRKGRRQYPDLETKY

SEQ ID NO: 2571 - protein, 81 aa, Homo sapiens
LQGLVMFEDVTVYFSREEWGLLNVTQKGLYRDVMLENFALVSSLGLAPSRSPVFTQLEDDEQSWVPSWVDVTPVSRAEARR

SEQ ID NO: 2572 - protein, 81 aa, Homo sapiens
AGRPLEMAVSEPEASAAEWKQLDPAQSNLYNDVMLENYCNQASMGCQAPKPDMISKLEKGEAPWLGKGKRPSQGCPSKIAR

SEQ ID NO: 2573 - protein, 81 aa, Homo sapiens
SQGLVTFGDVAVDFSQEEWEWLNPIQRNLYRKVMLENYRNLASLGLCVSKPDVISSLEQGKEPWTVKRKMTRAWCPDLKAV

SEQ ID NO: 2574 - protein, 81 aa, Homo sapiens
MGPLQFRDVAIEFSLEEWHCLDMAQRNLYRDVMLENYRNLVFLGIVVSKPDLITHLEQGKKPSTMQRHEMVANPSVLCSHF

SEQ ID NO: 2575 - protein, 81 aa, Homo sapiens
TFKEAVTFKDVAVVFTEEELGLLDPAQRKLYRDVMLENFRNLLSVGHQPFHQDTCHFLREEKFWMMGTATQREGNSGGKIQ

SEQ ID NO: 2576 - protein, 81 aa, Homo sapiens
SWGPLSFMDVFVDFTWEEWQLLDPAQKCLYRSVMLENYSNLVSLGYQHTKPDIIFKLEQGEELCMVQAQVPNQTCPNTVWK

SEQ ID NO: 2577 - protein, 81 aa, Homo sapiens
SVAFEDVAVNFTQEEWALLSPSQKNLYRDVTLETFRNLASVGIQWKDQDIENLYQNLGIKLRSLVERLCGRKEGNEHRETF

SEQ ID NO: 2578 - protein, 81 aa, Homo sapiens
LGPVTFEDVAVLFTEAEWKRLSLEQRNLYKEVMLENLRNLVSLAESKPEVHTCPSCPLAFGSQQFLSQDELHNHPIPGFHA

SEQ ID NO: 2579 - protein, 81 aa, Homo sapiens
GTVTFEDVAVKFTQEEWNLLSEAQRCLYRDVTLENLALMSSLGCWCGVEDEAAPSKQSIYIQRETQVRTPMAGVSPKKAHP

SEQ ID NO: 2580 - protein, 81 aa, Homo sapiens
SLEKVTFEDVAIDFTQEEWDMMDTSKRKLYRDVMLENISHLVSLGYQISKSYIILQLEQGKELWREGRVFLQDQNPDRESA

SEQ ID NO: 2581 - protein, 81 aa, Homo sapiens
QGRLTFRDVAIEFSLAEWKFLNPAQRALYREVMLENYRNLEAVDISSKHMMKEVLSTGQGNREVIHTGTLQRHQSYHIGDF

SEQ ID NO: 2582 - protein, 81 aa, Homo sapiens
SKESVSFKDVAVDFTQEEWGQLDSPQRALYRDVMLENYQNLLALGPPLHKPDVISHLERGEEPWSMQREVPRGPCPEWELK

SEQ ID NO: 2583 - protein, 81 aa, Homo sapiens
LQEPVTFRDVAVDFTQEEWGQLDPTQRILYRDVMLETFGHLLSIGPELPKPEVISQLEQGTELWVAERGTTQGCHPAWEPR

SEQ ID NO: 2584 - protein, 81 aa, Homo sapiens
TFKEAVTFKDVAVVFTEEELGLLDPAQRKLYRDVMLENFRNLLSVGNQPFHQDTFHFLGKEKFWKMKTTSQREGNSGGKIQ

SEQ ID NO: 2585 - protein, 81 aa, Homo sapiens
CEASVSFEDVTVDFSREEWQQLDPAQRCLYRDVMLELYSHLFAVGYHIPNPEVIFRMLKEKEPRVEEAEVSHQRCQEREFG

SEQ ID NO: 2586 - protein, 81 aa, Homo sapiens
AQGHVVFEDVAIYFSQEEWGHLDEAQRLLYRDVMLENLALLSSLGCCHGAEDEEAPLEPGVSVGVSQVMAPKPCLSTQNTQ

SEQ ID NO: 2587 - protein, 81 aa, Homo sapiens
PVTFRDVTVIFTEAEWKRLSPEQRNLYKEVMLENYRNLLSLAEPKPEIYTCSSCLLAFSCQQFLSQHVLQIFLGLCAENHF

SEQ ID NO: 2588 - protein, 81 aa, Homo sapiens
PKVPVAFDDVSIYFSTPEWEKLEEWQKELYKNIMKGNYESLISMDYAINQPDVLSQIQPEGEHNTEDQAGPEESEIPTDPS

SEQ ID NO: 2589 - protein, 81 aa, Homo sapiens
SLKKVTFEDVAIDFTQEEWAMMDTSKRKLYRDVMLENISHLVSLGYQISKSYIILQLEQGKELWREGREFLQDQNPDRESA

SEQ ID NO: 2590 - protein, 81 aa, Homo sapiens
QGTVTFEDVAVHFSWEEWGLLDEAQRCLYRDVMLENLALLTSLDVHHQKQHLGEKHFRSNVGRALFVKTCTFHVSGEPSTC

SEQ ID NO: 2591 - protein, 81 aa, Homo sapiens
LVTFRDVAIDFSQEEWECLDPAQRDLYRDVMLENYSNLISLDLESSCVTKKLSPEKEIYEMESLQWENMGKRINHHLQYNG

SEQ ID NO: 2592 - protein, 81 aa, Homo sapiens
RQAFLAFGDVTVDFTQKEWRLLSPAQRALYREVTLENYSHLVSLGILHSKPELIRRLEQGEVPWGEERRRRPGPCAGIYAE

SEQ ID NO: 2593 - protein, 81 aa, Homo sapiens
QGRLTFRDVAIEFSLAEWKCLNPSQRALYREVMLENYRNLEAVDISSKCMMKEVLSTGQGNTEVIHTGTLQRHESHHIGDF

SEQ ID NO: 2594 - protein, 81 aa, Homo sapiens
RESGKAPVTFDDITVYLLQEEWVLLSQQQKELCGSNKLVAPLGPTVANPELFRKFGRGPEPWLGSVQGQRSLLEHHPGKKQ

SEQ ID NO: 2595 - protein, 81 aa, Homo sapiens
VQESVTFRDVAVFFSQDEWLHLDSAQRALYREVMLENYSILVSLGILFSKPKVISQLEQGEDPWMVESGVPQGAHLGWESL

SEQ ID NO: 2596 - protein, 81 aa, Homo sapiens
DPEQVTFEDVVVGFSQEEWGQLKPAQRTLYRDVMLDTFRLLVSVGHWLPKPNVISLLEQEAELWAVESRLPQGVYPDLETR

SEQ ID NO: 2597 - protein, 81 aa, Homo sapiens
MEGLVMFQDLSIDFSQEEWECLDAAQKDLYRDVMMENYSSLVSLGLSIPKPDVISLLEQGKEPWMVSRDVLGGWCRDSEFR

SEQ ID NO: 2598 - protein, 81 aa, Homo sapiens
SQELVTFEDVAVYFIRKEWKRLEPAQRDLYRDVMLENYGNVFSLDRETRTENDQEISEDTRSHGVLLGRFQKDISQGLKFK

SEQ ID NO: 2599 - protein, 81 aa, Homo sapiens
MLENYQNLVWLGLSISKSVISLLEKRKLPWIMAKEEIRGPLPGYFKVSEMTISQEPKAKTRTLFGKDVPGAEIKELSAKRA

SEQ ID NO: 2600 - protein, 81 aa, Homo sapiens
AEGSVMFSDVSIDFSQEEWDCLDPVQRDLYRDVMLENYGNLVSMGLYTPKPQVISLLEQGKEPWMVGRELTRGLCSDLESM

SEQ ID NO: 2601 - protein, 81 aa, Homo sapiens
MVQESVTFKDVAILFTQEEWGQLSPAQRALYRDVMLENYSNLVSLGLLGPKPDTFSQLEKREVWMPEDTPGGFCLDWMTMP

SEQ ID NO: 2602 - protein, 81 aa, Homo sapiens
SYGSITFGDVAIDFSHQEWEYLSLVQKTLYQEVMMENYDNLVSLAGHSVSKPDLITLLEQGKEPWMIVREETRGECTDLDS

SEQ ID NO: 2603 - protein, 81 aa, Homo sapiens
DSVAFEDVAINFTCEEWALLGPSQKSLYRDVMQETIRNLDCIGMIWQNHDIEEDQYKDLRRNLRCHMVERACEIKDNSQCG

SEQ ID NO: 2604 - protein, 81 aa, Homo sapiens
PQESVTFKDVSVDFTQEEWYHVDPAQRSLYRDVMLENYSHLVSLGYQVSKPEVIFKLEQGEEPWISEGEIQRPFYPDWKTR

SEQ ID NO: 2605 - protein, 81 aa, Homo sapiens
QGLLTFRDVAIEFSQEEWKCLDPAQRTLYRDVMLENYRNLVSLDISSKCMMKTFFSTGQGNTEAFHTGTLQRQASHHIGDF

SEQ ID NO: 2606 - protein, 81 aa, Homo sapiens
SRSLENDGVCFTEQEWENLEDWQKELYRNVMESNYETLVSLKVLGQTEGEAELGTEMLGDLEEEGPGGAHPAGGVMIKQEL

SEQ ID NO: 2607 - protein, 81 aa, Homo sapiens
VMFRDVAIDFSQEEWECLDSAQRDLYRDVMLENYSNLVSLDLPSRCASKDLSPEKNTYETELSQWEMSDRLENCDLEESNS

SEQ ID NO: 2608 - protein, 81 aa, Homo sapiens
MGPLEFRDVAIEFSLEEWHCLDTAQQNLYRDVMLENYRHLVFLGIVVTKPDLITCLEQGKKPFTVKRHEMIAKSPVMCFHF

SEQ ID NO: 2609 - protein, 81 aa, Homo sapiens
MNVMLENYKNLVFLAGIAVSKQDPITSLEQEKEPWNMKICEMVDESPAMCSSFTRDLWPEQDIKDSFQQVILRRHGKCEHE

SEQ ID NO: 2610 - protein, 81 aa, Homo sapiens
EMGLLTFRDIAIEFSLAEWQCLDHAQQNLYRDVMLENYRNLVSLGIAVSKPDLITCLEQNKEPQNIKRNEMVAKHPVTCSH

SEQ ID NO: 2611 - protein, 81 aa, Homo sapiens
MGPLTFMDVAIEFCLEEWQCLDIAQQNLYRNVMLENYRNLVFLGIAVSKPDLITCLEQEKEPWEPMRRHEMVAKPPVMCSH

SEQ ID NO: 2612 - protein, 81 aa, Homo sapiens
MLENYRNLVFVGIAASKPDLITCLEQGKEPWNVKRHEMVAEPPVVCSYFARDLWPKQGKKNYFQKVILRRYKKCGCENLQL

SEQ ID NO: 2613 - protein, 81 aa, Homo sapiens
QEPLSFKDVAVVFTEEELELLDSTQRQLYQDVMQENFRNLLSVGERNPLGDKNGKDTEYIQDEELRFFSHKELSSCKIWEE

SEQ ID NO: 2614 - protein, 81 aa, Homo sapiens
ANVSLAFRDVSIDLSQEEWECLDAVQRDLYKDVMLENYSNLVSLGYTIPKPDVITLLEQEKEPWIVMREGTRNWFTDLEYK

SEQ ID NO: 2615 - protein, 81 aa, Homo sapiens
QQGYVTFEDVAVYFSQEEWRLLDDAQRLLYRNVMLENFTLLASLGLASSKTHEITQLESWEEPFMPAWEVVTSAILRGSWQ

SEQ ID NO: 2616 - protein, 81 aa, Homo sapiens
FQDSVAFEDVAVSFTQEEWALLDPSQKNLYRDVMQETFKNLTSVGKTWKVQNIEDEYKNPRRNLSLMREKLCESKESHHCG

SEQ ID NO: 2617 - protein, 81 aa, Homo sapiens
YHGSVTFEDVAIAFSQQEWESLDSSQRGLYRDVMLENYRNLVSMGHSRSKPHVIALLEQWKEPEVTVRKDGRRWCTDLQLE

SEQ ID NO: 2618 - protein, 81 aa, Homo sapiens
KSKEAVTFKDVAVVFSEEELQLLDLAQRKLYRDVMLENFRNVVSVGHQSTPDGLPQLEREEKLWMMKMATQRDNSSGAKNL

SEQ ID NO: 2619 - protein, 81 aa, Homo sapiens
CEVSVSFEDVTVDFSREEWQQLDSTQRRLYQDVMLENYSHLLSVGFEVPKPEVIFKLEQGEGPWTLEGEAPHQSCSDGKFG

SEQ ID NO: 2620 - protein, 81 aa, Homo sapiens
EMGVLTFRDVALEFSLEEWQCLDTAQQNLYRNVMLENYRNLVFVGIAASKPDLITCLEQGKEPWNVKRHEMVTEPPVVYSY

SEQ ID NO: 2621 - protein, 81 aa, Homo sapiens
SQGRVTFEDVTVNFTQGEWQRLNPEQRNLYRDVMLENYSNLVSVGQGETTKPDVILRLEQGKEPWLEEEEVLGSGRAEKNG

SEQ ID NO: 2622 - protein, 81 aa, Homo sapiens
FQEMVTFKDVAVVFTREELGLLDLAQRKLYQDVMLENFRNLLSVGYQPFKLDVILQLGKEDKLRMMETEIQGDGCSGHKNQ

SEQ ID NO: 2623 - protein, 81 aa, Homo sapiens
TQGQVTFRDVAIEFSQEEWTCLDPAQRTLYRDVMLENYRNLASLGISCFDLSIISMLEQGKEPFTLESQVQIAGNPDGWEW

SEQ ID NO: 2624 - protein, 81 aa, Homo sapiens
WSQNSVTFQEVAVDFSQEEWALLDPAQKNLYKDVMLENFRNLASVGYQLCRHSLISKVDQEQLKTDERGILQGDCADWETQ

SEQ ID NO: 2625 - protein, 81 aa, Homo sapiens
VAFEDVAVNFTQEEWTLLDISQKNLFREVMLETFRNLTSIGKKWSDQNIEYEYQNPRRSFRSLIEEKVNEIKEDSHCGETF

SEQ ID NO: 2626 - protein, 81 aa, Homo sapiens
RVTFKDVAVVFTKEELALLDKAQINLYQDVMLENFRNLMLVRDGIKNNILNLQAKGLSYLSQEVLHCWQIWKQRIRDLTVS

SEQ ID NO: 2627 - protein, 81 aa, Homo sapiens
SPDSMTFEDIIVDFTQEEWALLDTSQRKLFQDVMLENISHLVSIGKQLCKSVVLSQLEQVEKLSTQRISLLQGREVGIKHQ

SEQ ID NO: 2628 - protein, 81 aa, Homo sapiens
GTVTFEDVAVKFTQEEWNLLSEAQRCLYRDVTLENLALMSSLGCWCGVEDEAAPSKQSIYIQRETQVRTPVTGVSPKKAHP

SEQ ID NO: 2629 - protein, 81 aa, Homo sapiens
EKGPLTFRDVAIEFSLEEWQCLDSAQQGLYRKVMLENYRNLVFLAGIALTKPDLITCLEQGKEPWNIKRHEMVAKPPVICS

SEQ ID NO: 2630 - protein, 81 aa, Homo sapiens
EMGPLTFRDVTIEFSLEEWQCLDTVQQNLYRDVMLENYRNLVFLGMAVFKPDLITCLKQGKEPWNMKRHEMVTKPPVMRSH

SEQ ID NO: 2631 - protein, 81 aa, Homo sapiens
QGLLTFRDVAIEFSQEEWKCLDPAQRTLYRDVMLENYRNLVSLDISSKCMMKEFSSTAQGNREVIHTGTLQRHESHHTGDF

SEQ ID NO: 2632 - protein, 81 aa, Homo sapiens
PQEAVVFEDVAVYFTRIEWSCLAPDQQALYRDVMLENYGNLASLGFLVAKPALISLLEQGEEPGALILQVAEQSVAKASLC

SEQ ID NO: 2633 - protein, 81 aa, Homo sapiens
QSCVTFEDVFVYFSREEWELLEEAQRFLYRDVMLENFALVATLGFWCEAEHEAPSEQSVSVEGVSQVRTAESGLFQKAHPC

SEQ ID NO: 2634 - protein, 81 aa, Homo sapiens
FQELVTFRDVAIDFSRQEWEYLDPNQRDLYRDVMLENYRNLVSLGGHSISKPVVVDLLERGKEPWMILREETQFTDLDLQC

SEQ ID NO: 2635 - protein, 81 aa, Homo sapiens
AQESVMFSDVSVDFSQEEWECLNDDQRDLYRDVMLENYSNLVSMGHSISKPNVISYLEQGKEPWLADRELTRGQWPVLESR

SEQ ID NO: 2636 - protein, 81 aa, Homo sapiens
PKVPVTFDDVAVYFSELEWGKLEDWQKELYKHVMRGNYETLVSLDYAISKPDILTRIERGEEPCLDRWGQEKGNEVEVGRP

SEQ ID NO: 2637 - protein, 81 aa, Homo sapiens
SQGLVSFKDVAVDFTQEEWQQLDPSQRTLYRDVMLENYSHLVSMGYPVSKPDVISKLEQGEEPWIIKGDISNWIYPDEYQA

SEQ ID NO: 2638 - protein, 81 aa, Homo sapiens
GQLTFKDVAIEFSQEEWTCLDPAQKTLYRDVMLENYRNLVSLDISCKCVNTDLPPKGKNNMGEAFYTVKLERLESCDTVGL

SEQ ID NO: 2639 - protein, 81 aa, Homo sapiens
KVPVTFVDIAVYFSEDEWKNLDEWQKELYNNLVKENYKTLMSLDAEGSVPKPDAPVQAEPREEPCVWEQRHPEEREIPMDP

SEQ ID NO: 2640 - protein, 81 aa, Homo sapiens
FQGSVSFKDVTVGFTQEEWQHLDPSQRALYRDVMLENYSNLVSVGYCAHKPEVIFRLEQGEEPWRLEEEFPSQSFPEVWTA

SEQ ID NO: 2641 - protein, 81 aa, Homo sapiens
RRGHLTFRDVAIEFSQEEWKCLDPVQKALYRDVMLENYRNLVSLGICLPDLSIISMMKQRTEPWTVENEMKVAKNPDRWEG

SEQ ID NO: 2642 - protein, 81 aa, Homo sapiens
SKGPVMFRDVSIDFSQEEWECLDADQMNLYKEVMLENFSNLVSVGLSNSKPAVISLLEQGKEPWMVDRELTRGLCSDLESM

SEQ ID NO: 2643 - protein, 81 aa, Homo sapiens
SQHLVTFEDVAVDFTQEEWTLLDQAQRDLYRDVMLENYKNLIILAGSELFKRSLMSGLEQMEELRTGVTGVLQELDLQLKT

SEQ ID NO: 2644 - protein, 81 aa, Homo sapiens
MSKEAVTFKDVAVVFTEEELGLLDLAQRKLYRDVMLENFRNLLSVGHQPFHRDTFHFLREEKFWMMDIATQREGNSGGKIQ

SEQ ID NO: 2645 - protein, 81 aa, Homo sapiens
MPQVTFNDVAIDFTHEEWGWLSSAQRDLYKDVMVQNYENLVSVAGLSVTKPYVITLLEDGKEPWMMEKKLSKGMIPDWESR

SEQ ID NO: 2646 - protein, 81 aa, Homo sapiens
AGGSVSFSDVAVGFTQEEWQHLDSAQRTPYRDMMLENYSLLLSVGYCITKPEVVCKLEHGQVLWILEEESPSQSHLDCCID

SEQ ID NO: 2647 - protein, 81 aa, Homo sapiens
AQELLTLEDVTVEFTWEEWQLLGPFQKDLYRDVMLEIYSNLLSMGYQVSKPDALSKLERGEEPWTMEDERHSRICPENNEV

SEQ ID NO: 2648 - protein, 81 aa, Homo sapiens
VTFDDVAVEFTPEEWALLDTTQKYLYRDVMLENYMNLASVDFFFCLTSEWEIQPRTKRSSLQQGFLKNQIFTGIQMQTRSY

SEQ ID NO: 2649 - protein, 81 aa, Homo sapiens
EKGPLTFRDVAIEFSLEEWQCLDTAQQDLYRKVMLENYRNLVFLAGIAVSKPDLITCLEQGKEPWNMKRHAMVDQPPVTYS

SEQ ID NO: 2650 - protein, 81 aa, Homo sapiens
VHGSVTFRDVAIDFSQEEWECLQPDQRTLYRDVMLENYSHLISLGSSISKPDVITLLEQEKEPWMVVRKETSRRYPDLELK

SEQ ID NO: 2651 - protein, 81 aa, Homo sapiens
MELLTFRDVTIEFSLEEWEFLNPAQQSLYRKVMLENYRNLVSLGLTVSKPELISRLEQRQEPWNVKRHETIAKPPAMSSHY

SEQ ID NO: 2652 - protein, 81 aa, Homo sapiens
ALALVSFEDVVVTFTGEEWGHLDLAQRTLYQEVMLETCRLLVSLGHPVPKPELIYLLEHGQELWTVKRGLSQSTCAGEKAK

SEQ ID NO: 2653 - protein, 81 aa, Homo sapiens
SVAFEDVAVTFTQEEWALLDPSQKNLCRDVMQETFRNLASIGKKWKPQNIYVEYENLRRNLRIVGERLFESKEGHQHGEIL

SEQ ID NO: 2654 - protein, 81 aa, Homo sapiens
PQVSLTFEDVAVLFTWDEWRKLAPSQRNLYRDVMLENYRNLVSLGLSFTKPKVISLLQQGEDPWEVEKDSSGVSSLGCKST

SEQ ID NO: 2655 - protein, 81 aa, Homo sapiens
MRDEVAEKEKADINVTLVFQGYENTPIMVCVDGIVFSKPDLVTCLEQRKKPWSMKHPGLTQHNIVHTGDKPYKCKDCGKIF

SEQ ID NO: 2656 - protein, 81 aa, Homo sapiens
SLKKVTFEDVAIDFTQEEWAMMDTSKRKLYRDVMLENISHLVSLGYQISKSYIILQLEQGKELWQEGREFLQDQNPDRESA

SEQ ID NO: 2657 - protein, 81 aa, Homo sapiens
LQGLLTFRDVAIEFSQEEWKCLDPAQRTLYRDVMLENYRNLVSLDTSSKCMMKMFSSTGQGNTEVVHTGTLQIHASHHIGD

SEQ ID NO: 2658 - protein, 81 aa, Homo sapiens
FQEMVTFKDVAVVFTEEELGLLDSVQRKLYRDVMLENFRNLLLVAHQPFKPDLISQLEREEKLLMVETETPRDGCSGRKNQ

SEQ ID NO: 2659 - protein, 81 aa, Homo sapiens
FQGPVTLKDVIVEFTKEEWKLLTPAQRTLYKDVMLENYSHLVSVGYHVNKPNAVFKLKQGKEPWILEVEFPHRGFPEDLWS

SEQ ID NO: 2660 - protein, 81 aa, Homo sapiens
TTFKEAVTFKDVAVFFTEEELGLLDPAQRKLYQDVMLENFTNLLSVGHQPFHPFHFLREEKFWMMETATQREGNSGGKTIA

SEQ ID NO: 2661 - protein, 81 aa, Homo sapiens
SLGSELFRDVAIVFSQEEWQWLAPAQRDLYRDVMLETYSNLVSLGLAVSKPDVISFLEQGKEPWMVERVVSGGLCPVLESR

SEQ ID NO: 2662 - protein, 81 aa, Homo sapiens
AHALVTFRDVAIDFSQKEWECLDTTQRKLYRDVMLENYNNLVSLGYSGSKPDVITLLEQGKEPCVVARDVTGRQCPGLLSR

SEQ ID NO: 2663 - protein, 81 aa, Homo sapiens
IQDSVVFEDVAVDFTQEEWALLDLAQRNLYRDVMLENFQNLASLGYPLHTPHLISQWEQEEDLQTVKRELIQGIFMGEHRE

SEQ ID NO: 2664 - protein, 81 aa, Homo sapiens
AQEPVTFRDVAIYFSREEWACLEPSQRALYRDVMLDNFSSVAALGFCSPRPDLVSRLEQWEEPWVEDRERPEFQAVQRGPR

SEQ ID NO: 2665 - protein, 81 aa, Homo sapiens
QDTVAYEDLSEDYTQKKWKGLALSQRALHWNMMLENDRSMASLGRNMMESSELTPKQEIFKGSESSNSTSGGLFGVVPGGT

SEQ ID NO: 2666 - protein, 81 aa, Homo sapiens
SRTLVTFKDVFVDFTREEWKLLDTAQQIVYRNVMLENYKNLVSLGYQLTKPDVILRLEKGEEPWLVEREIHQETHPDSETA

SEQ ID NO: 2667 - protein, 81 aa, Homo sapiens
RRGHLAFRDVAIEFPQEEWKCLDPAQRTLYREVMVENYRNLVFLGICLPDLSVISMLEQRRDPRNLQSEVKIANNPGGREC

SEQ ID NO: 2668 - protein, 81 aa, Homo sapiens
PRGSTFFSSVTVAFAQERWRCLVSTPRDRFKEGIPGKSRSLVLLGLPVSQPGMNSQLEQREGAWMLEGEDLRSPSPGWKII

SEQ ID NO: 2669 - protein, 81 aa, Homo sapiens
AHELVMFRDVAIDVSQEEWECLNPAQRNLYKEVMLENYSNLVSLGLSVSKPAVISSLEQGKEPWMVVREETGRWCPGTWKT

SEQ ID NO: 2670 - protein, 81 aa, Homo sapiens
AQVSVTFDDVAVTFTKEEWGQLDLAQRTLYQEVMLENCGLLVSLGCPVPKAELICHLEHGQEPWTRKEDLSQDTCPGDKGK

SEQ ID NO: 2671 - protein, 81 aa, Homo sapiens
TQGPLKFMDVAIEFSQEEWKCLDPAQRTLYRDVMLENYRNLVSLGICLPDLSVTSMLEQKRDPWTLQSEEKIANDPDGREC

SEQ ID NO: 2672 - protein, 81 aa, Homo sapiens
SYEGSVSFRDVAIDFSREEWRHLDPSQRNLYRDVMLETYSHLLSVGYQVPEAEVVMLEQGKEPWALQGERPRQSCPGEKLW

SEQ ID NO: 2673 - protein, 81 aa, Homo sapiens
WLQEPMTFKDVAVEFTQEEWMMLDSAQRSLYRDVMLENYRNLTSVEYQLYRLTVISPLDQEEIRNMKKRIPQAICPDQKIQ

SEQ ID NO: 2674 - protein, 81 aa, Homo sapiens
VASEDVAVNFTLEEWALLDPSQKKLYRDVMRETFRNLACVGKKWEDQSIEDWYKNQGRILRNHMEEGLSESKEYDQCGEAF

SEQ ID NO: 2675 - protein, 81 aa, Homo sapiens
TQESLTLEDVAVEFSWEEWQLLDTAQKNLYRDVMVENYNHLVSLGYQTSKPDVLSKLAHGQEPWTTDAKIQNKNCPGIGKV

SEQ ID NO: 2676 - protein, 81 aa, Homo sapiens
SLEEWQCLDTSQQNLYRNVMLDNYRNLVFLGIAVSKPDLITCLEQGKEPCNMKRHAMVAKPPVVCSHFAQDLWPKQGLKDS

SEQ ID NO: 2677 - protein, 81 aa, Homo sapiens
HLTFKDVAIEFSQEEWKCLEPVQKALYKDVMLENYRNLVFLGISPKCVIKELPPTENSNTGERFQTVALERHQSYDIENLY

SEQ ID NO: 2678 - protein, 81 aa, Homo sapiens
AQGLVTFRDVAIEFSLEEWKCLEPAQRDLYREVTLENFGHLASLGLSISKPDVVSLLEQGKEPWMIANDVTGPWCPDLESR

SEQ ID NO: 2679 - protein, 81 aa, Homo sapiens
SQESLTFKDVFVDFTLEEWQQLDSAQKNLYRDVMLENYSHLVSVGHLVGKPDVIFRLGPGDESWMADGGTPVRTCAGEDRP

SEQ ID NO: 2680 - protein, 81 aa, Homo sapiens
SQGSVSFRDVTVGFTQEEWQHLDPAQRTLYRDVMLENYSHLVSVGYCIPKPEVILKLEKGEEPWILEEKFPSQSHLELINT

SEQ ID NO: 2681 - protein, 81 aa, Homo sapiens
KPGTVSFADVAVYFSPEEWGCLRPAQRALYRDVMQETYGHLGALGFPGPKPALISWMEQESEAWSPAAQDPEKGERLGGAR

SEQ ID NO: 2682 - protein, 81 aa, Homo sapiens
VTFADVAVNFTKEEWTLLDPAQRNLYRDVMLENSRNLAFIDWATPCKTKDATPQPDILPKRTFPEANRVCLTSISSQHSTL

SEQ ID NO: 2683 - protein, 81 aa, Homo sapiens
SLGPVSFKDVAVDFTQEEWQQLDPEQKITYRDVMLENYSNLVSVGYHIIKPDVISKLEQGEEPWIVEGEFLLQSYPDEVWQ

SEQ ID NO: 2684 - protein, 81 aa, Homo sapiens
MGPLQFRDVAIEFSLEEWHCLDTAQWNLYRDVMLENYRHLVFLVCGKAFNSSSNLTTHKKIHTGEKPYRCEECGKAFKRSS

SEQ ID NO: 2685 - protein, 81 aa, Homo sapiens
MGPLTFRDVAIEFSLKEWQCLDTAQRNLYRNVMLENYRNLVFLGITVSKPDLITCLEQGKEAWSMKRHEIMVAKPTVMCSH

SEQ ID NO: 2686 - protein, 81 aa, Homo sapiens
PKVPVTFDDVAVHFSEQEWGNLSEWQKELYKNVMRGNYESLVSMDYAISKPDLMSQMERGERPTMQEQEDSEEGETPTDPS

SEQ ID NO: 2687 - protein, 81 aa, Homo sapiens
RVTFKDIAVIFTKEELAVLDKAQINLYQDVMLENFRNFISVDGIKNNILNLQGKGLIYLSQEELHCWKIWKQRIRDLSVSQ

SEQ ID NO: 2688 - protein, 81 aa, Homo sapiens
RNMIPQDNENPPQQGEANQNDSVAFEDVAVNFTPDEWALLDPSQKNLYREVMQETLRNLASIEVLWKRDSLKVKVISMEKF

SEQ ID NO: 2689 - protein, 81 aa, Homo sapiens
MAHLMMFRDVAVDFSQEEWECLDLEQRDLYRDVMLENYSNMVSLGFCIYQPEAFSLLEKGKEPWKILRDETRGPCPDMQSR

SEQ ID NO: 2690 - protein, 81 aa, Homo sapiens
FQKPVTFEDVAVNFTQEEWDCLDASQRVLYQDVMSETFKNLTSVARIFLHKPELITKLEQEEEQWRETRVLQASQAGPPFF

SEQ ID NO: 2691 - protein, 81 aa, Homo sapiens
QAEVTFEDVAVYLSREEWGRLGPAQRGLYRDVMLETYGNLVSLGVGPAGPKPGVISQLERGDEPWVLDVQGTSGKEHLRVN

SEQ ID NO: 2692 - protein, 81 aa, Homo sapiens
HQELVRFRDVAVVFSPEEWDHLTPEQRNLYKDVMLDNCKYLASLGNWTYKAHVMSSLKQGKEPWMMEREVTGDPCPACQPA

SEQ ID NO: 2693 - protein, 81 aa, Homo sapiens
QEGVNFKIVTVDFTREEQGTWNPAQRTLDRDVILENHRDLVSWDLATAVGKKDSTSKQRIFDEEPANGVKIERFTRDDPWL

SEQ ID NO: 2694 - protein, 81 aa, Homo sapiens
TQVRLTFRDVAIEFSQEEWKCLDPAQRILYRDVMLENYWNLVSLGLCHFDMNIISMLEEGKEPWTVKSCVKIARKPRTPEC

SEQ ID NO: 2695 - protein, 81 aa, Homo sapiens
TEGRVVFEDVAIYFSQEEWGHLDEAQRLLYRDVMLENLALLSSLGSWHGAEDEEAPSQQGFSVGVSEVTASKPCLSSQKVH

SEQ ID NO: 2696 - protein, 81 aa, Homo sapiens
PQDLVTFKDVAIDFSQEEWQWMNPAQKRLYRSMMLENYQSLVSLGLCISKPYVISLLEQGREPWEMTSEMTRSPFSDWESI

SEQ ID NO: 2697 - protein, 81 aa, Homo sapiens
YQELVTFRDVAVDFSQEEWDCLDSSQRHLYSNVMLENYRILVSLGLCFSKPSVILLLEQGKAPWMVKRELTKGLCSGWEPI

SEQ ID NO: 2698 - protein, 81 aa, Homo sapiens
AQGSVSFNDVTVDFTQEEWQHLDHAQKTLYMDVMLENYCHLISVGCHMTKPDVILKLERGEEPWTSFAGHTCLEENWKAED

SEQ ID NO: 2699 - protein, 81 aa, Homo sapiens
IQSQISFEDVAVDFTLEEWQLLNPTQKNLYRDVMLENYSNLVFLEVWLDNPKMWLRDNQDNLKSMERGHKYDVFGKIFNSS

SEQ ID NO: 2700 - protein, 81 aa, Homo sapiens
MLENYRNLVFLGIAAFKPDLIIFLEQGKEPWNMKRHEMVEEPPVICSHFSQEFWPEQGIEDSFQKMILRRYDKCGHENLHL

SEQ ID NO: 2701 - protein, 81 aa, Homo sapiens
ASVTVTFDDVALYFSEQEWEILEKWQKQMYKQEMKTNYETLDSLGYAFSKPDLITWMEQGRMLLISEQGCLDKTRRTTSPP

SEQ ID NO: 2702 - protein, 81 aa, Homo sapiens
SQESLTFKDVFVDFTLEEWQQLDSAQKNLYRDVMLENYSHLVSVGYLVAKPDVIFRLGPGEESWMADGGTPVRTCAGEDRP

SEQ ID NO: 2703 - protein, 81 aa, Homo sapiens
MLENYWNLVSLGLCHFDMNIISMLEEGKEPWTVKSCVKIARKPRTPECVKGVVTDIPPKCTIKDLLPKEKSSTEAVFHTVV

SEQ ID NO: 2704 - protein, 81 aa, Homo sapiens
MGPLTFRDVAIEFSLKEWQCLDTAQRNLYRNVMLENYRNLVFLDLITCLEQGKEAWSMKRHEIMVAKPTVMCSHFAQDLWP

SEQ ID NO: 2705 - protein, 81 aa, Homo sapiens
MASPSPPPESKEWDYLDPAQRSLYKDVMMENYGNLVSLDVLNRDKDEEPTVKQEIEEIEEEVEPQGVIVTRIKSEIDQDPM

SEQ ID NO: 2706 - protein, 81 aa, Homo sapiens
PQASVCFEDVAMAFTQEEWEQLDLAQRTLYREVTLETWEHIVSLGLFLSKSDVISQLEQEEDLCRAEQEAPRDGVSLLLPR

SEQ ID NO: 2707 - protein, 81 aa, Homo sapiens
PQASVCFEDVAMAFTQEEWEQLDLAQRTLYREVTLETWEHIVSLGLFLSKSDVISQLEQEEDLCRAEQEAPRGTRPSKKQR

SEQ ID NO: 2708 - protein, 81 aa, Homo sapiens
QGRLTFRDVAIEFSLAEWKCLNPSQRALYREVMLENYRNLEAVDISSKRMMKEVLSTGQGNTEVIHTGTLQRYQSYHIGDF

SEQ ID NO: 2709 - protein, 81 aa, Homo sapiens
MGLLAFRDVALEFSPEEWECLDPAQRSLYRDVMLENYRNLISLGLAMSKPELIICLEARKEPWNVNTEKTARHSVETRFRH

SEQ ID NO: 2710 - protein, 81 aa, Homo sapiens
SQGLVTFRDVALDFSQEEWEWLKPSQKDLYRDVMLENYRNLVWLGLSISKPNMISLLEQGKEPWMVERKMSQGHCAGSHSV

SEQ ID NO: 2711 - protein, 81 aa, Homo sapiens
KDHSCPQNLDLFVCSGLEPHTPSVGSQESVTFQDVAVDFTEKEWPLLDSSQRKLYKDVMLENYSNLTSLGKASAISPLIHP

SEQ ID NO: 2712 - protein, 81 aa, Homo sapiens
RKRKAKESGMALLQGLLTFRDVAIEFSQEEWKCLDPAQRTLYRDVMLENYRNLVSLDTSSKCMMKMFSSTGQGNTEVVHTG

SEQ ID NO: 2713 - protein, 81 aa, Homo sapiens
LQEPVKDVHVARGFSYRKSVHQIPAQRDLYRDFRKENVGNVVSLGSAVSTSNKITRLEQRKEPWTLGLHSSNKRSILRSNY

SEQ ID NO: 2714 - protein, 81 aa, Homo sapiens
KKKPVTFEDVAVNFTQEEWDCLDASQRVLYQDVMSETFKNLTSVARIFLHKPELITKLEQEEEQWREFVHLPNTEGLSEGK

SEQ ID NO: 2715 - protein, 81 aa, Homo sapiens
GYSGQLAGVAVSAGSPPIPTSSMWSPMVRLGGFSPELQHLPQTLLHRCPLGQPCMGVLTFRDVALEFSLEEWQCLDTAQQN

SEQ ID NO: 2716 - protein, 81 aa, Homo sapiens
SPEVTQPDEDLHLQAEETQLVKESVTFKDVAIDFTLEEWRLMDPTQRNLHKDVMLENYRNLVSLGLAVSKPDMISHLENGK

SEQ ID NO: 2717 - protein, 81 aa, Homo sapiens
MLENYRNLVSLGLTVSKPELISRLEQRQEPWNVKRHETIAKPPAMSSHYTEDLLPEQCMQDSFQKVILRRYGSCGLEDLHL

SEQ ID NO: 2718 - protein, 81 aa, Homo sapiens
PLSFKDVAVVFTEEELELLDSTQRQLYQDVMQENFRNLLSVGDKNGKDTEYIQDEELRFFSHKELSSCKIWEEVAGELPGS

SEQ ID NO: 2719 - protein, 81 aa, Homo sapiens
QDSVTFDDVAVEFTPEEWALLDTTQKYLYRDVMLENYMNLASVDFFFCLTSEWEIQPRTKRSSLQQGFLKNQIFTGIQMTR

SEQ ID NO: 2720 - protein, 81 aa, Homo sapiens
ASGSVTFEDVAVYFSWEEWDLLDEAQKHLYFDVMLENFALTSSLGLISSWSHVVAQLGLGEVPSVLHRMFMTPASARWDQR

SEQ ID NO: 2721 - protein, 81 aa, Homo sapiens
MLENYCHLISVGCHMTKPDVILKLERGEEPWTSFAGHTCLEENWKAEDFLVKFKEHQEKYSRSVVSINHKKLVKEKSKIYE

SEQ ID NO: 2722 - protein, 81 aa, Homo sapiens
SQELVTFEDVAVYFIRKEWKRLEPAQRDLYRDVMLENYGNVSSLDRETRTENDQEISEDTRSHGVLLGRFQKDISQGLKFK

SEQ ID NO: 2723 - protein, 81 aa, Homo sapiens
PLAMAEMDPTQGRVVFEDVAIYFSQEEWGHLDEAQRLLYRDVMLENLALLSSLGKALTLAQCPGLGCVTPFYPKAALRFPQ

SEQ ID NO: 2724 - protein, 81 aa, Homo sapiens
WSQNSVTFQEVAVDFSQEEWGLLDPAQKNLYKDVMLENFRNLASVGYQLCRHSLISKVDQEQLKTDERGILQGDCADWETQ

SEQ ID NO: 2725 - protein, 81 aa, Homo sapiens
QAMVKIEDMAVSLILEEWGCQNLARRNLSRDNRQENYGSAFPQGGENRNENEESTSKAETSEDSASRGETTGRSQKEFGEK

SEQ ID NO: 2726 - protein, 81 aa, Homo sapiens
MVQNYENLVSVGLSVTKPYVIMLLEDGKEPWMMEKKLSKDWESRWENKELSTKKDIYDEDSPQPVTMEKVVKQSYEFSNSN

SEQ ID NO: 2727 - protein, 81 aa, Homo sapiens
YHIIKPDVISKLEQGEEPWIVEGEFLLQSYPDEVWQTDDLIERIQEEENKPSRQTVFIETLIEERGNVPGKTFDVETNPVP

SEQ ID NO: 2728 - protein, 81 aa, Homo sapiens
MLETYNHLVSLEIPSSKPKLIAQLERGEAPWREERKCPLDLCPESKPEIQLSPSCPLIFSSQQALSQHVWLSHLSQLFSSL

SEQ ID NO: 2729 - protein, 81 aa, Homo sapiens
MAAPDLAHGGHVSRDSVCLHEEQTQAAGMVAGWLINCYQDAVTFDDVAVDFTQEEWTLLDPSQRDLYRDVMLENYENLASV

SEQ ID NO: 2730 - protein, 81 aa, Homo sapiens
TQGQLSFSDVAIEFSQEEWKCLDPGQKALYRDVMLENYRNLVSLGICLPDLSVTSMLEQKRDPWTLQSEVKIINNPDGREC

SEQ ID NO: 2731 - protein, 81 aa, Homo sapiens
MAEGSVMFSDVSIDFSQEEWDCLDPVQRDLYRDVMLENYGNLVSMGKGICTSDSQFSSGMSPSSTVNFSAAFQDFTLLSLK

SEQ ID NO: 2732 - protein, 81 aa, Homo sapiens
MPQVTFNDVAIDFTHEEWGWLSSAQRDLYKDVMVQNYENLVSVGLSVTKPYVITLLEDGKEPWMMEKKLSKGMIPDWESRW

SEQ ID NO: 2733 - protein, 81 aa, Homo sapiens
DMGPLTFRDVAIEFSLEEWQCLDTAQQDLYRKVMLENYRNLVFLAGIAVSKPDLVTCLEQGKDPWNMKGHSTVVKPPGFLP

SEQ ID NO: 2734 - protein, 81 aa, Homo sapiens
KLYRDVMVENFKNLVAVGHLPFQPDMVSQLEAEEKLWMMETETQRSSKHQNKMETLQKFALKYLSNQELSCWQIWKQVASE

SEQ ID NO: 2735 - protein, 81 aa, Homo sapiens
DMGPLTFRDVAIEFSLEEWQCLDTAQQDLYRKVMLENYRNLVFLGIAVSKPDLVTCLEQGKDPWNMKGHSTVVKPPGFLPP

SEQ ID NO: 2736 - protein, 81 aa, Homo sapiens
SITFKDLAVRFSEEEWRLLEEGQREFYRDVMRENYETLVSVGTAELLPLSAFLSPSEPGRAVGGGSHADEGQEPAGCGDPQ

SEQ ID NO: 2737 - protein, 81 aa, Homo sapiens
VHGSVTFRDVAIDFSQEEWECLQPDQRTLYRDVMLENYSHLISLAGSSISKPDVITLLEQEKEPWMVVRKETSRRYPDLEL

SEQ ID NO: 2738 - protein, 81 aa, Homo sapiens
MLENYRNLIFLGIVVSKQDLITSMSSHYTEDLLPEQCMQDSFQKVILRRYGSCGLEDLHLRKDGENVGECKDQKEIYNGLN

SEQ ID NO: 2739 - protein, 81 aa, Homo sapiens
MELVTFRDVAIEFSPEEWKCLDPAQQNLYRDVMLENYRNLVSLAICSPFSQDLSPVQGIEDSFHKLILKRYEKCGHENLQL

SEQ ID NO: 2740 - protein, 81 aa, Homo sapiens
SLELVSFEEVAVHFTWEEWQDLDDAQRTLYRDVMLETYSSLVSLGHYITKPEMIFKLEQGAEPWIVEETPNLRLSAVQIID

SEQ ID NO: 2741 - protein, 81 aa, Homo sapiens
SQELVTFEDVAVYFIRKEWKRLKPAQRDLYRDVMLENYGNVFSLDRETRTENDQEISEDTRSHGVLLGRFQKDISQGLKFK

SEQ ID NO: 2742 - protein, 81 aa, Homo sapiens
DSVTFEDVAVDFTQEEWTLLDQTQRNLYRDVMLENYKNLVAVDWESHINTKWSAPQQNFLQGKTSSVVEMVRFRRYNLLSS

SEQ ID NO: 2743 - protein, 81 aa, Homo sapiens
ARGKSKSKAPITFGDLAIYFSQEEWEWLSPIQKDLYEDVMLENYRNLVSLGLSFRRPNVITLLEKGKAPWMVEPVRRRRAP

SEQ ID NO: 2744 - protein, 81 aa, Homo sapiens
RVQSCVTFEDVFVYFSREEWELLEEAQRFLYRDVMLENFALVATLAFIFPVPCSCAVGGGRKPWVPDRADITAATVKETYR

SEQ ID NO: 2745 - protein, 81 aa, Homo sapiens
AVTFKDVAVVFSREELRLLDLTQRKLYRDVMVENFKNLVAVGSKHQNKMETLQKFALKYLSNQELSCWQIWKQVASELTRC

SEQ ID NO: 2746 - protein, 81 aa, Homo sapiens
MLENYGNLVSVGLLSSKPKLITQLEQGAEPWTEVREAPSGTHAVEDYWFETKMSALKQSTSEASVLGERTKSVMMEKGLDW

SEQ ID NO: 2747 - protein, 81 aa, Homo sapiens
GQVNFEDVFVYFSQEEWVLLDEAQRLLYRDVMLENFALMASLGCWHGMEDEEIPFEQSFSIGMSQIRIPKGGPSTQKAYPC

SEQ ID NO: 2748 - protein, 80 aa, Homo sapiens
MWAPREQLLGWTAEALPAKDSAWPWEEKPRYLGPVTFEDVAVLFTEAEWKRLSLEQRNLYKEVMLENLRNLVSLVLSYQI

SEQ ID NO: 2749 - protein, 81 aa, Homo sapiens
TGGDVTFSDVAIDFSHEEWACLDSAQRDLYKDVMVQNYENLVSVGLSVTKPYVIMLLEDGKEPWMMEKKLSKDWESRWENK

SEQ ID NO: 2750 - protein, 81 aa, Homo sapiens
AVLTDRAQVSVTFDDVAVTFTKEEWGQLDLAQRTLYQEVMLENCGLLVSLAPLQTHPGSIRCILQSNQVDTLIKIPEHTEH

SEQ ID NO: 2751 - protein, 81 aa, Homo sapiens
QGLVTFRDVALDFSQEEWEWLKPSQKDLYRDVMLENYRNLVWLGDGCSCCSTLRTTVTAEASSSSSSIQASFHSLALPLMS

SEQ ID NO: 2752 - protein, 81 aa, Homo sapiens
SQGLLTFRDVAIEFSQEEWKCLDPAQRTLYRDVMLENYRNLVSLGLISRDLCYLRKTPRRQRKGARDGSSSGILDFQRCGY

SEQ ID NO: 2753 - protein, 81 aa, Homo sapiens
LLTFRDVAIEFSQEEWKCLDPAQRTLYRDVMLENYRNLVSLGIFSKCEIKELPPKKESNTGEIFQTVMLERHESHDIQDFC

SEQ ID NO: 2754 - protein, 81 aa, Homo sapiens
GTVTFEDVAVKFTQEEWNLLSEAQRCLYRDVTLENLALMSSLGCWCGVEDEAAPSKQSIYIQRETQVRTPMTGVSPKKAHP

SEQ ID NO: 2755 - protein, 81 aa, Homo sapiens
FQAKLTFEDVAVLLSQDEWDRLCPAQRGLYRNVMMGTYGNVVSLGLPGSKPDIISQLERGEDPWVLDRKGAKKSQGLWSDY

SEQ ID NO: 2756 - protein, 81 aa, Homo sapiens
WEQLDPSQRILYMDVMLENYSNLLSVEVWKADDQMERDHRNPDEQARQFLILKNQTPIEERGDLFGKALNLNTDFVSLRQV

SEQ ID NO: 2757 - protein, 81 aa, Homo sapiens
QLTFRDVAIEFSQDEWKCLNSTQRTLYRDVMLENYRNLVSLDLSRNCVIKELAPQQEGNPGEVFHTVTLEQHEKHDIEEFC

SEQ ID NO: 2758 - protein, 81 aa, Homo sapiens
QEGVNFKIVTVDFTREEQGTCNPAQRTLDRDVILENHRDLVSWDLATAVGKKDSTSKQRIFDEEPANGVKIERFTRDDPWL

SEQ ID NO: 2759 - protein, 81 aa, Homo sapiens
LFQLLVTFRDVAIDFSQEEWECLDPAQRDLYRDVMLENYSNLISLDLESSCVTKKLSPEKEIYEMESLQWENMGKRINHHL

SEQ ID NO: 2760 - protein, 81 aa, Homo sapiens
YQEFVTFEDVAVHLTREEWGYLDPVQRDLYREVMLENYGNVVSLGFPISKPDGISQLEQDLQVFDLETKTREVLRDDCSDG

SEQ ID NO: 2761 - protein, 81 aa, Homo sapiens
DSVTFEDVAVDFTQEEWTLLDQTQRNLYRDVMLENYKNLVAVDWESHINTKWSAPQQNFLQGKTSSVVEMSLTVSPRLECS

SEQ ID NO: 2762 - protein, 81 aa, Homo sapiens
SKAPITFGDLAIYFSQEEWEWLSPIQKDLYEDVMLENYRNLVSLGLSFRRPNVITLLEKGKAPWMVEPVRRRRAPGWTTMM

SEQ ID NO: 2763 - protein, 81 aa, Homo sapiens
KVPVTFVDIAVYFSEDEWKNLDEWQKELYNNLVKENYKTLMSLDAEGSVPKPDAPVQAEPYSCPECGKSFGVRKSLIIHHR

SEQ ID NO: 2764 - protein, 81 aa, Homo sapiens
SQAPVTFEDMAMYLTREDWRPLDAAQRDLYRDVMQENYGNVVSLDFEIRSENEVNPKQEISEDVQFGTTSERPAENAEGNP

SEQ ID NO: 2765 - protein, 81 aa, Homo sapiens
MLENYSLLLSVGYCITKPEVVCKLEHGQVLWILEEESPSQSHLDCCIDDDLMEKRQENQDQHLQKVDFVNNKTLTMDRNGV

SEQ ID NO: 2766 - protein, 81 aa, Homo sapiens
QASVCFEDVAMAFTQEEWEQLDLAQRTLYREVTLETWEHIVSLDWKATLEENRLNSEKDRAREELSHHVEVYRSGPEEPPS

SEQ ID NO: 2767 - protein, 81 aa, Homo sapiens
MAFTQLTFRDVAIEFSQDEWKCLNSTQRTLYRDVMLENYRNLVSLEYYPMWEHRKEPWTIESQVRVARKPKGWEWIKGVKT

SEQ ID NO: 2768 - protein, 81 aa, Homo sapiens
VQGLLTFRDVAIEFSQEEWKCLDPAQRTLYRDVMLENYRNLVSLEFWSVIPAKVQWCHLRSLQPPLPRFKQFSCLSLPSTW

SEQ ID NO: 2769 - protein, 81 aa, Homo sapiens
AQGLVTFADVAIDFSQEEWACLNSAQRDLYWDVMLENYSNLVSLDLESAYENKSLPTEKNIHEIWASKRNSDRRSKSLGRN

SEQ ID NO: 2770 - protein, 81 aa, Homo sapiens
TQGQLSFSDVAIEFSQEEWKCLDPGQKALYRDVMLENYRNLVSLGICLPDLSVNSMLEQKRDPWTLQSEVKIVNNPDGREC

SEQ ID NO: 2771 - protein, 81 aa, Homo sapiens
TLPQVGNSGDQAGATVLRMVRPQDTVAYEDLSVDYTQKKWKSLTLSQRALQWNMMPENHHSMASLDGETGTEEELIPKHHS

SEQ ID NO: 2772 - protein, 81 aa, Homo sapiens
PQGLLTFRDVAIEFSQEEWKCLDPAQRTLYRDVMLENYRNLVSLGSCCAVEVGLDLLGSRHPPRPPKKLGLQAPTPVPNYW

SEQ ID NO: 2773 - protein, 81 aa, Homo sapiens
PQGSLTFRDVAVEFSQEEWKCLDPVQKALYRDVMLENYRNLGFLGLCLPDLNIISMLEQGKEPWTVVSQVKIARNPNCGEC

SEQ ID NO: 2774 - protein, 81 aa, Homo sapiens
TQGQVTFRDVAIEFSQEEWTCLDPAQRTLYRDVMLENYRNLASLAGISCFDLSIISMLEQGKEPFTLESQVQIAGNPDGWE

SEQ ID NO: 2775 - protein, 81 aa, Homo sapiens
PKVPMTFDDVAVQFSEQVWGKLEDWQKELCKHVMRGNCEMLVSLDYAISKSEVLSQIEQGKEPCNWHRPDPKIPDVPVDPS

SEQ ID NO: 2776 - protein, 81 aa, Homo sapiens
AQGTVTFEDVAVNFTWEEWNLLSEAQRCLYRDVTLENLALISSLGMTFLHVCQALDSLRQVIHPPTSASQSAGITGSHSIP

SEQ ID NO: 2777 - protein, 81 aa, Homo sapiens
SQGLVTFGDVAVDFSQEEWEWLNPIQRNLYRKVMLENYRNLAWLGLCVSKPDVISSLEQGKEPWTVKRKMTRAWCPDLKAV

SEQ ID NO: 2778 - protein, 81 aa, Homo sapiens
AEPLHPVCTCGRHFRRPEPCREPLASPIQDSVAFEDVAVNFTQEEWALLDSSQKNLYREVMQETCRNLASVEIISYRDCVK

SEQ ID NO: 2779 - protein, 81 aa, Homo sapiens
AQESVMFSDVSVDFSQEEWECLNDDQRDLYRDVMLENYSNLVSMAGHSISKPNVISYLEQGKEPWLADRELTRGQWPVLES

SEQ ID NO: 2780 - protein, 81 aa, Homo sapiens
SKAPITFGDLAIYFSQEEWEWLSPIQKDLYEDVMLENYRNLVSLGLSFRRPNVITLLEKGKAPWMVEPVRRRRAPELVTVA

SEQ ID NO: 2781 - protein, 81 aa, Homo sapiens
GYVTFEDVAVYFSQEEWRLLDDAQRLLYRNVMLENFTLLASLGCWHGAEAEEAPEQIASVGLLSSNIQQHQKQHCGEKPLK

SEQ ID NO: 2782 - protein, 81 aa, Homo sapiens
RAEEAVTFKDVAVIFTEEELGLLDPAQRKLYRDVMLENFRNLLSVGHQPFHGDTFHFLREEKFWVMGTTSQREGNLGTILL

SEQ ID NO: 2783 - protein, 81 aa, Homo sapiens
QVSVTFDDVAVTFTKEEWGQLDLAQRTLYQEVMLENCGLLVSLGDKGKPKTTEPTTCEPALSEGISLQGQVTQGNSVDSQL

SEQ ID NO: 2784 - protein, 81 aa, Homo sapiens
AQQIVYRNVMLENYKNLVSLGYQLTKPDVILRLEKGEEPWLVEREIHQETHPDSETAFEIKSSVSSRSIFKDKQSCDIKME

SEQ ID NO: 2785 - protein, 81 aa, Homo sapiens
MEEMLSFWDVAIDFSPEEKECLDPAQWDLYRDVMLENFSHLDFLGLAVAKPYLVTFLEQNQGSSGVKSQTSATIPPGTTGN

SEQ ID NO: 2786 - protein, 81 aa, Homo sapiens
MLENYSHLISVGYCITKPKVISKLEKGEEPWSLEDEFLNQRYPGYFKVDHIKGIREKQEKPLWQEIFISDADKTLSKEGQK

SEQ ID NO: 2787 - protein, 81 aa, Homo sapiens
MLETYGHLLSVGNQIAKPEVISLLEQGEEPWSVEQACPQRTCPEWVRNLESKALIPAQSIFEEEQSHGMKLERYIWDDPWF

SEQ ID NO: 2788 - protein, 81 aa, Homo sapiens
MELLTFKDVAIEFSPEEWKCLDISQQNLYRDVMLENYRNLVSLGVTISNPDLVTSLEQRKEPYNLKIHETAARPPVISLQV

SEQ ID NO: 2789 - protein, 81 aa, Homo sapiens
VTFKDVAVTFTREEWRQLDLAQRTLYREVMLETCGLLVSLGDRAQVHTREPTTYPPVLSERAFLRGSLTLESSTSSDSRLG

SEQ ID NO: 2790 - protein, 81 aa, Homo sapiens
KISIVTFKDVAVNFSQEEWRYLDPSQKLLYKRDVMLENYRNLVSLGNDVSKPDVISCLEQGSEPWIRKTPPDLRKYPRISY

SEQ ID NO: 2791 - protein, 81 aa, Homo sapiens
SVVFEDVDVNFTQEEWALLDPSQKNLYRDVMQETFRNLASVGKKWKDQKIEDEYKNPRRNLSLRKWSWSLYARQTLGLDSP

SEQ ID NO: 2792 - protein, 81 aa, Homo sapiens
MGLLAFRDVALEFSPEEWECLDPAQRSLYRDVMLENYRNLISLGLAMSKPELIICLEARKEPWNVNTEKTAKHSVATRFRH

SEQ ID NO: 2793 - protein, 81 aa, Homo sapiens
PQASVCFEDVAMAFTQEEWEQLDLAQRTLYREVTLETWEHIVSLGLFLSKSDVISQLEQEEDLCRAEQEAPREKGMLPGSF

SEQ ID NO: 2794 - protein, 81 aa, Homo sapiens
CYQDSVTFDDLAVDFTPEEWTLLDPTQRNLYRDVMLENYKNLATVGYQLFKPSLISWLEQEESRTVQRGDFQASEWKVQLK

SEQ ID NO: 2795 - protein, 81 aa, Homo sapiens
VTFEDVAVYLSREEWGRLGPAQRGLYRDVMLETYGNLVSLALGTRTEYKELTSQETFGEEDPQGSEPVEACDHISKSEGSL

SEQ ID NO: 2796 - protein, 81 aa, Homo sapiens
MFKEAVTFKDVAVAFTEEELGLLGPAQRKLYRDVMVENFRNLLSVGHPPFKQDVSPIERNEQFWIMTTATRRQGNLGEKNQ

SEQ ID NO: 2797 - protein, 81 aa, Homo sapiens
SQGLVTFKDVAVCFSQDQWSDLDPTQKEFYGEYVLEEDCGIVVSLSFPIPRPDEISQVREEEPWVPDIQEPQETQEPEILS

SEQ ID NO: 2798 - protein, 81 aa, Homo sapiens
SQEQVSFKDVCVDFTQEEWYLVDPAQKILYRDVILENYSNLVSVGYCITKPEVIFKIEQGEEPWILEKGFPSQCHPERKWK

SEQ ID NO: 2799 - protein, 81 aa, Homo sapiens
SYGSITFGDVAIDFSHQEWEYLSLVQKTLYQEVMMENYDNLVSLGHSVSKPDLITLLEQGKEPWMIVREETRGECTAELQS

SEQ ID NO: 2800 - protein, 81 aa, Homo sapiens
PKVPVTFDDVAVYFSEQEWGKLEDWQKELYKHVMRGNYETLVSLDYAISKPEVLSQIEQGKEPCNWRRPGPKIPDVPVDPS

SEQ ID NO: 2801 - protein, 81 aa, Homo sapiens
RQAEQIPVTFPRDVAVFSQEEWRKLDPLQKLYDVMLENYPTLVSVGQKPIRIISLEQLKPWGIFLRVSSSDKQLDFLLQAS

SEQ ID NO: 2802 - protein, 81 aa, Homo sapiens
MELVTFRDVAIEFSPEEWKCLDPARQNLYRDVMLENYRNLVSLGFVISNPDLVTCLEQIKEPCNLKIHETAAKPPAICSPF

SEQ ID NO: 2803 - protein, 81 aa, Homo sapiens
MDVAIEFSLEEWQCLDTAQRNVYRHVMLENYRNLVFLALCSRFAQDLWLEQNIKDSFQKVTLSRYGKYGHKNLQLRKGCKS

SEQ ID NO: 2804 - protein, 81 aa, Homo sapiens
MLENYNSIVSLGLPVPQPDVIFQLKRGDKPWMVDLHGSEEREWPESVSLDWETKPEIHDASDKKSEGSLRECLGRQSPLCP

SEQ ID NO: 2805 - protein, 80 aa, Homo sapiens
MLREEAAQKRKGKEPGMALPQGRLTFRDVAIEFSLAEWKCLNPSQRALYREVMLENYRNLEAVETGFHCVSQDGLNLLTS

SEQ ID NO: 2806 - protein, 81 aa, Homo sapiens
MLDNFSSVAALGFCSPRPDLVSRLEQWEEPWVEDRERPEFQAVQRGPRPGARKSADPKRPCDHPAWAHKKTHVRRERAREG

SEQ ID NO: 2807 - protein, 81 aa, Homo sapiens
MLENYGNMVSLGFPFPKPPLISHLEREVDPCVQDPQDRESLSCSYPVSADKMWPENEKASSQQEIFENGEAYWMKFNSLLK

SEQ ID NO: 2808 - protein, 81 aa, Homo sapiens
EKGPLTFRDVAIEFSLEEWQCLDTAQQDLYRKVMLENYRNLVFLGIAVSKPDLITCLEQGKEPWNMKRHAMVDQPPVTYSH

SEQ ID NO: 2809 - protein, 81 aa, Homo sapiens
EKGPLTFRDVAIEFSLEEWQCLDSAQQGLYRKVMLENYRNLVFLGIALTKPDLITCLEQGKEPWNIKRHEMVAKPPVICSH

SEQ ID NO: 2810 - protein, 81 aa, Homo sapiens
KRKGKEPGMALPQGRLTFRDVAIEFSLAEWKCLNPSQRALYREVMLENYRNLEAVESHFVTQAGVQWCDPGSLQPLPPRFK

SEQ ID NO: 2811 - protein, 81 aa, Homo sapiens
KMTKFQEAVTFKDVAVVFSREELRLLDLTQRKLYRDVMVENFKNLVAVDMVSQLEAEEKLWMMETETQRSSKHQNKMETLQ

SEQ ID NO: 2812 - protein, 81 aa, Homo sapiens
LVTFRDVALDFSQEEWEWLKPSQKDLYRDVMLENYRNLVWLDWESWCEIEELSPKWFIDEDEISQEMVMERLASHGLECSS

SEQ ID NO: 2813 - protein, 81 aa, Homo sapiens
FPREPICPFEEKTKIGTMVEDHRSNSYQDSVTFDDVAVEFTPEEWALLDTTQKYLYRDVMLENYMNLASVADKKLQWMETL

SEQ ID NO: 2814 - protein, 81 aa, Homo sapiens
ARDLVMFRDVAVDFSQEEWECLNSYQRNLYRDVILENYSNLVSLGCSISKPDVITLLEQGKEPWMVVRDEKRRWTLDLESR

SEQ ID NO: 2815 - protein, 81 aa, Homo sapiens
VGLQYHGSVTFEDVAIAFSQQEWESLDSSQRGLYRDVMLENYRNLVSMAGHSRSKPHVIALLEQWKEPEVTVRKDGRRWCT

SEQ ID NO: 2816 - protein, 81 aa, Homo sapiens
ESCSGFSGFCASPIEESHGALISSCNSRTMTDGLVTFRDVAIDFSQEEWECLDPAQRDLYVDVMLENYSNLVSLGKVICLK

SEQ ID NO: 2817 - protein, 81 aa, Homo sapiens
MLETYSHLLSVGYQVPKPEVVMLEQGKEPWALQGERPRHSCPGEKLWDHNQHRKIIGYKPASSQDQKIYSGEKSYECAEFG

SEQ ID NO: 2818 - protein, 81 aa, Homo sapiens
MLENYSNLVSVGYHVSKPDVIFKLEQGEEPWIVEEFSNQNYPDIDDALEKNKEIQDKHLTQTVFFSNKTLITERENVFGKT

SEQ ID NO: 2819 - protein, 81 aa, Homo sapiens
QDTVAYEDLSVDYTQKKWKSLTLSQRALQWNMMPENHHSMASLGENMMKGSELTPKQEFFKGSESSNRTSGGLFGVVPGAA

SEQ ID NO: 2820 - protein, 81 aa, Homo sapiens
QGHVTFEDIAVYFSQEEWGLLDEAQRCLYHDVMLENFSLMASVAGLSQSNHKDSCSQQKVPVSLNNCVAQCSPDDGHYDPK

SEQ ID NO: 2821 - protein, 81 aa, Homo sapiens
GELTSSCGSKTMANVSLAFRDVSIDLSQEEWECLDAVQRDLYKDVMLENYSNLVSLGYTIPKPDVITLLEQEKEPWIVMRE

SEQ ID NO: 2822 - protein, 81 aa, Homo sapiens
LKSMVTFEDVAVYFSQEEWELLDAAQRHLYHSVMLENLELVTSLGNALSQHDVFTCSVEADLPNCFPNWLHHFTSLSAVYK

SEQ ID NO: 2823 - protein, 81 aa, Homo sapiens
MLAIGLSLCDHLSQDVFCLHESKFEEERMVAGWLTNYSQDSVTFEDVAVDFTQEEWTLLDQTQRNLYRDVMLENYKNLVAV

SEQ ID NO: 2824 - protein, 81 aa, Homo sapiens
MVEGEEEWQQLNPAQKTLHRDVMLETYNHLVSVGCSGIKPDVIFKLEHGKDPWIIESELSRWIYPDRVKGLESSQQIISGE

SEQ ID NO: 2825 - protein, 81 aa, Homo sapiens
CWGLLSFKDISMGFTWDEWQLLDSTQKYLYRDVILENYHNLISVGYHGTKPDLIFKLEQGEDPWIINAKISRQSCPDGWEE

SEQ ID NO: 2826 - protein, 81 aa, Homo sapiens
WEYLNSDQRDLYRDVMLENYTNLVSLDFNFTTESNKLSSEKRNYEVNAYHQETWKRNKTFNLMRFIFRTDPQYTIEFGRQQ

SEQ ID NO: 2827 - protein, 81 aa, Homo sapiens
VTFEDVTIIFTWEEWKFLDSSQKRLYREVMWENYTNVMSVENWNESYKSQEEKFRYLEYENFSCWQGWWNAGAQMYENQNY

SEQ ID NO: 2828 - protein, 81 aa, Homo sapiens
QLSFSDVAIEFSQEEWKCLDPGQKALYRDVMLENYRNLVSLDFSLLAWDARVFRVEAWRASGGAEEPTGPNFVGNDSPLPS

SEQ ID NO: 2829 - protein, 81 aa, Homo sapiens
TVLTMDHELVTLRDVVINFSQEEWEYLDSAQRNLYWDVMMENYSNLLSLDLESRNETKHLSVGKDIIQNTGSQWEVMESSK

SEQ ID NO: 2830 - protein, 81 aa, Homo sapiens
RSLENDGVCFTEQEWENLEDWQKELYRNVMESNYETLVSLSSSDSPASASRVAEITEVLGQTEGEAELGTEMLGDLEEEGP

SEQ ID NO: 2831 - protein, 81 aa, Homo sapiens
GWLTNYSQDSVTFEDVAVDFTQEEWTLLDQTQRNLYRDVMLENYKNLVAVDWESHINTKWSAPQQNFLQGKTSSVVEMGWV

SEQ ID NO: 2832 - protein, 81 aa, Homo sapiens
PMPGPQEAVVFEDVAVYFTRIEWSCLAPDQQALYRDVMLENYGNLASLALISLLEQGEEPGALILQVAEQSVAKASLCTDS

SEQ ID NO: 2833 - protein, 81 aa, Homo sapiens
FWQYNLVLPSQDPALPQKEQEKMTKFQEMVTFKDVAVVFTREELGLLDLAQRKLYQDVMLENFRNLLSVGYQPFKLDVILQ

SEQ ID NO: 2834 - protein, 81 aa, Homo sapiens
AQGSLSFGDVAVGFTRKEWQQLDLEQRTLYQDVMLEIYSHLLSVGCQVSKPAVISSLEQGKEPWMEEEEIRTWSFPEEVWQ

SEQ ID NO: 2835 - protein, 81 aa, Homo sapiens
VKIEEVADVAVSFILEEWGHLDQSQKSLYRDDRKENYGSITSMGYESRDNMELIVKQISDDSESHWVAPEHTERSVPQDPD

SEQ ID NO: 2836 - protein, 81 aa, Homo sapiens
MIESQEEWQQLNPAQKTLHRDVMLETYNHLVSVGCSGIKPDVIFKLEHGKDPWIIESELSRWIYPDRVKGLESSQQIISGE

SEQ ID NO: 2837 - protein, 81 aa, Homo sapiens
YLGPVTFEDVAVLFTEAEWKRLSLEQRNLYKEVMLENLRNLVSLESKPEVHTCPSCPLAFGSQQFLSQDELHNHPIPGFHA

SEQ ID NO: 2838 - protein, 81 aa, Homo sapiens
QGLLTFRDVAIEFSQEEWKCLDPAQRTLYRDVMLENYRNLVSLGISSKCTMKEFSSTAQGNTEVIHTGTLQRHERHHIGDF

SEQ ID NO: 2839 - protein, 81 aa, Homo sapiens
VHGSVTFRDVAIDFSQEEWECLQPDQRTLYRDVMLENYSHLISLAGSSISKPDVITLLEQEKEPWIVIWSQNMDLRKYLQK

SEQ ID NO: 2840 - protein, 81 aa, Homo sapiens
MDVAIEFSVEEWQCLDTAQQNLYRNVMLENYRNLVFLGIAVSKPDLITCLEQGKEPWNMERHEMVAKPPGMCCYFAQDLRP

SEQ ID NO: 2841 - protein, 81 aa, Homo sapiens
SASRVAETTGTRPHSRDSVTFADVAVNFTKEEWTLLDPAQRNLYRDVMLENSRNLAFIDWATPCKTKDATPQPDILPKRTF

SEQ ID NO: 2842 - protein, 81 aa, Homo sapiens
FQELVTFRDVAIDFSRQEWEYLDPNQRDLYRDVMLENYRNLVSLEMRSRSVARVGLKLLVSSDPPTSAFQNAGIIGVSHHA

SEQ ID NO: 2843 - protein, 81 aa, Homo sapiens
AQGTVTFEDVAVNFTWEEWNLLSEAQRCLYRDVTLENLALISSLGMTFLHVCQALDSLRQVIHPPTSASQSAGITGVSHCA

SEQ ID NO: 2844 - protein, 81 aa, Homo sapiens
YQDAVTFDDVAVDFTQEEWTLLDPSQRDLYRDVMLENYENLASVGHHLFQPSVIYWLEQEEELRAGRRAVLQEWRLKTKGP

SEQ ID NO: 2845 - protein, 81 aa, Homo sapiens
MLENYQNLLALGPPLHKPDVISHLERGEEPWSMQREVPRGPCPEWELKAVPSQQQGICKEEPAQEPIMERPLGGAQAWGRQ

SEQ ID NO: 2846 - protein, 81 aa, Homo sapiens
MATGLLRAKKEEEWRLLSPAQRTLHREVMLETYNHLVSLEIPSSKPKLIAQLERGEAPWREERKCPLDLCPAESKPEIQLS

SEQ ID NO: 2847 - protein, 81 aa, Homo sapiens
LLTFRDVAIEFSQEEWKCLDPAQRTLYRDVMLENYRNLVSLVRRSEVCCTDIWAEVIVADISSKCMLKTLSSTGQGNTEVI

SEQ ID NO: 2848 - protein, 81 aa, Homo sapiens
MLENYFNLTSVGCQVPKPEVIFSLEQEEPCMLDGEIPSQSRPDGDIGFGPLQQRMSEEVSFQSEININLFTRDDPYSILEE

SEQ ID NO: 2849 - protein, 81 aa, Homo sapiens
LESVTFRDVTVDFTQEEWQQLEPAQKDLYRDVMLENYRNLVSLDWETRPEMKELDPKNDISEDKLSVVGEATGGPTRNGAR

SEQ ID NO: 2850 - protein, 81 aa, Homo sapiens
DGLVTFRDVAIDFSQEEWECLDPAQRDLYVDVMLENYSNLVSLDLESKTYETKKIFSENDIFEINFSQWEMKDKSKTLGLE

SEQ ID NO: 2851 - protein, 81 aa, Homo sapiens
PRGSTFFSSVTVAFAQEGWRCLVSTPRDRFKEGIPGKSRSLVLLGLPVSQPGMNSQLEQREGAWMLEGEDLRSPSPGWKII

SEQ ID NO: 2852 - protein, 81 aa, Homo sapiens
MLENYSNLVSVGYCVHKPEVIFRLQQGEEPWKQEEEFPSQSFPEMGFHHVPVAGLKLLSSSDPPALASQSGRITGMSHSIP

SEQ ID NO: 2853 - protein, 80 aa, Homo sapiens
MALSQGLFTFKDVAIEFSQEEWECLDPAQRALYRDVMLENYRNLLSLDEDNIPPEDAFYSIRELRETLVFLIPYSSKICL

SEQ ID NO: 2854 - protein, 81 aa, Homo sapiens
REEAAQKRKGKESGMALPQGRLTFRDVAIEFSLAEWKFLNPAQRALYREVMLENYRNLEAVDISSKHMMKEVLSTGQGNRE

SEQ ID NO: 2855 - protein, 81 aa, Homo sapiens
MNVMLENYKNLVFLGIAVSKQDPITSLEQEKEPWNMKICEMVDESPGYMCRMCSYVFFFYQRPLARARHKRFFSTSDTEKT

SEQ ID NO: 2856 - protein, 81 aa, Homo sapiens
MEPLTFRDVAIEFSPEEWKCLDPAQQNLYRDVMLENYRNLVSLAMCSHFTQDFLPVQGIEDSFHKLILRRYEKFSSLISSC

SEQ ID NO: 2857 - protein, 81 aa, Homo sapiens
NLQREVIESSHQAQWLTPVIPALWEAKADGASQMFQDPVACEDVAVNFTQEEWALLDISQRKLYREVMLETFRNLTSIGVS

SEQ ID NO: 2858 - protein, 81 aa, Homo sapiens
EMGPLTFMDVAIEFCLEEWQCLDIAQQNLYRNVMLENYRNLVFLGIAVSKPDLITCLEQEKEPWEPMRRHEMVAKPPVMCS

SEQ ID NO: 2859 - protein, 81 aa, Homo sapiens
EDYTQKKWKGLALSQRALHWNMMLENDRSMASLAGRNMMESSELTPKQEIFKGSESSNSTSGGLFGVVPGGTETGDVCEDT

SEQ ID NO: 2860 - protein, 81 aa, Homo sapiens
MLENYRNLVSLGICLPDLSIISMMKQRTEPWTVENEMKVAKNPDRWEGIKDINTGRSCAVRSKAGNKPITNQLGLTFQLPL

SEQ ID NO: 2861 - protein, 81 aa, Homo sapiens
QGLLTFRDVAIEFSQEEWKCLDPAQRTLYRDVMLENYRNLVSLGQGNTEVIHTGTLQRQASYHIGAFCSQEIEKDIHDFVF

SEQ ID NO: 2862 - protein, 81 aa, Homo sapiens
QGRLTFRDVAIEFSLEEWKCLNPAQRALYRAVMLENYRNLEFVDISSKCMMKEFSSTAQGNTEVIHTGTLQRHESHHIRDF

SEQ ID NO: 2863 - protein, 81 aa, Homo sapiens
PQKSVTFEDVAVYFTQAEWDGLSPAQRTLYRDVMLENYGNVASLGFPLLKPAVISQLEGGSELGGSSPLAAGTGLQGLQTV

SEQ ID NO: 2864 - protein, 81 aa, Homo sapiens
MLENYGNVASLGFPLLKPAVISQLEGGIDIQTDNDLTKEMYEGKENVSFELQRDFSQETDFSEASLLEKQQEVHSAGNIKK

SEQ ID NO: 2865 - protein, 81 aa, Homo sapiens
SVAFEDVAVNFTHEEWALLGPSQKNLYRDVMRETIRNLNCIGMKWENQNIDDQHQNLRRNPRLSETWLQNFILIHYGHLVA

SEQ ID NO: 2866 - protein, 81 aa, Homo sapiens
PHLLVTFRDVAIDFSQEEWECLDPAQRDLYRDVMLENYSNLISLEPARTREEQHNLPVPKAGSVNLAAGFGHSRSQTGCGS

SEQ ID NO: 2867 - protein, 81 aa, Homo sapiens
PPPAPLLAPRPGETRPGCRKPGTVSFADVAVYFSPEEWGCLRPAQRALYRDVMQETYGHLGALGESPGSEPPPPSPGSQGR

SEQ ID NO: 2868 - protein, 81 aa, Homo sapiens
MLENYRNLASLGISCFDLSIISMLEQGKEPFTLESQVQIAGNPDGWEWIKAVITALSSEFVMKDLLHKGKSNTGEVFQTVM

SEQ ID NO: 2869 - protein, 81 aa, Homo sapiens
SQESVTFQDVAVDFTEEEWPLLDSSQRKLYKDVMLENYSNLTSLGYQVGKPSLISHLEQEEEPRTEERGAHQGACADWETP

SEQ ID NO: 2870 - protein, 81 aa, Homo sapiens
QGLLTFRDVAIEFSQEEWKCLDPAQRTLYRDVMLENYRNLVSLDTGFLLFCLADLKLLPSGDPSTSASETAAITDISSKCM

SEQ ID NO: 2871 - protein, 81 aa, Homo sapiens
MLETYSSLVSLGHYITKPEMIFKLEQGAEPWIVEETPNLRLSAVQIIDDLIERSHESHDRFFWQIVITNSNTSTQERVELG

SEQ ID NO: 2872 - protein, 81 aa, Homo sapiens
SLELVSFEEVAVHFTWEEWQDLDDAQRTLYRDVMLETYSSLVSLGHYITKPEMIFKLEQGAEPWIVEETPNLRLSGGSKKQ

SEQ ID NO: 2873 - protein, 81 aa, Homo sapiens
MLENYRNLVFVGIAASKPDLITCLEQGKEPWNVKRHEMVTEPPVVYSYFAQDLWPKQGKKNYFQKVILRTYKKCGRENLQL

SEQ ID NO: 2874 - protein, 81 aa, Homo sapiens
MLENFGNLTALGYPVPKPALISLLERGDMAWGLEAQDDPPAERTKNVCKDVETNIDSESTLIQGISEERDGMMSHGQLKSV

SEQ ID NO: 2875 - protein, 81 aa, Homo sapiens
MGLLTFRDVAVEFSLEEWEHLEPAQKNLYQDVMLENYRNLVSLGLVVSKPDLLTEHCTEASFQKVISRRHGSCDLENLHLR

SEQ ID NO: 2876 - protein, 81 aa, Homo sapiens
RLIRDQDLGASLLPAAPQWRQLDSTQKEQYWDLMLETYGKMVSGGISHPKSDLTNSIEFGEELAGIYLHVNEKIPRPTCIG

SEQ ID NO: 2877 - protein, 81 aa, Homo sapiens
MPQVTFNDVAIDFTHEEWGWLSSAQRDLYKDVMVQNYENLVSVAGLSVTKPYVITLLEDGKEPWMMEKKLSKDWESRWENK

SEQ ID NO: 2878 - protein, 81 aa, Homo sapiens
AQELLTLEDVTVEFTWEEWQLLGPFQKDLYRDVMLEIYSNLLSMGYQVSKPDALSKLERGEEPWTMEDERHSRICSENNEV

SEQ ID NO: 2879 - protein, 81 aa, Homo sapiens
PPCPFPFGNWGRLSPVLHTSRHADTVVFSAAHTAGFLVFKPELISRLEQGEEPWVLDLQGAEGTEAPRTSKTDSTIRTENE

SEQ ID NO: 2880 - protein, 81 aa, Homo sapiens [sequence omitted]

SEQ ID NO: 2881 - protein, 81 aa, Homo sapiens
DSVTFEDVAVDFTQEEWTLLDQTQRNLYRDVMLENYKNLVAVDWESHINTKWSAPQQNFLQGKTSSVVEMRCGLAVLPRLV

SEQ ID NO: 2882 - protein, 81 aa, Homo sapiens
SQEPVTFADVAVVFTPEEWVFLDSTQRSLYRDVMLENYRNLASVADQLCKPNALSYLEERGEQWTTDRGVLSDTCAEPQCQ

SEQ ID NO: 2883 - protein, 81 aa, Homo sapiens
QGLLTFRDVAIEFSQEEWKCLDPAQRTLYRDVMLENYRNLVSLDGVFALVAQAGVQWHNLGSPPPPPPGFKRFSRLSLRSC

SEQ ID NO: 2884 - protein, 81 aa, Homo sapiens
TGLSISKPNMISLLEQGKEPWMVERKMSQGHCADWESWCEIEELSPKWFIDEDEISQEMVMERLASHGLECSSFREAWKYK

SEQ ID NO: 2885 - protein, 81 aa, Homo sapiens
QGLLTFRDVAIEFSQEEWKCLDPAQRTLYRDVMLENYRNLVSLGHDLILFFLFPRWSFCSCCPGWSAVAQSRLTTTSASRV

SEQ ID NO: 2886 - protein, 81 aa, Homo sapiens
MYLIRESHASGSSSVTSSCSLPSESPTLRQWRPCSCLPHPKPGVISQLERGDEPWVLDVQGTSGKEHLRVNSPALGTRTEY

SEQ ID NO: 2887 - protein, 81 aa, Homo sapiens
QPLPGTPRQKQKSRRIEKVLEWLFISQEQPKITKSWGPLSFMDVFVDFTWEEWQLLDPAQKCLYRSVMLENYSNLVSLGYQ

SEQ ID NO: 2888 - protein, 81 aa, Homo sapiens
QSTGSARTVQWPGRRREEWGLLNVTQKGLYRDVMLENFALVSSLGLAPSRSPVFTQLEDDEQSWVPSWVDVTPVSRAEARR

SEQ ID NO: 2889 - protein, 81 aa, Homo sapiens
MLDTFRLLVSVGHWLPKPNVISLLEQEAELWAVESRLPQGVYPDLETRPKVKLSVLKQGISEEISNSVILVERFLWDGLWY

SEQ ID NO: 2890 - protein, 81 aa, Homo sapiens
MGPLTFMDVAIEFSLEEWQCLDTAQRNVYRHVMLENYRNLVFLDLITCLEQGKEPWNMKRHEMVVAKHSALCSRFAQDLWL

SEQ ID NO: 2891 - protein, 81 aa, Homo sapiens
PQGLVTFEDVAVDFTQEEWQYLNPPQRTLYRDVMLETYSNLVFVGQQVTKPNLILKLEVEECPAEGKIPFWNFPVCQVDEQ

SEQ ID NO: 2892 - protein, 80 aa, Homo sapiens
MELLTFRDVAIEFSPEEWKCLDPAQQNLYRDVMLENYRNLVSLELHTEHHQRTDGHFISLGEGQVYHAVMAIPASIGVWV

SEQ ID NO: 2893 - protein, 81 aa, Homo sapiens
AHALVTFRDVAIDFSQKEWECLDTTQRKLYRDVMLENYNNLVSLAGYSGSKPDVITLLEQGKEPCVVARDVTGRQCPGLLS

SEQ ID NO: 2894 - protein, 81 aa, Homo sapiens
MLENYSNLVAVGYQASKPDALFKLEQGEQLWTIEDGIHSGACSDIWKVDHVLERLQSESLVNRRKPCHEHDAFENIVHCSK

SEQ ID NO: 2895 - protein, 81 aa, Homo sapiens
PQGLLTFRDVAIEFSQEEWKCLDPAQRTLYRDVMLENYRNLVSLDFRSVTQAKVQWCHLGSLQPPLPRFKQFSCLSLPSSW

SEQ ID NO: 2896 - protein, 81 aa, Homo sapiens
EFSLEEWQCLDTAQQDLYRKVMLENYRNLVFLAGIAVSKPDLVTCLEQGKDPWNMKGHSTVVKPPGGDCSIFLMEHQGDVT

SEQ ID NO: 2897 - protein, 81 aa, Homo sapiens
QMDLVTFDSVAVEFTQEEWTLLDPAQRNLYSDVMLENYKNLSSVGYQLFKPSLISWLEEEEELSTLPRVLQEWKMCLKTKG

SEQ ID NO: 2898 - protein, 81 aa, Homo sapiens
DTVAYEDLSVDYTQKKWKSLTLSQRALQWNMMPENHHSMASLAGENMMKGSELTPKQEFFKGSESSNRTSGGLFGVVPGAA

SEQ ID NO: 2899 - protein, 81 aa, Homo sapiens
QEPVTFKDVVVEFSKEEWGQLDSAVKNLYRNVMLENFRNLNSLRKAHLLSKPFESLKLESKKKRWIMEKEIPRKTIFDMKS

SEQ ID NO: 2900 - protein, 81 aa, Homo sapiens
SCESITLKDVAVNFSRGEWKKLEPFQKELYKEVLLENLRNLEFLDFPVSKLELISQLKWVELPWLLEEVSKSSRLDESALD

SEQ ID NO: 2901 - protein, 81 aa, Homo sapiens
GMVTFEDTAVSLTWEEWERLDPARRDFCRESAQKDSGSTVPPSLESRVENKELIPMQQILEEAEPQGQLQEAFQGKRPLFS

SEQ ID NO: 2902 - protein, 81 aa, Homo sapiens
ETQPGLVTIKNLAVDFRQQLHPAQKNFCKNGIWENNSDLGSAGHCVAKPDLVSLLEQEKEPWMVKRELTGSLFSGQRSVHE

SEQ ID NO: 2903 - protein, 81 aa, Homo sapiens
IRDQDLGASLLPAAPQEQWRQLDSTQKEQYWDLMLETYGKMVSGAGISHPKSDLTNSIEFGEELAGIYLHVNEKIPRPTCI

SEQ ID NO: 2904 - protein, 81 aa, Homo sapiens
QLQETMTFKDVEVTFSQDEWGWLDSAQRNLYRDVMLENYRNMASLVGPFTKPALISWLEAREPWGLNMQAAQPKGNPVAAP

SEQ ID NO: 2905 - protein, 81 aa, Homo sapiens
SSLTTHQRTHTREQPYEYNESFYQNPNFTKCQRDNIEETLVNILKAQKPSPSWTRSIAETTQVGGSVSLKDVTVDFTQEEW

SEQ ID NO: 2906 - protein, 81 aa, Homo sapiens
IRDQDLGASLLSAAPQEQWRQLDSTQKEQYWDLMLETYGKMVSGAGISHPKSDLTNSIEFGEELAGIYLHVNEKIPRPTCI

SEQ ID NO: 2907 - protein, 81 aa, Homo sapiens
IRDQDLGASLLPAAPQEQWRQLDSTQKEQYWDLMLETYGKMVSGGISHPKSDLTNSIEFGEELAGILSLFFTKELTPERHT

SEQ ID NO: 2908 - protein, 81 aa, Homo sapiens
TESCESITLKDVAVNFSRGEWKKLEPFQKELYKEVLLENLRNLEFLDFPVSKLELISQLKWVELPWLLEEVSKSSRLGSVI

SEQ ID NO: 2909 - protein, 81 aa, Homo sapiens
GHQEPASTSFHPPRIQEEWGLLDRSQKELYWDAMLEKYGTVVSLGLPPHQPEAQAQSELGMLLTGTGVCRSLRSETRLEPA

SEQ ID NO: 2910 - protein, 81 aa, Homo sapiens
SWGPLSFMDVFVDFTWEEWQLLDPAQKCLYRSVMLENYSNLVSLGYQHTKPDIIFKLEQGEELCLVQAQVPNQTCPILKAG

SEQ ID NO: 2911 - protein, 81 aa, Homo sapiens
SQSLLTFEEVAMYFSQEEWELLDPTQKALYNDVMQENYETVISLALFVLPKPKVISCLEQGEEPWVQVSPEFKDSAGKSPT

SEQ ID NO: 2912 - protein, 81 aa, Homo sapiens
DFAQCTSPVPTLPQVGNSGDQAGATVLRMVRPQDTVAYEDLSVDYTQKKWKSLTLSQRALQWNMMPENHHSMASLGWSTMA

SEQ ID NO: 2913 - protein, 81 aa, Homo sapiens
SQEPVTFADVAVVFTPEEWVFLDSTQRSLYRDVMLENYRNLASVADQLCKPNALSYLEERGEQWTTDRGVLPDTCAEPQCQ

SEQ ID NO: 2914 - protein, 81 aa, Homo sapiens
VKIEEAADVAVSFILEEWGHLDQSQKSLYRDDRKENYGSITSMGYESRDNMELIVKQISDDSESHWVAPEHTERSVPQDPD

SEQ ID NO: 2915 - protein, 81 aa, Pan paniscus
MAKRPGPPGSREMGLLTFRDIAIEFSLAEWQCLDLAQQNLYRDVMLENYRNLVSLGIAVSKPDLITCLEQNKEPQNIKRNE

SEQ ID NO: 2916 - protein, 81 aa, Pan paniscus
MAKRPGPPGSREMGLLTFRDIAIEFSLEEWQCLDCAQRNLYRDVMLENYRNLVSLGIAVSKPDLITCLEQNKESQNIKRNK

SEQ ID NO: 2917 - protein, 81 aa, Pan paniscus
EPGSLHSGHQEQLNRKRERRPLPKNARPSPWVPALADEWNTLDQEVTTTRLPAGSQEPVKDVHVARGFSYRKSVHQIPAQR

SEQ ID NO: 2918 - protein, 81 aa, Pan paniscus
NTLDQEVTTTRLPAGSQEPVKDVHVARGFSYRKSVHQIPAQRDLYRDFRKENVGNVVSLGSAVSTSNKITRLEQRKEPWTL

SEQ ID NO: 2919 - protein, 81 aa, Pan paniscus
GPVSFKDVAVDFTQEEWQQLDPDEKIAYGDVMLENYSHLVSVGYDYHQAKHHHGVEVKEVEQGEEPWIMEGEFPCQHSPDL

SEQ ID NO: 2920 - protein, 81 aa, Pan paniscus
MNTLQGPVSFKDVAVDFTQEEWQQLDPDEKIAYGDVMLENYSHLVSVGYDYHQAKHHHGVEVKEVEQGEEPWIMEGEFPCQ

SEQ ID NO: 2921 - protein, 81 aa, Pan paniscus
GPVSFKDVAVDFTQEEWQQLDPDEKIAYGDVMLENYSHLVSVGYDYHQAKHHHGVEVKEVEQGEEPWIMEGEFPCQHSPVQ

SEQ ID NO: 2922 - protein, 81 aa, Pan paniscus
KENLEDISGWGLPEARSKESVSFKDVAVDFTQEEWGQLDSPQRALYRDVMLENYQNLLALGPPLHKPDVISHLERGEEPWS

SEQ ID NO: 2923 - protein, 81 aa, Pan paniscus
KENLEDISGWGLPEARSKESVSFKDVAVDFTQEEWGQLDSPQRALYRDVMLENYQNLLALEWELKAVPSQQQGICKEEPAQ

SEQ ID NO: 2924 - protein, 81 aa, Pan paniscus
MLVAAAAERNKDPILHVLQQYLDPAQRGVRVLEVASGSGQHAAHFARAFPLAEWQPSDVDQRCLDRNPEWGLRDTALLEDL

SEQ ID NO: 2925 - protein, 81 aa, Pan paniscus
VLQQYLDPAQRGVRVLEVASGSGQHAAHFARAFPLAEWQPSDVDQRCLDRNPEWGLRDTALLEDLGKANGLLLERMVDMPA

SEQ ID NO: 2926 - protein, 81 aa, Pan paniscus
RGVRVLEVASGSGQHAAHFARAFPLAEWQPSDVDQRCLDRNPEWGLRDTALLEDLGKANGLLLERMVDMPANNKCLIFRKN

SEQ ID NO: 2927 - protein, 81 aa, Pan paniscus
MLVAAAAERNKDPILHVLQQYLDPAQRGVRVLEVASGSGQHAAHFARAFPLAEWQPSDVDQRCLDRGSSEQQDTCSNPGPC

SEQ ID NO: 2928 - protein, 81 aa, Pan paniscus
LQQYLDPAQRGVRVLEVASGSGQHAAHFARAFPLAEWQPSDVDQRCLDRGSSEQQDTCSNPGPCSSPMGPMPSMGRSTPRA

SEQ ID NO: 2929 - protein, 81 aa, Pan paniscus
AAAERNKDPILHVLQQYLDPAQRGVRVLEVASGSGQHAAHFARAFPLAEWQPSDVDQRCLDRGSSEQQDTCSNPGPCSSPM

SEQ ID NO: 2930 - protein, 81 aa, Pan paniscus
LQQYLDPAQRGVRVLEVASGSGQHAAHFARAFPLAEWQPSDVDQRCLDRGSSEQQDTCSNPGPCSSPMGEGLPFHSPNPSL

SEQ ID NO: 2931 - protein, 81 aa, Pan paniscus
SDVDQRCLDRGSSEQQDTCSNPGPCSSPMGEGLPFHSPNPSLQVCPRLSGKYPDLGPVGCVPMPTALCHQWEDLPPEQRGL

SEQ ID NO: 2932 - protein, 81 aa, Pan paniscus
MAAALLMAGSQAPVTFEDMAMYLTREEWRPLDAAQRDLYRDVMQENYGNVVSLDFEIRSENEVNPKQEISEDVQFGTTSER

SEQ ID NO: 2933 - protein, 81 aa, Pan paniscus
FGTTSERPAENAEENPESEEGFESGDRSERQWGDLTAEEWVSYPLQQVTDLLVHKEVHTGIRYHICSHCGKAFSQISDLNR

SEQ ID NO: 2934 - protein, 81 aa, Pan paniscus
GESLESRVTLGSLTAESQELLTFKDVSVDFTQEEWGQLAPAHRNLYREVMLENYGNLVSVGCQLSKPGVISQLEKGEEPWL

SEQ ID NO: 2935 - protein, 81 aa, Pan paniscus
RESLEDEVTPGLPTAESQELLTFKDISIDFTQEEWGQLAPAHQNLYREVMLENYSNLVSVGYQLSKPSVISQLEKGEEPWM

SEQ ID NO: 2936 - protein, 81 aa, Pan paniscus
EEPWMAEKEGPGDPSSDLKSKIETIESTAKSAISQERLYHGIMMESFMRDDIIYSTLRKVSTYDDVLERHQETCMRDVRQA

SEQ ID NO: 2937 - protein, 81 aa, Pan paniscus
QRESLEDEVTPGLPTAESQELLTFKDISIDFTQEEWGQLAPAHQNLYREVMLENYSNLVSVAGYQLSKPSVISQLEKGEEP

SEQ ID NO: 2938 - protein, 81 aa, Pan paniscus
RESLEDEVTPGLPTAESQELLTFKDISIDFTQEEWGQLAPAHQNLYREVMLENYSNLVSVDLKSKIETIESTAKSAISQER

SEQ ID NO: 2939 - protein, 81 aa, Pan paniscus
LYREVMLENYSNLVSVDLKSKIETIESTAKSAISQERLYHGIMMESFMRDDIIYSTLRKVSTYDDVLERHQETCMRDVRQA

SEQ ID NO: 2940 - protein, 81 aa, Pan paniscus
MISFQESVTFQDVAVDFTAEEWQLLDCAERTLYWDVMLENYRNLISVGCPITKTKVILKVEQGQEPWMVEEVNPHESSPES

SEQ ID NO: 2941 - protein, 81 aa, Pan paniscus
MISFQESVTFQDVAVDFTAEEWQLLDCAERTLYWDVMLENYRNLISVGCPITKTKVILKVEQGQEPWMVEEVNPHESSPGW

SEQ ID NO: 2942 - protein, 81 aa, Pan paniscus
EDGPADMQKVRICSEGGWVPALFDEVAIYFSDEEWEVLTEQQKALYREVMRMNYETVLSLEFPFPKPDMITRLEGEEESQN

SEQ ID NO: 2943 - protein, 81 aa, Pan paniscus
QKALYREVMRMNYETVLSLEFPFPKPDMITRLEGEEESQNSDEWQLQGGTSAENEESDVKPPDWPNPMNATSQFPQPQHFD

SEQ ID NO: 2944 - protein, 81 aa, Pan paniscus
EDGPADMQKVRICSEGGWVPALFDEVAIYFSDEEWEVLTEQQKALYREVMRMNYETVLSLENEESDVKPPDWPNPMNATSQ

SEQ ID NO: 2945 - protein, 81 aa, Pan paniscus
NSFPQVILLPNPPKVLRLQGLLAFSDVVIEFSPEEWACLDPAQRNLYRDVMFENYRNLVSLAILSYSIQDLLPEQDMKDLC

SEQ ID NO: 2946 - protein, 81 aa, Pan paniscus
AQRNLYRDVMFENYRNLVSLAILSYSIQDLLPEQDMKDLCQKVTLTRHRSWGLDNLHLVKDWRTVNEGKGQKEYCNRLTQC

SEQ ID NO: 2947 - protein, 81 aa, Pan paniscus
MGLLAFRDVALEFSPEEWECLDPAQRSLYRDVMLENYRNLISLGLAMSKPELIICLEARKEPWNVNTEKTAKHSALSSYLT

SEQ ID NO: 2948 - protein, 81 aa, Pan paniscus
EARKEPWNVNTEKTAKHSALSSYLTEDILPEQGLQVSFQKVMLRRYERCCLEKLRLRNDWEIVVETGFHRVSQDGLDLLTS

SEQ ID NO: 2949 - protein, 81 aa, Pan paniscus
MGLLAFRDVALEFSPEEWECLDPAQRSLYRDVMLENYRNLISLGLAMSKPELIICLEARKEPWNVNTEKTAKHSVETRFRH

SEQ ID NO: 2950 - protein, 81 aa, Pan paniscus
ISLGLAMSKPELIICLEARKEPWNVNTEKTAKHSALSSYLTEDILPEQGLQVSFQKVMLRRYERCCLEKLRLRNDWEIVAM

SEQ ID NO: 2951 - protein, 81 aa, Pan paniscus
MGLLAFRDVALEFSPEEWECLDPAQRSLYRDVMLENYRNLISLGEDNFNMQFLFHSLAMSKPELIICLEARKEPWNVNTEK

SEQ ID NO: 2952 - protein, 81 aa, Pan paniscus
LFHSLAMSKPELIICLEARKEPWNVNTEKTAKHSALSSYLTEDILPEQGLQVSFQKVMLRRYERCCLEKLRLRNDWEIVAM

SEQ ID NO: 2953 - protein, 81 aa, Pan paniscus
RKEPWNVNTEKTAKHSALSSYLTEDILPEQGLQVSFQKVMLRRYERCCLEKLRLRNDWEILCEDVLASPLPSAMIVSFLRP

SEQ ID NO: 2954 - protein, 81 aa, Pan paniscus
MDSVSFEDVAVAFTQEEWALLDPSQKNLYRDVMQEIFRNLASVGNKSEDQNIQDDFKNPGRNLSSHVVERLFEIKEGSQYG

SEQ ID NO: 2955 - protein, 81 aa, Pan paniscus
MDSVAFEDVAVNFTQEEWALLDSSQKNLYREVMQETCRNLASVGSQWKDQNIEDHFKKPGKDIRNHIVQRLCESKEGGQYG

SEQ ID NO: 2956 - protein, 81 aa, Pan paniscus
RHFRRPEPCREPRASPTQDSVAFEDVAVNFTQEEWALLDSSQKNLYREVMQETCRNLASVGSQWKDQNIEDHFKKPGKDIR

SEQ ID NO: 2957 - protein, 81 aa, Pan paniscus
AEPLHPVCTCGRHFRRPEPCREPRASPTQDSVAFEDVAVNFTQEEWALLDSSQKNLYREVMQETCRNLASVEIISYRDCVK

SEQ ID NO: 2958 - protein, 81 aa, Pan paniscus
MSGHPGSWEMNSVAFEDVAVNFTQEEWALLDPSQKNLYRDVMQETFRNLASIGNKGEDQSIEDQYKNSSRNLSSFQIHQRN

SEQ ID NO: 2959 - protein, 81 aa, Pan paniscus
MSGHPGSWEMNSVAFEDVAVNFTQEEWALLDPSQKNLYRDVMQETFRNLASIGNKGEDQSIEDQYKNSSRNLRHIISHSGN

SEQ ID NO: 2960 - protein, 81 aa, Pan paniscus
LQEENVRDTQQVTTLQLPPSRVSPFKDMILCFSEEDWSLLDPAQTGFYGEFIIGEDYGVSMPPNDLAAQPDLSQGEENEPR

SEQ ID NO: 2961 - protein, 81 aa, Pan paniscus
LGSGGKKAQIISVLSQIYVSRVSPFKDMILCFSEEDWSLLDPAQTGFYGEFIIGEDYGVSMPPNDLAAQPDLSQGEENEPR

SEQ ID NO: 2962 - protein, 81 aa, Pan paniscus
MNKSQEQVSFKDVCVDFTQEEWYLLDPAQKILYRDVILENYSNLVSVGYCITKPEVIFKIEQGEEPWILEKGFPSQCHPER

SEQ ID NO: 2963 - protein, 81 aa, Pan paniscus
MNKFQGPVTLKDVIVEFTKEEWKLLTPAQRTLYKDVMLENYSHLVSVGYHVNKPNAVFKLKQGKEPWILEVEFPHRGFPED

SEQ ID NO: 2964 - protein, 81 aa, Pan paniscus
SNWMSSPLYSTEVEQKSQESVSFKDVTVGFTQEEWQHLDPSQRALYRDVMLENYSNLVSVGYCVHKPEVIFRLQQGEEPWK

SEQ ID NO: 2965 - protein, 81 aa, Pan paniscus
MANATRGSGVEQKSQESVSFKDVTVGFTQEEWQHLDPSQRALYRDVMLENYSNLVSVGYCVHKPEVIFRLQQGEEPWKLEE

SEQ ID NO: 2966 - protein, 81 aa, Pan paniscus
MNKVEQKSQESVSFKDVTVGFTQEEWQHLDPSQRALYRDVMLENYSNLVSVGYCVHKPEVIFRLQQGEEPWKLEEEFPSQS

SEQ ID NO: 2967 - protein, 81 aa, Pan paniscus
SPSFQEQNKMNKVEQKSQESVSFKDVTVGFTQEEWQHLDPSQRALYRDVMLENYSNLVSVGYCVHKPEVIFRLQQGEEPWK

SEQ ID NO: 2968 - protein, 81 aa, Pan paniscus
MITSQGSVSFRDVTVGFTQEEWQHLDPAQRTLYRDVMLENYSHLVSVGYCIPKPEVILKLEKGEEPWILEEKFPSQSHLGS

SEQ ID NO: 2969 - protein, 81 aa, Pan paniscus
MITSQGSVSFRDVTVGFTQEEWQHLDPAQRTLYRDVMLENYSHLVSVGYCIPKPEVILKLEKGEEPWILEEKFPSQSHLEL

SEQ ID NO: 2970 - protein, 81 aa, Pan paniscus
MITSQGSVSFRDVTVGFTQEEWQHLDPAQRTLYRDVMLENYSHLVSVGYCIPKPEVILKLEKGEEPWILEEKFPSQSHLGC

SEQ ID NO: 2971 - protein, 81 aa, Pan paniscus
HLDPSQRALYRDVMLENYSNLVSVGYCAHKPEVIFRLEQGEEPWRLEEEFPSQSFPEVWTADHLKERSQENQSKHLWEVVF

SEQ ID NO: 2972 - protein, 81 aa, Pan paniscus
MSAVDQKFQGSVSFKDVTVGFTQEEWQHLDPSQRALYRDVMLENYSNLVSVGYCAHKPEVIFRLEQGEEPWRLEEEFPSQS

SEQ ID NO: 2973 - protein, 81 aa, Pan paniscus
MSKVDQKFQGSVSFKDVTVGFTQEEWQHLDPSQRALYRDVMLENYSNLVSVGYCAHKPEVIFRLEQGEEPWRLEEEFPSQS

SEQ ID NO: 2974 - protein, 81 aa, Pan paniscus
MANATRRESEVDQKFQGSVSFKDVTVGFTQEEWQHLDPSQRALYRDVMLENYSNLVSVGYCAHKPEVIFRLEQGEEPWRLE

SEQ ID NO: 2975 - protein, 81 aa, Pan paniscus
MPGQLVRSLALSPRLKCRGSVSFSDVAVGFTQEEWQHLDHAQRTPYRDVMLENYSLLLSVGYCITKPEVFCKLEHGQVLWI

SEQ ID NO: 2976 - protein, 81 aa, Pan paniscus
VMLENYSLLLSVGYCITKPEVFCKLEHGQVLWILEEESPSQSHLDCCIDDDLMEKRQENQDQHLQKVDFVNNKTLTMDRNG

SEQ ID NO: 2977 - protein, 81 aa, Pan paniscus
MAPRAQIQGPLTFGDVAVAFTRIEWRHLDAAQRALYRDVMLENYGNLVSVGLLSSKPKLITQLEQGAEPWTEVREAPSGTH

SEQ ID NO: 2978 - protein, 81 aa, Pan paniscus
RDVMLENYGNLVSVGLLSSKPKLITQLEQGAEPWTEVREAPSGTHAVQDYWFETKMSALKQSTSEGSVLGERTKSVMMEKG

SEQ ID NO: 2979 - protein, 81 aa, Pan paniscus
MTLLTFRDVAIEFSLEEWKCLDLAQQNLYRDVMLENYRNLFSVGLTVSKPGLITCLEQRKEPWNVKRQEAADGHPAMSSHF

SEQ ID NO: 2980 - protein, 81 aa, Pan paniscus
SHFTQDLLPEQGIQDAFPKTILRGYGNCGLDNLYLRKDWESLDECKLQKDYNGLNQCSSTTHSKIFQYNKYVKIFDNFSNL

SEQ ID NO: 2981 - protein, 81 aa, Pan paniscus
MTLLTFRDVAIEFSLEEWKCLDLAQQNLYRDVMLENYRNLFSVGLTVSKPGLITCLEQRKEPWNVKRQEAADGHPEMGFHH

SEQ ID NO: 2982 - protein, 81 aa, Pan paniscus
MAGAQTLLTFRDVAIEFSLEEWKCLDLAQQNLYRDVMLENYRNLFSVGLTVSKPGLITCLEQRKEPWNVKRQEAADGHPAM

SEQ ID NO: 2983 - protein, 81 aa, Pan paniscus
MAGAQTLLTFRDVAIEFSLEEWKCLDLAQQNLYRDVMLENYRNLFSVGLTVSKPGLITCLEQRKEPWNVKRQEAADGHPEM

SEQ ID NO: 2984 - protein, 81 aa, Pan paniscus
SSHFTQDLLPEQGIQDAFPKTILRGYGNCGLDNLYLRKDWESLDECKLQKDYNGLNQCSSTTHSKIFQYNKYVKIFDNFSN

SEQ ID NO: 2985 - protein, 81 aa, Pan paniscus
MAGAQTLLTFRDVAIEFSLEEWKCLDLAQQNLYRDVMLENYRNLFSVGLTVSKPGLITCLEQRKEPWNVKRQEAADGHPDI

SEQ ID NO: 2986 - protein, 81 aa, Pan paniscus
MAGAQTLLTFRDVAIEFSLEEWKCLDLAQQNLYRDVMLENYRNLFSVGLTVSKPGLITCLEQRKEPWNVKRQEAADGHPAL

SEQ ID NO: 2987 - protein, 81 aa, Pan paniscus
MTLLTFRDVAIEFSLEEWKCLDLAQQNLYRDVMLENYRNLFSVGLTVSKPGLITCLEQRKEPWNVKRQEAADGHPGWCSGV

SEQ ID NO: 2988 - protein, 81 aa, Pan paniscus
VSVDKFTAMSSHFTQDLLPEQGIQDAFPKTILRGYGNCGLDNLYLRKDWESLDECKLQKDYNGLNQCSSTTHSKIFQYNKY

SEQ ID NO: 2989 - protein, 81 aa, Pan paniscus
VSKPGLITCLEQRKEPWNVKRQEAADGHPAMSSHFTQDLLPEQGIQDAFPKTILRGYGNCGLDNLYLRKDWESLDECKLQK

SEQ ID NO: 2990 - protein, 81 aa, Pan paniscus
MPWAERNLLVYSSSKETLLTFRDVAIEFSLEEWKCLDLAQQNLYRDVMLENYRNLFSVGLTVSKPGLITCLEQRKEPWNVK

SEQ ID NO: 2991 - protein, 80 aa, Pan paniscus
MTLLTFRDVAIEFSLEEWKCLDLAQQNLYRDVMLENYRNLFSVGLTVSKPGLITCLEQRKEPWNVKRQEAADGHPASANV

SEQ ID NO: 2992 - protein, 81 aa, Pan paniscus
MTLLTFRDVAIEFSLEEWKCLDLAQQNLYRDVMLENYRNLFSVGLTVSKPGLITCLEQRKEPWNVKRQEAADGHPEFHSIT

SEQ ID NO: 2993 - protein, 81 aa, Pan paniscus
PGLITCLEQRKEPWNVKRQEAADGHPEFHSITQAVVQWRHLSSLQPLPPGLEPSSHFSLLRTWNYRGTPPHPANFCVFNRD

SEQ ID NO: 2994 - protein, 81 aa, Pan paniscus
MAGAQTLLTFRDVAIEFSLEEWKCLDLAQQNLYRDVMLENYRNLFSVGLTVSKPGLITCLEQRKEPWNVKRQEAADGHPGP

SEQ ID NO: 2995 - protein, 81 aa, Pan paniscus
QMGSIKEKMKAGSRTGKPQEPVTFKDVVVEFSKEEWGQLDSAVKNLYRNVMLENFRNLNSLRKAHLLSKPFESLKLESKKK

SEQ ID NO: 2996 - protein, 81 aa, Pan paniscus
MAVTFEDVTIIFTWEEWKFLDSSQKRLYREVMWENYTNVMSVENWNESYKSQEEKFRYLEYENFSCWQGWWNAGAQMYENQ

SEQ ID NO: 2997 - protein, 81 aa, Pan paniscus
PRKNLSMVKEQKLIVEHSYIPVEEALPQYVGVICQKDLLRDSMEEKYCGCNKCKEIYYWNSRCVFHKRNQPGENLYQCSIR

SEQ ID NO: 2998 - protein, 81 aa, Pan paniscus
ERSSGDSEMVALLTALSQGLVTFKDVAVCFSQDQWSDLDPTQKEFYGEYVLEEDCGIVVSLSFPIPRPDEISQVREEEPWV

SEQ ID NO: 2999 - protein, 81 aa, Pan paniscus
CTTENLFEEPLGISHTEQGLVTFKDVAVCFSQDQWSDLDPTQKEFYGEYVLEEDCGIVVSLSFPIPRPDEISQVREEEPWV

SEQ ID NO: 3000 - protein, 81 aa, Pan paniscus
GNTGDWEMAAALLAAGSQGLVTIKDVSLCFSQEEWRSLDPSQTDFYGEYVMQENCGIVVSLRFPIPKLDMLSQLEGGEEQW

SEQ ID NO: 3001 - protein, 81 aa, Pan paniscus; identical to SEQ ID NO: 2381

SEQ ID NO: 3002 - protein, 81 aa, Pan paniscus
MIQSQISFEDVAVDFTLEEWQLLNPTQKNLYRDVMLENYSNLVFLEVWLDNPKMWLRDNQDNLKSMERGHKYDVFGKIFNS

SEQ ID NO: 3003 - protein, 81 aa, Pan paniscus
MIQSQISFEDVAVDFTLEEWQLLNPTQKNLYRDVMLENYSNLVFLGFQILKPDAMFKLEQQDPWIIGQEILNQNFSEVWLD

SEQ ID NO: 3004 - protein, 81 aa, Pan paniscus
MATSFRTASCWGLLSFKDISMEFTWDEWQLLDSTQKYLYRDVILENYHNLISVGYHGTKPDLIFKLEQGEDPWIINAKISR

SEQ ID NO: 3005 - protein, 80 aa, Pan paniscus
MATSFRTASCWGLLSFKDISMEFTWDEWQLLDSTQKYLYRDVILENYHNLISVDGWEEWYQNNQDELESIERSYACSVLG

SEQ ID NO: 3006 - protein, 81 aa, Pan paniscus
FGNLLGVPWAQGNSALPEGLLSFKDISMEFTWDEWQLLDSTQKYLYRDVILENYHNLISVGYHGTKPDLIFKLEQGEDPWI

SEQ ID NO: 3007 - protein, 81 aa, Pan paniscus
RDVILENYHNLISVGYHGTKPDLIFKLEQGEDPWIINAKISRQSCPDGWEEWYQNNQDELESIERSYACSVLGRLNLSKTH

SEQ ID NO: 3008 - protein, 81 aa, Pan paniscus
MTMLQESFSFDDLSVDFTQKEWQLLDPSQKNLYKDVMLENYSSLVSLGYEVMKPDVIFKLEQGEEPWVGDGEIPSSDSPEV

SEQ ID NO: 3009 - protein, 81 aa, Pan paniscus
MTMLQESFSFDDLSVDFTQKEWQLLDPSQKNLYKDVMLENYSSLVSLGYEVMKPDVIFKLEQGEEPWVGDGEIPSSDSPVW

SEQ ID NO: 3010 - protein, 81 aa, Pan paniscus
MTMLQESFSFDDLSVDFTQKEWQLLDPSQKNLYKDVMLENYSSLVSLGYEVMKPDVIFKLEQGEEPWVGDGEIPSSDSPGT

SEQ ID NO: 3011 - protein, 81 aa, Pan paniscus
MTMLQESFSFDDLSVDFTQKEWQLLDPSQKNLYKDVMLENYSSLVSLGYEVMKPDVIFKLEQGEEPWVGDGEIPSSDSPVS

SEQ ID NO: 3012 - protein, 81 aa, Pan paniscus
MSQGSVTFRDVAIDFSQEEWKWLQPAQRDLYRCVMLENYGHLVSLGLSISKPDVVSLLEQGKEPWLGKREVKRDLFSVSES

SEQ ID NO: 3013 - protein, 81 aa, Pan paniscus; identical to SEQ ID NO: 2382

SEQ ID NO: 3014 - protein, 81 aa, Pan paniscus
MSQGSVTFRDVAIDFSQEEWKWLQPAQRDLYRCVMLENYGHLVSLAGLSISKPDVVSLLEQGKEPWLGKREVKRDLFSGFF

SEQ ID NO: 3015 - protein, 81 aa, Pan paniscus
MSQGSVTFRDVAIDFSQEEWKWLQPAQRDLYRCVMLENYGHLVSLGLSISKPDVVSLLEQGKEPWLGKREVKRDLFSVLKE

SEQ ID NO: 3016 - protein, 81 aa, Pan paniscus
REFGGMRAGHANICPSFQGSVTFRDVAIDFSQEEWKWLQPAQRDLYRCVMLENYGHLVSLGLSISKPDVVSLLEQGKEPWL

SEQ ID NO: 3017 - protein, 81 aa, Pan paniscus
RNAEEERMIAVFLTTWLQEPMTFKDVAVEFTQEEWMMLDSAQRSLYRDVMLENYRNLTSVEYQLYRLTVISPLDQEEIRNM

SEQ ID NO: 3018 - protein, 81 aa, Pan paniscus
MDAKSLTAWSRTLVTFKDVFVDFTREEWKLLDTAQQIVYRNVMLENYKNLVSLGYQLTKPDVILRLEKGEEPWLVEREIHQ

SEQ ID NO: 3019 - protein, 81 aa, Pan paniscus
VLEWLFISQEQPKITKSWGPLSFMDVFVDFTWEEWQLLDPAQKCLYRSVMLENYSNLVSLGYQHTKPDIIFKLEQGEELCM

SEQ ID NO: 3020 - protein, 81 aa, Pan paniscus; identical to SEQ ID NO: 2383

SEQ ID NO: 3021 - protein, 81 aa, Pan paniscus
KQKSRRIEKVLEWLFISQEQPKITKSWEWQLLDPAQKCLYRSVMLENYSNLVSLGYQHTKPDIIFKLEQGEELCMVQAQVP

SEQ ID NO: 3022 - protein, 81 aa, Pan paniscus
MATRVRTASIWGPLSFMDVFVDFTWEEWQLLDPAQKCLYRSVMLENYSNLVSLGYQHTKPDIIFKLEQGEELCMVQAQVPN

SEQ ID NO: 3023 - protein, 81 aa, Pan paniscus
GPLSFMDVFVDFTWEEWQLLDPAQKCLYRSVMLENYSNLVSLGYQHTKPDIIFKLEQGEELCMVQAQVPNQTCPILKAGKS

SEQ ID NO: 3024 - protein, 81 aa, Pan paniscus
QWGNELKNSMSSFRPGRGHNDSRRTVFYTNEEWELLDPTPKDLEESIVQEEKKKLTPEGNKGVTGSGFPFDFGRNPYKGKR

SEQ ID NO: 3025 - protein, 81 aa, Pan paniscus
SGDPSSEGTSGSGSVSIRKPASEMQLQVQSQQEELEQLKKDLSSQKELVRLLQQTVRSSQYDKYFTSSRLCEGVPKDTLEL

SEQ ID NO: 3026 - protein, 81 aa, Pan paniscus
SSGDPSSEGTSGSGSVSIRKPASEMQLQVQSQQEELEQLKKDLSSQKELVRLLQQTVRSSQYDKYFTSSRLCEGVPKDTLE

SEQ ID NO: 3027 - protein, 81 aa, Pan paniscus
EGRTRDRQMAAALLTAWSQMPVTFEDVALYLSREEWGRLDHTQQNFYRDVLQKKNRLSLGFPFSRPFWAPQAHGKGEASGS

SEQ ID NO: 3028 - protein, 81 aa, Pan paniscus
EGRTRDRQMAAALLTAWSQMPVTFEDVALYLSREEWGRLDHTQQNFYRDVLQKKNRLSLGAVEVGQRVQTSSVAALGNVKP

SEQ ID NO: 3029 - protein, 81 aa, Pan paniscus
LKEGRPGETTDTCFVSGVHGPVALGDIPFYFSREEWGTLDPAQRDLFWGIKRENSRNTTLGFGLKGQSEKSLLQEMVPVVP

SEQ ID NO: 3030 - protein, 81 aa, Pan paniscus
SRNTTLGFGLKGQSEKSLLQEMVPVVPGQTGSDVTVSWSPEEAEAWESENRPRAALGPVVGARRGRPPTRRRQFRDLAAEK

SEQ ID NO: 3031 - protein, 81 aa, Pan paniscus
RPLVKLLPKGVQREQETVSLYLKANPELVVFEDLNVFHCQEECVSLDPTQQLTSEKEDDSSVGEMMLLAVNGSNPEGEDPE

SEQ ID NO: 3032 - protein, 81 aa, Pan paniscus
PLVKLLPKGVQREQETVSLYLKANPEELVVFEDLNVFHCQEECVSLDPTQQLTSEKEDDSSVGEMMLLAVNGSNPEGEDPE

SEQ ID NO: 3033 - protein, 81 aa, Pan paniscus
PLVKLLPKGVQREQETVSLYLKANPEELVVFEDLNVFHCQEECVSLDPTQQLTSEKEDDSSVGEMMLLVNGSNPEGEDPER

SEQ ID NO: 3034 - protein, 81 aa, Pan paniscus
LFPPEGNVEDKEMTGPQLPESLEDVAMYISQEEWGHQDPSKRALSRDTVQESYENVDSLESHIPSQEVPGTQVGQGGKLWD

SEQ ID NO: 3035 - protein, 81 aa, Pan paniscus
QTNTKDWTVTPEHVLPESQSLLTFEEVAMYFSQEEWELLDPTQKALYNDVMQENYETVISLALFVLPKPKVISCLEQGEEP

SEQ ID NO: 3036 - protein, 81 aa, Pan paniscus
MYFSQEEWELLDPTQKALYNDVMQENYETVISLALFVLPKPKVISCLEQGEEPWVQVSPEFKDSAGKSPTGLKLKNDTENR

SEQ ID NO: 3037 - protein, 81 aa, Pan paniscus
MCDNRAVSLCQQEWMCPGPAKRALYRGATQRKDRHVSLATGVPWGYEETKTLLAILSSSQFYGKLQTCQQNSQIYRAMAEG

SEQ ID NO: 3038 - protein, 81 aa, Pan paniscus
NTGLHDQETGAVVWTAGSQGPAMCDNRAVSLCQQEWMCPGPAKRALYRGATQRKDRHVSLATGVPWGYEETKTLLAILSSS

SEQ ID NO: 3039 - protein, 81 aa, Pan paniscus
MASMPPTPEAQGPMLFEDLAVYFSQEECVTLHPAQRSLSKDGTKESLEVAALMGEEGKPEINQQLSLESMELDELALEKYP

SEQ ID NO: 3040 - protein, 81 aa, Pan paniscus
WPERGPPAPRHQEMASASPFLSAWSQVPVNLEDVAVYLSGEEPRCLDPAQRDAPLENEGPGIQLEDGGEGREDAPVRMEWY

SEQ ID NO: 3041 - protein, 81 aa, Pan paniscus
MGLLTFRDVAVEFSLEEWEHLEPAQKTLYQDVMLENYRNLVSLGLVVSKPDLITFLEQRKEPWNVKSEETVAIQPDVFSHY

SEQ ID NO: 3042 - protein, 81 aa, Pan paniscus; identical to SEQ ID NO: 2384

SEQ ID NO: 3043 - protein, 81 aa, Pan paniscus
MCQGLLTFRDVAIEFSREEWEHLDSDQKLLYGDVMLENYGNLVSLGLAVSKPDLITFLEQRKEPWNVKSAETVAIQPDIFS

SEQ ID NO: 3044 - protein, 81 aa, Pan paniscus; identical to SEQ ID NO: 2385

SEQ ID NO: 3045 - protein, 81 aa, Pan paniscus
MGLLTFRDVAIEFSREEWEHLDSDQKLLYGDVMLENYGNLVSLGLAVSKPDLITFLEQRKEPWNVKSAETVAIQPEVKVNT

SEQ ID NO: 3046 - protein, 81 aa, Pan paniscus
PDLITFLEQRKEPWNVKSAETVAIQPDIFSHDTQGLLRKKLIEASFQKAILDGYGSCGPQNLNLRKEWESEEKNQYNKSDT

SEQ ID NO: 3047 - protein, 81 aa, Pan paniscus
EVTEHLTGWAPAPVPSVEGLLTFRDVAIEFSREEWEHLDSDQKLLYGDVMLENYGNLVSLGLAVSKPDLITFLEQRKEPWN

SEQ ID NO: 3048 - protein, 81 aa, Pan paniscus
PAQGPGKARPSRKRGRRPRALKFVDVAVYFSPEEWGCLRPAQRALYRDVMRETYGHLGALGCAGPKPALISWLERNTDDWE

SEQ ID NO: 3049 - protein, 81 aa, Pan paniscus
PAHVPGEAGPRRTRESRPGAVSFADVAVYFSPEEWECLRPAQRALYRDVMRETFGHLGALGFSGPKPAFISWVEGEVEAWS

SEQ ID NO: 3050 - protein, 81 aa, Pan paniscus
APLLAPRPGETRPGCRKPGTVSFADVAVYFSPEEWGCLRPAQRALYRDVMQETYGHLGALGFPGPKPALISWMEQESEAWS

SEQ ID NO: 3051 - protein, 81 aa, Pan paniscus
APLPPRDPNGAGPEWREPGAVSFADVAVYFCREEWGCLRPAQRALYRDVMRETYGHLSALGIGGNKPALISWVEEEAELWG

SEQ ID NO: 3052 - protein, 81 aa, Pan paniscus
APLPPRDPNGAGPEWRKPGAVSFADVAVYFSREEWGCLRPAHRALYRDVMRETYGHLGALGESPTCLPGPCASTGPAAPLG

SEQ ID NO: 3053 - protein, 81 aa, Pan paniscus
APLPPRDPNGAGPEWRKPGAVSFADVAVYFSREEWGCLRPAHRALYRDVMRETYGHLGALGVGGSKPALISWVEEKAELWD

SEQ ID NO: 3054 - protein, 81 aa, Pan paniscus
MAPRPPTAAPQESVTFKDVSVDFTQEEWYHVDPAQRSLYRDVMLENYSHLVSLGYQVSKPEVIFKLEQGEEPWISEGEIQR

SEQ ID NO: 3055 - protein, 81 aa, Pan paniscus
VTFKDVSVDFTQEEWYHVDPAQRSLYRDVMLENYSHLVSLGYQVSKPEVIFKLEQGEEPWISEGEIQRPFYPAVYFNRKEE

SEQ ID NO: 3056 - protein, 81 aa, Pan paniscus
ESVTFKDVSVDFTQEEWYHVDPAQRSLYRDVMLENYSHLVSLGYQVSKPEVIFKLEQGEEPWISEGEIQRPFYPGFVCLLP

SEQ ID NO: 3057 - protein, 81 aa, Pan paniscus
MAAMPLKAQYQEMVTFEDVAVHFTKTEWTGLSPAQRALYRSVMLENFGNLTALGYPVPKPALISLLEGGDMAWGLEAQDDP

SEQ ID NO: 3058 - protein, 80 aa, Pan paniscus
VTFEDVAVHFTKTEWTGLSPAQRALYRSVMLENFGNLTALGYPVPKPALISLLEGGDMAWGLEAQDDPPAERTKNVCKGR

SEQ ID NO: 3059 - protein, 81 aa, Pan paniscus
MVTFEDVAVHFTKTEWTGLSPAQRALYRSVMLENFGNLTALGYPVPKPALISLLEGGDMAWGLEAQDDPPAERTKNVCKVI

SEQ ID NO: 3060 - protein, 81 aa, Pan paniscus
MLENYGNVASLGFPLLKPAVISQLEGGGELGGPSPLAAGTGLQGLQTDIQTDNDLTKEMHEGKENVSFELQRDFSQETDFS

SEQ ID NO: 3061 - protein, 81 aa, Pan paniscus
MLENYGNVASLGFPLLKPAVISQLEGGGELGGPSPLAAGTGLQGLQTDGVSLCRPNWSAVARTWLTATSVSRVRAILLPHP

SEQ ID NO: 3062 - protein, 81 aa, Pan paniscus
MLENYGNVASLGFPLLKPAVISQLEGGVDIQTDNDLTKEMHEGKENVSFELQRDFSQETDFSEASLLEKQQEVHSAGNIKK

SEQ ID NO: 3063 - protein, 81 aa, Pan paniscus
SQLEGGVDIQTDNDLTKEMHEGKENVSFELQRDFSQETDFSEASLLEKQQEVHSAGNIKKEKSNTIDGTVKDETNPVEECF

SEQ ID NO: 3064 - protein, 81 aa, Pan paniscus
MHLTTWPQKSVTFEDVAVYFTQAEWDGLSPAQRTLYRDVMLENYGNVASLGFPLLKPAVISQLEGGGELGGPSPLAAGTGL

SEQ ID NO: 3065 - protein, 81 aa, Pan paniscus
MNKSQGSVSFTDVTVDFTQEEWEQLDPSQRILYMDVMLENYSNLLSVEVWKADDQMERDHRNPDEQARQFLILKNQTPIEE

SEQ ID NO: 3066 - protein, 81 aa, Pan paniscus
MDVMLENYSNLLSVEVWKADDQMERDHRNPDEQARQFLILKNQTPIEERGDLFGKALNLNTDFVSLRQIPYKYDLHEKTLK

SEQ ID NO: 3067 - protein, 81 aa, Pan paniscus
PRGKHAFQTGWLNDLVTKESMTFKDVAVDITQEDWELMRPVQKELYKTVTLQNYWNMVSLGLTVYRPTVIPILEEPWMVIK

SEQ ID NO: 3068 - protein, 81 aa, Pan paniscus
TQPDEDLHLQAEETQLVKESVTFKDVAIDFTLEEWRLMDPTQRNLHKDVMLENYRNLVSLGLAVSKPDMISHLENGKGPWV

SEQ ID NO: 3069 - protein, 81 aa, Pan paniscus
PEVTQPDEDLHLQAEETQLVKESVTFKDVAIDFTLEEWRLMDPTQRNLHKDVMLENYRNLVSLGLAVSKPDMISHLENGKG

SEQ ID NO: 3070 - protein, 81 aa, Pan paniscus
FQEKSTEEGEVAALRLTARSQETVTFKDVAMDFTPEEWGKLDPVQRDVMLENYRNLVSLWLPVSKPENYNLENGKEPLKLE

SEQ ID NO: 3071 - protein, 81 aa, Pan paniscus
EGEVAALRLTARSQETVTFKDVAMDFTPEEWGKLDPVQRDVMLENYRNLVSLWLPVSKPENYNLENGKEPLKLERKAPKSS

SEQ ID NO: 3072 - protein, 81 aa, Pan paniscus
ASQPARLEERLIRDQDLGASLLPAAPQEQWRHLDSTQKEQYWDLMLETYGKMVSGAGISHPKSDLTNSIEFGEELAGLYLH

SEQ ID NO: 3073 - protein, 81 aa, Pan paniscus
ASQPARLEERLIRDQDLGASLLPAAPQEQWRHLDSTQKEQYWDLMLETYGKMVSGGISHPKSDLTNSIEFGEELAGLYLHV

SEQ ID NO: 3074 - protein, 81 aa, Pan paniscus
AASQPARLEERLIRDQDLGASLLPAAPQWRHLDSTQKEQYWDLMLETYGKMVSGGISHPKSDLTNSIEFGEELAGLYLHVN

SEQ ID NO: 3075 - protein, 81 aa, Pan paniscus
ASQPARLEERLIRDQDLGASLLPAAPQEQWRHLDSTQKEQYWDLMLETYGKMVSGGDRQENDKENLNLENHRDQELLHASC

SEQ ID NO: 3076 - protein, 81 aa, Pan paniscus
VLFQEATAFENMTKDWNYLEGSQKDCYRDTMLDSYENTVPQGSFLQFSMMPQRAGNDPPGVSNASEMEMEISNMREKFLMS

SEQ ID NO: 3077 - protein, 81 aa, Pan paniscus
LQGKYGNVTKEVIVLYLTLCKQCHQKNPVPKRGLAPQPMTFKDIDSTCQVEILDMQSSADGEFKFILYYQDHSTKFIILRP

SEQ ID NO: 3078 - protein, 81 aa, Pan paniscus
FSPCPKTVWSLWQQPVLFQEATAFENMTKDWNYLEGSQKDCYRDTMLDSYENTVPQGSFLQFSMMPQRAGNDPPGVSNASE

SEQ ID NO: 3079 - protein, 81 aa, Pan paniscus
MELLTFRDVAIEFSPEEWKCLDPAQQNLYRDVMLENYRNLVSLAVYSYYNQGILPEQGIEDSFKKATLGRYGSCGLENICL

SEQ ID NO: 3080 - protein, 80 aa, Pan paniscus
MELLTFRDVAIEFSPEEWKCLDPAQQNLYRDVMLENYRNLVSLELHAEHHQRTDGHFISLGEGQVYHAVMAIPASIGVWV

SEQ ID NO: 3081 - protein, 81 aa, Pan paniscus
MVTCAHLGRRARLPAAQPSACPGTCFSQEERMAAGYLPRWSQELVTFEDVSVDFSQEEWELLEPAQKNLYREVMLENYRNV

SEQ ID NO: 3082 - protein, 81 aa, Pan paniscus
CFSQEERMAAGYLPRWSQELVTFEDVSVDFSQEEWELLEPAQKNLYREVMLENYRNVVSLEGLKNQCTDVGIKEGPLSPAQ

SEQ ID NO: 3083 - protein, 81 aa, Pan paniscus
MLETFRNLASVDDETQFKASGSVSQQDIYGEKIPKESKIATFTRNVSWASVLGKIWDSLSIEDQTTNQGRNLSRNHVLERL

SEQ ID NO: 3084 - protein, 81 aa, Pan paniscus
EKIPKESKIATFTRNVSWASVLGKIWDSLSIEDQTTNQGRNLSRNHVLERLCESNDQCGEALSQIPHLNLYKKIPPGVKQY

SEQ ID NO: 3085 - protein, 81 aa, Pan paniscus
MDSVVFEDVAVDFTPEEWALLDSAQRDLYRDVMLETFRNLASVDDETQFKASGSVSQQDIYGEKIPKESKIATFTRNVSWA

SEQ ID NO: 3086 - protein, 81 aa, Pan paniscus; identical to SEQ ID NO: 2386

SEQ ID NO: 3087 - protein, 81 aa, Pan paniscus
MDSVVFEDVAVDFTLEEWALLDSAQRDLYRDVMLETFRNLASVGCEMWERANGSVSLQDMYGQEKSKEQTIPNFTGNNSCA

SEQ ID NO: 3088 - protein, 81 aa, Pan paniscus; identical to SEQ ID NO: 2387

SEQ ID NO: 3089 - protein, 81 aa, Pan paniscus
MDSVVFEEVAVNFTPEEWALLDHAQRSLYRDVMLETCRNLASLDCYIYVRTSGSSSQRDVFGNGISNDEEIVKFTGSDSWS

SEQ ID NO: 3090 - protein, 81 aa, Pan paniscus
GHTQGGELVNELLTSWLRGLVTFEDVAVEFTQEEWALLDPAQRTLYRDVMLENCRNLASLGCRVNKPSLISQLEQDKKVIT

SEQ ID NO: 3091 - protein, 81 aa, Pan paniscus
DLFACSGLEPHTPSAGSQESVTFQDVAVDFTEKEWPLLDSSQRKLYKDVMLENYSNLTSLGYQVGKPSLISHLEQEEEPRT

SEQ ID NO: 3092 - protein, 81 aa, Pan paniscus
DLFACSGLEPHTPSAGSQESVTFQDVAVDFTEKEWPLLDSSQRKLYKDVMLENYSNLTSLDWETPSKTKWSLLMEDIFGKE

SEQ ID NO: 3093 - protein, 81 aa, Pan paniscus
SSKDRSCPQNLDLFACSGLEPHTPSAGSQESVTFQDVAVDFTEKEWPLLDSSQRKLYKDVMLENYSNLTSLEILAPPFCRS

SEQ ID NO: 3094 - protein, 81 aa, Pan paniscus
MEEERKTAELQKNRIQDSVVFEDVAVDFTQEEWALLDLAQRNLYRDVMLENFQNLASLGYPLHTPHLISQWEQEEDLQTVK

SEQ ID NO: 3095 - protein, 81 aa, Pan paniscus
MAAGWLTTWSQNSVTFQEVAVDFSQEEWALLDPAQKNLYKDVMLENFRNLASVGYQLCRHSLISKVDQEQLKTDERGILQG

SEQ ID NO: 3096 - protein, 81 aa, Pan paniscus
SKFEEERMVAGWLTNYSQDSVTFEDVAVDFTQEEWTLLDQTQRNLYRDVMLENYKNLVAVDWESHINTKWSAPQQNFLQGK

SEQ ID NO: 3097 - protein, 81 aa, Pan paniscus
MVAGWLTNYSQDSVTFEDVAVDFTQEEWTLLDQTQRNLYRDVMLENYKNLVAVDWESHINTKWSAPQQNFLQGKTSSVVEM

SEQ ID NO: 3098 - protein, 81 aa, Pan paniscus
EKTEVERVVADCLTNCYQDSVTFDDLAVDFTPEEWTLLDPTQRNLYRDVMLENYKNLATVGYQLFKPSLISWLEQEESRTV

SEQ ID NO: 3099 - protein, 81 aa, Pan paniscus
MAYCLTNCYQDSVTFEDTAVDFTQEEWTLLDPVQRNLYRDVMLENYENVAKVGFQLLKPSVISWLEEEELRTLQQGVLQDW

SEQ ID NO: 3100 - protein, 81 aa, Pan paniscus
VSALQQDFWKIQTSNGIQTDLVTFDSVAVEFTQEEWTLLDPTQRNLYSDVMLENYKNLSSVVYQLFKPSLISWLEEEEELS

SEQ ID NO: 3101 - protein, 81 aa, Pan paniscus
EKTPAGRIVADCLTDCYQDSVTFDDVAVDFTQEEWTLLDSTQRSLYSDVMLENYKNLATVGGQIIKPSLISWLEQEESRTV

SEQ ID NO: 3102 - protein, 81 aa, Pan paniscus
MDSVTFDDVAVDFTQEEWTLLDSTQRSLYSDVMLENYKNLATVGGQIIKPSLISWLEQEESRTVQGGVLQGWEMRLETQWS

SEQ ID NO: 3103 - protein, 81 aa, Pan paniscus
EKTKVERMVEDSLANGYQDSVTFDDVAVDFTPEEWALLDTTEKYLYRDVMLENYTNLASVEWEIQPRTKRSSLQQGFLKNQ

SEQ ID NO: 3104 - protein, 81 aa, Pan paniscus
FFSREPICPFEEKTKVERMVEDSLANGYQDSVTFDDVAVDFTPEEWALLDTTEKYLYRDVMLENYTNLASVDKRLQWMETL

SEQ ID NO: 3105 - protein, 81 aa, Pan paniscus
EKTKIGTMVEDHRSNSYQDSVTFDDVAVEFTPEEWALLDTTQKYLYRDVMLENYMNLASVDFFFCLTSEWEIQPRTKRSSL

SEQ ID NO: 3106 - protein, 81 aa, Pan paniscus
FSREPICPFEEKTKIGTMVEDHRSNSYQDSVTFDDVAVEFTPEEWALLDTTQKYLYRDVMLENYMNLASVADKKLQWMETL

SEQ ID NO: 3107 - protein, 81 aa, Pan paniscus
VDSVTFDDVAVEFTPEEWALLDTTQKYLYRDVMLENYMNLASVDFFFCLTSEWEIQPRTKRSSLQQGFLKNQIFTGIQMQT

SEQ ID NO: 3108 - protein, 81 aa, Pan paniscus
LASVDFFFCLTSEWEIQPRTKRSSLQQGFLKNQIFTGIQMQTRSYSGWKLCENCGEVFSEQFCLKTHMRAQNGGNTFEGNC

SEQ ID NO: 3109 - protein, 81 aa, Pan paniscus
SYQDSVTFDDVAVEFTPEEWALLDTTQKYLYRDVMLENYMNLASVDFFFCLTSEWEIQPRTKRSSLQQGFLKNQIFTGIQM

SEQ ID NO: 3110 - protein, 81 aa, Pan paniscus
MDSSQHLVTFEDVAVDFTQEEWTLLDQAQRDLYRDVMLENYKNLIILAGSELFKHSLMSGLEQMEELRTGVTGVLQGEKQY

SEQ ID NO: 3111 - protein, 81 aa, Pan paniscus
MDSSQHLVTFEDVAVDFTQEEWTLLDQAQRDLYRDVMLENYKNLIILAGSELFKHSLMSGLEQMEELRTGVTGVLQELDLQ

SEQ ID NO: 3112 - protein, 81 aa, Pan paniscus
MDSSQHLVTFEDVAVDFTQEEWTLLDQAQRDLYRDVMLENYKNLIILELDLQLKTKGSPLLQDISAERSPNGVQLERSNTA

SEQ ID NO: 3113 - protein, 81 aa, Pan paniscus
MDSSQHLVTFEDVAVDFTQEEWTLLDQAQRDLYRDVMLENYKNLIILGSELFKHSLMSGLEQMEELRTGVTGVLQELDLQL

SEQ ID NO: 3114 - protein, 81 aa, Pan paniscus
MDSVAFEDVAVNFTLEEWALLDPSQKNLYRDVMRETFRNLASVGKQWEEQNIEDPFKIPRRNISHIPERLCESKEGGQGEE

SEQ ID NO: 3115 - protein, 81 aa, Pan paniscus
MDSVAFEDVAVNFTQEEWALLGPSQKSLYRNVMQETIRNLDCIEMKWEDQNIGDQCQNAKRNLRSHTCEIKDDSQCGETFG

SEQ ID NO: 3116 - protein, 81 aa, Pan paniscus
MDSVAFEDVAINFTCEEWALLGPSQKSLYRDVMQETIRNLDCIGMIWQNHDIEEDQYKDLRRNLRCHMVERSCEIKDNSQC

SEQ ID NO: 3117 - protein, 81 aa, Pan paniscus
MDPVAFKDVAVNFTQEEWALLDISQRRLYREVMLETFRNLTSVGKRWKDQNIEYEYQNPRRNFSSLIEEKVNEIKQDSHCG

SEQ ID NO: 3118 - protein, 81 aa, Pan paniscus
MMFQDPVAFKDVAVNFTQEEWALLDISQRRLYREVMLETFRNLTSVGKRWKDQNIEYEYQNPRRNFSSLIEEKVNEIKQDS

SEQ ID NO: 3119 - protein, 81 aa, Pan paniscus
MFQDPVAFKDVAVNFTQEEWALLDISQRRLYREVMLETFRNLTSVGKRWKDQNIEYEYQNPRRNFSSLIEEKVNEIKQDSH

SEQ ID NO: 3120 - protein, 81 aa, Pan paniscus
MDPVAFKDVAVNFTQEEWALLDISQKNLYREVMLETFWNLTSIGKKWKDQNIEYEYQNPRRNFRSLIEEKVNEIKQDSHCG

SEQ ID NO: 3121 - protein, 81 aa, Pan paniscus
MFQDPVAFKDVAVNFTQEEWALLDISQKNLYREVMLETFWNLTSIGKKWKDQNIEYEYQNPRRNFRSLIEEKVNEIKQDSH

SEQ ID NO: 3122 - protein, 81 aa, Pan paniscus
MLSLSPILLYTCEMFQDPVAFKDVAVNFTQEEWALLDISQKNLYREVMLETFWNLTSIGKKWKDQNIEYEYQNPRRNFRSL

SEQ ID NO: 3123 - protein, 81 aa, Pan paniscus
CSHRRCREDPGTSESQEMDPVAFDDVAVNFTQEEWALLDISQRKLYREVMLETFRNLTSIGKSWKDQNIEYEYQNPRRNFR

SEQ ID NO: 3124 - protein, 81 aa, Pan paniscus
MPCCSHRRCREDPGTSESQEMEEWALLDISQRKLYREVMLETFRNLTSIGKSWKDQNIEYEYQNPRRNFRSLIEKKVNEIK

SEQ ID NO: 3125 - protein, 81 aa, Pan paniscus
RSCREDPGTSESREMMFQDPVAFEDVAVNFTQEEWTLLDISQKNLFREVMLETFRNLTSIGKKWSDQNIEYEYQNPRRSFR

SEQ ID NO: 3126 - protein, 81 aa, Pan paniscus
CSHRSCREDPGTSESREMDPVAFEDVAVNFTQEEWTLLDISQKNLFREVMLETFRNLTSIGKKWSDQNIEYEYQNPRRSFR

SEQ ID NO: 3127 - protein, 81 aa, Pan paniscus
MFQDPVAFEDVAVNFTQEEWTLLDISQKNLFREVMLETFRNLTSIGKKWSDQNIEYEYQNPRRSFRSLIEEKVNEIKEDSH

SEQ ID NO: 3128 - protein, 81 aa, Pan paniscus
CSHRSCREDPGTSESREMDPVAFDDVAVNFTQEEWALLDISQRKLYREVMLETFRNLTSIGKKWKDQNIEYEYQNPRRNFR

SEQ ID NO: 3129 - protein, 81 aa, Pan paniscus
QIHERTHTGEKPCECSKCNRAFRSHRSYLRHKRSHTGEKPYQCKECRKAFTYPSSLRRHERTHSAKNLMNVSSVGKHYLIL

SEQ ID NO: 3130 - protein, 81 aa, Pan paniscus
MPCCSHRSCREDPGTSESREMRPESSDCKLRPVRNLQREVIESSHQAQWLTPVIPALWEAKADGASQMFQDPVAFDDVAVN

SEQ ID NO: 3131 - protein, 81 aa, Pan paniscus
NLQREVIESSHQAQWLTPVIPALWEAKADGASQMFQDPVAFDDVAVNFTQEEWALLDISQRKLYREVMLETFRNLTSIGVS

SEQ ID NO: 3132 - protein, 81 aa, Pan paniscus
MDPVAFDDVAVNFTQEEWALLDISQRKLYREVMLETFRNLTSIGKKWKDQNIEYEYQNPRRNFRSLIEGNVNEIKEDSHCG

SEQ ID NO: 3133 - protein, 81 aa, Pan paniscus
MMFQDPVAFDDVAVNFTQEEWALLDISQRKLYREVMLETFRNLTSIGKKWKDQNIEYEYQNPRRNFRSLIEGNVNEIKEDS

SEQ ID NO: 3134 - protein, 81 aa, Pan paniscus
PPVLSLSPILLYTCEMFQDPVAFDDVAVNFTQEEWALLDISQRKLYREVMLETFRNLTSIGKKWKDQNIEYEYQNPRRNFR

SEQ ID NO: 3135 - protein, 81 aa, Pan paniscus
MMFQDSVAFEDVAVTFTQEEWALLDPSQKNLYRDVMQETFRNLASIGKKWKPQNIYVEYENLRRNLRIVGERLFESKEGHQ

SEQ ID NO: 3136 - protein, 81 aa, Pan paniscus
MDSVAFEDVAVTFTQEEWALLDPSQKNLYRDVMQETFRNLASIGKKWKPQNIYVEYENLRRNLRIVGERLFESKEGHQHGE

SEQ ID NO: 3137 - protein, 81 aa, Pan paniscus
MLVLSIFLYTCEMFQDSVAFEDVAVTFTQEEWALLDPSQKNLYRDVMQETFRNLASIGKKWKPQNIYVEYENLRRNLRIVG

SEQ ID NO: 3138 - protein, 81 aa, Pan paniscus
MDSVAFEDVAVNFTQEEWALLDPSQKNLYREVMQETLRNLTSIGKKWNNQYIEDEHQNPRRNLRRLIGERLSESKESHQHG

SEQ ID NO: 3139 - protein, 81 aa, Pan paniscus
MDSVAFEDVAVNFTQEEWSLLDPSQKNLYREVMQETLRNLASIGEKWKDQYIEDQYKNPRNNLRSLLGERVDENTEENHCG

SEQ ID NO: 3140 - protein, 81 aa, Pan paniscus
MDSVAFEDVAVSFTQEEWALLDPSQKNLYRDVMQETFKNLTSVGKTWKVQNIEDEYKNPRRNLRRSFTLVAQAGVRQDLGS

SEQ ID NO: 3141 - protein, 81 aa, Pan paniscus
MMFQDSVAFEDVAVSFTQEEWALLDPSQKNLYRDVMQETFKNLTSVGKTWKVQNIEDEYKNPRRNLSLMREKLCESKESHH

SEQ ID NO: 3142 - protein, 81 aa, Pan paniscus
MDSVAFEDVAVSFTQEEWALLDPSQKNLYRDVMQETFKNLTSVGKTWKVQNIEDEYKNPRRNLSLMREKLCESKESHHCGE

SEQ ID NO: 3143 - protein, 81 aa, Pan paniscus
MDSVVFEDVDVNFTQEEWALLDPSQKNLYRDVMQETFRNLASVGKKWKDQKIEDEYKNPRRNLSLRKWSWSLYARQTLGLD

SEQ ID NO: 3144 - protein, 81 aa, Pan paniscus
DSVVFEDVDVNFTQEEWALLDPSQKNLYRDVMQETFRNLASVGKKWKDQKIEDEYKNPRRNLSLRKWSWSLYARQTLGLDS

SEQ ID NO: 3145 - protein, 81 aa, Pan paniscus
MDSVVFEDVDVNFTQEEWALLDPSQKNLYRDVMQETFRNLASVGKKWKDQKIEDEYKNPRRNLRGLMGERLLESKKDHQHG

SEQ ID NO: 3146 - protein, 81 aa, Pan paniscus
NRHHRADTGHKPYEYQEYGQKPYKCTYCKKAFSDLPYFRTHEWAHTGGKPYDCEECGKSFISRSSIRRHRIMHSGDGPYKC

SEQ ID NO: 3147 - protein, 81 aa, Pan paniscus
MDSVAFEDVDVNFTQEEWALLDPSQKNLYRDVMWETMRNLASIGKKWKDQNIKDHYKHRGRNLRSHMLERLYQTKDGSQRG

SEQ ID NO: 3148 - protein, 81 aa, Pan paniscus
TLPRGQPEVLEWGLPKDQDSVAFEDVAVNFTHEEWALLSPSQKNLYRDVMRETIRNLNCIGMKWENQNIDDQYQNLRRNPR

SEQ ID NO: 3149 - protein, 81 aa, Pan paniscus
MDSVAFEDVAVNFTHEEWALLSPSQKNLYRDVMRETIRNLNCIGMKWENQNIDDQYQNLRRNPRCDVVERFGKSKDGSQCG

SEQ ID NO: 3150 - protein, 81 aa, Pan paniscus
MDAVAFEDVAVNFTQEEWALLGPSQKNLYRYVMQETIRNLDCIRMIWEEQNTEDQYKNPRRNLRCHIVERFSESKDSSQCG

SEQ ID NO: 3151 - protein, 81 aa, Pan paniscus
HTHKQRGKAFSYHHSFQSCGRPHTGKKRYECKECGKTFSSRRNLRRHMVVQGGNRPYKFPIEDMRECTLGRNRMNVSSVLK

SEQ ID NO: 3152 - protein, 81 aa, Pan paniscus
RNDFFLPDSQTNEERKQYDSVAFEDVAVNFTQEEWALLGPSQKSLYRDVMWETIRNLDCIEMKWEDTNIEDQHKNPRRSLR

SEQ ID NO: 3153 - protein, 81 aa, Pan paniscus
MASVALEDVAVNFTREEWALLGPCQKNLYKDVMQETIRNLDCVGMKWKDQNIEDQYRYPRKNLRCRMLERFVESKGGSQCG

SEQ ID NO: 3154 - protein, 80 aa, Pan paniscus; identical to SEQ ID NO: 2388

SEQ ID NO: 3155 - protein, 81 aa, Pan paniscus; identical to SEQ ID NO: 2389

SEQ ID NO: 3156 - protein, 81 aa, Pan paniscus
SDQRRRRKEARTPGSRDTDSVVFEDVAVNFTQEEWALLGPSQKKLYRDVMQETFVNLASIGENWEEKNIEDHKNQGRKLRS

SEQ ID NO: 3157 - protein, 81 aa, Pan paniscus
MDSVASEDVAVNFTLEEWALLDPSQKKLYRDVMRETFRNLACVGKKWEDQSIEDWYKNQGRILRNHMEEGLSESKEYDQCG

SEQ ID NO: 3158 - protein, 81 aa, Pan paniscus
VLQMQNSEHHGQSIKTQTDSISLEDVAVNFTLEEWALLDPGQRNIYRDVMRATFKNLACIGEKWKDQDIEDEHKNQGRNLR

SEQ ID NO: 3159 - protein, 81 aa, Pan paniscus
MDSISLEDVAVNFTLEEWALLDPGQRNIYRDVMRATFKNLACIGEKWKDQDIEDEHKNQGRNLRSPMVEALCENKEDCPCG

SEQ ID NO: 3160 - protein, 81 aa, Pan paniscus
MDSVAFEDVSVSFSQEEWALLAPSQKKLYRDVMQETFKNLASIGEKWEDPNVEDQHKNQGRNLRSHTGERLCEGKEGSQCA

SEQ ID NO: 3161 - protein, 81 aa, Pan paniscus
MESVTFEDVAVEFIQEWALLDSARRSLCKYRMLDQCRTLASRGTPPCKPSCVSQLGQRAEPKATERGILHATGVAWESQLK

SEQ ID NO: 3162 - protein, 81 aa, Pan paniscus
EDKVEEEAMAPGLPTACSQEPVTFADVAVVFTPEEWVFLDSTQRSLYRDVMLENYRNLASVADQLCKPNALSYLEERGEQW

SEQ ID NO: 3163 - protein, 81 aa, Pan paniscus
MESVTFEDVAVEFIQEWALLDSARRSLCKYRMLDQCRTLASRGAGAVPEDAAGALHRREGDTIDSRGPASSPGAALVSGMH

SEQ ID NO: 3164 - protein, 81 aa, Pan paniscus
MDSVAFEDVAVNFTQEEWALLSPSQKNLYRDVTLETFRNLTSVGIQWKDQDIENLYQNLGIKLRSLVERLCGRKEGNEHRE

SEQ ID NO: 3165 - protein, 81 aa, Pan paniscus
MDSVSFEDVAVNFTLEEWALLDSSQKKLYEDVMQETFKNLVCLGKKWEDQDIEDDHRNQGKNQRCHMVERLCESRRGSKCG

SEQ ID NO: 3166 - protein, 81 aa, Pan paniscus
MGPLEFRDVAIEFSLEEWHCLDTAQRNLYRNVMLENYRHLVFLGIVVSKPNLITCLEQGKKPLTMKRHEMIAKPPVMYSHF

SEQ ID NO: 3167 - protein, 81 aa, Pan paniscus
LRRYEKCRHDNLQLKKGCESVDECPVHKRGYNGLKQCLTTTQRKILQCDEYVKFLHKFSNSNKHKIRDTGKKPFKCIEYGK

SEQ ID NO: 3168 - protein, 81 aa, Pan paniscus
MGPLEFRDVAIEFSLEEWHCLDTAQRNLYRNVMLENYRHLVFLGIVVSKPNLITCLEQGKKPLTMKRHEMIAKPPGQARWL

SEQ ID NO: 3169 - protein, 81 aa, Pan paniscus
MGPLEFRDVAIEFSLEEWHCLDTAQRNLYRNVMLENYRHLVFLGIVVSKPNLITCLEQGKKPLTMKRHEMIAKPPDGVSVF

SEQ ID NO: 3170 - protein, 81 aa, Pan paniscus
MGPLEFRDVAIEFSLEEWHCLDTAQRNLYRNVMLENYRHLVFLVMYSHFAQDLWSEHSIKDSFQKVILRRYEKCRHDNLQL

SEQ ID NO: 3171 - protein, 81 aa, Pan paniscus
MGPLEFRDVAIEFSLEEWHCLDTAQRNLYRNVMLENYRHLVFLGIVVSKPNLITCLEQGKKPLTMKRHEMIAKPPETGFHR

SEQ ID NO: 3172 - protein, 81 aa, Pan paniscus; identical to SEQ ID NO: 2390

SEQ ID NO: 3173 - protein, 81 aa, Pan paniscus
LRRYEKCRHDNLQLKKGCKSVGEHKVHKGGYNGLNQCLTTTQKEIFQCDKYGKVFHKFSNSNTYKTRHTGINLFKCIICGK

SEQ ID NO: 3174 - protein, 81 aa, Pan paniscus
GPLQFRDVAIEFSLEEWHCLDTAQRNLYRDVMLENYRNLVFLGIVVSKPDLVTCLEQGKKPLTMERHEMIAKPPVMSSHFA

SEQ ID NO: 3175 - protein, 81 aa, Pan paniscus
MGPLQFRDVAIEFSLEEWHCLDTAQRNLYRNVMLENYSNLVFLGIVVSKPDLIAHLEQGKKPLTMKRHEMVANPSGPGVVV

SEQ ID NO: 3176 - protein, 81 aa, Pan paniscus; identical to SEQ ID NO: 2391

SEQ ID NO: 3177 - protein, 81 aa, Pan paniscus
MGPLQFRDVAIEFSLEEWHCLDTAQRNLYRNVMLENYSNLVFLGIVVSKPDLIAHLEQGKKPLTMKRHEMVANPSDGVNLC

SEQ ID NO: 3178 - protein, 81 aa, Pan paniscus
MGPLQFRDVAIEFSLEEWHCLDTAQRNLYRNVMLENYSNLVFLGIVVSKPDLIAHLEQGKKPLTMKRHEMVANPSGARLLS

SEQ ID NO: 3179 - protein, 81 aa, Pan paniscus
MELLTFRDVTIEFSLEEWEFLNPAQQSLYRKVMLENYRNLVSLGLTVSKPELISCLEQREEPWNVKRHETIAKPPGTYRVG

SEQ ID NO: 3180 - protein, 81 aa, Pan paniscus
MLENYRNLVSLGLTVSKPELISCLEQREEPWNVKRHETIAKPPAMSSHYTEDLLPEQGMQDSFQKVILRRYGSCGLEDLHL

SEQ ID NO: 3181 - protein, 81 aa, Pan paniscus
MELLTFRDVTIEFSLEEWEFLNPAQQSLYRKVMLENYRNLVSLGLTVSKPELISCLEQREEPWNVKRHETIAKPPAMSSHY

SEQ ID NO: 3182 - protein, 81 aa, Pan paniscus
MFCFVFQELLTFRDVTIEFSLEEWEFLNPAQQSLYRKVMLENYRNLVSLGLTVSKPELISCLEQREEPWNVKRHETIAKPP

SEQ ID NO: 3183 - protein, 81 aa, Pan paniscus
EQGMQDSFQKVILRRYGSCGLEDLHLRKDGENVGECKDQKEIYNGLNQCLSTLPSKIFPYNKCVKVFSKSSNLNRENIRHT

SEQ ID NO: 3184 - protein, 81 aa, Pan paniscus
MELLTFRDVTIEFSLEEWEFLNPAQQSLYRKVMLENYRNLVSLGLTVSKPELISCLEQREEPWNVKRHETIAKPPDYSLTI

SEQ ID NO: 3185 - protein, 81 aa, Pan paniscus
MGPLQFRDVAIEFSLEEWHCLDTAQRNLYRNVMLENYRNLVFLGIVVTKPDLITCLEQGKKPFTVKRHEMIAKPPDGVHFL

SEQ ID NO: 3186 - protein, 81 aa, Pan paniscus
MGPLQFRDVAIEFSLEEWHCLDTAQRNLYRNVMLENYRNLVFLGIVVTKPDLITCLEQGKKPFTVKRHEMIAKPPVMCFHF

SEQ ID NO: 3187 - protein, 81 aa, Pan paniscus
MPGPLRSLEMESLQFRDVAVEFSLEEWHCLDTAQQNLYRDVMLENYRHLVFLGIIVSKPDLITCLEQGIKPLTMKRHEMIA

SEQ ID NO: 3188 - protein, 81 aa, Pan paniscus
MAPLQFRDVAIEFSLEEWHCLDTAQRNLYRNVMLENYRNLVFLGIVVSKPDLITCLEQGEKPLTMKKHEMVANPSVTCSHF

SEQ ID NO: 3189 - protein, 81 aa, Pan paniscus
MAPLQFRDVAIEFSLEEWHCLDTAQRNLYRNVMLENYRNLVFLGIVVSKPDLITCLEQGEKPLTMKKHEMVANPSETGFHH

SEQ ID NO: 3190 - protein, 81 aa, Pan paniscus
MGPLQFRDVAIEFSLEEWHCLDTAQRNYKDVMLENYRNLIFLGITVSKPDLITCLEQGRKPLTMKRNEMIAKPSVMCSHFA

SEQ ID NO: 3191 - protein, 81 aa, Pan paniscus
MGPLQFRDVAIEFSLEEWHCLDTAQRNYKDVMLENYRNLIFLGITVSKPDLITCLEQGRKPLTMKRNEMIAKPSVSFLQVH

SEQ ID NO: 3192 - protein, 81 aa, Pan paniscus
MGPLQFRDVAIEFSLEEWHCLDMAQRNLYRDVMLENYRNLVFLGIVVSKPDLITHLEQGKKPSTMKRHEMVANPSVLCSHF

SEQ ID NO: 3193 - protein, 81 aa, Pan paniscus
MGPLQFRDVAIEFSLEEWHCLDMAQRNLYRDVMLENYRNLVFLGIVVSKPDLITHLEQGKKPSTMKRHEMVANPSGPVLHI

SEQ ID NO: 3194 - protein, 81 aa, Pan paniscus
MGPLTFRDVAIEFSLEEWQCLDTAQRNLYRNVMLENYRNLVFLGIAVSKPDLITCLEQGKEAWSMKRHEIMVAKPTVMCSH

SEQ ID NO: 3195 - protein, 81 aa, Pan paniscus
MGPLTFRDVAIEFSLEEWQCLDTAQRNLYRNVMLENYRNLVFLDLITCLEQGKEAWSMKRHEIMVAKPTVMCSHFAQDLWP

SEQ ID NO: 3196 - protein, 81 aa, Pan paniscus
MGPLTFRDVAIEFSLEEWQCLDTAQRNLYRNVMLENYRNLVFLGIAVSKPDLITCLEQGKEAWSMKRHEIMVAKPTESYSV

SEQ ID NO: 3197 - protein, 81 aa, Pan paniscus
MGPLTFRDVAIEFSLEEWQCLDTAQRNLYRNVMLENYRNLVFLGIAVSKPDLITCLEQGKEAWSMKRHEIMVAKPTGEVSR

SEQ ID NO: 3198 - protein, 81 aa, Pan paniscus
MGPLTFRDVAIEFSLEEWQCLDTAQRNLYRNVMLENYRNLVFLGIAVSKPDLITCLEQGKEAWSMKRHEIMVAKPTGCLSK

SEQ ID NO: 3199 - protein, 81 aa, Pan paniscus
MGPLTFRDVAIEFSLEEWQCLDTAQRNLYRNVMLENYRNLVFLVMCSHFAQDLWPEQNIKDSFQKVTLKRYGKCRHENLPL

SEQ ID NO: 3200 - protein, 81 aa, Pan paniscus
ASGCPVADRNLLVYSFYEKGPLTFKDVAIEFSLEEWQCLDTAQQDLYRKVMLENYRNLVSLAGIAVSKPDLITCLEQGKEP

SEQ ID NO: 3201 - protein, 81 aa, Pan paniscus
SGCPVADRNLLVYSFYEKGPLTFKDVAIEFSLEEWQCLDTAQQDLYRKVMLENYRNLVSLGIAVSKPDLITCLEQGKEPWN

SEQ ID NO: 3202 - protein, 81 aa, Pan paniscus
MNVMLENYKNLVFLGIAVSKQDPITSLEQEKEPWNMKICEIVDESPGQVWCLTPVIPALWEARAGGLLEPRNLRPAWSTWK

SEQ ID NO: 3203 - protein, 81 aa, Pan paniscus
MNVMLENYKNLVFLGIAVSKQDPITSLEQEKEPWNMKICEIVDESPGYMCRMSYVFFFYQRPLARARHKRFFSTSDTEKTW

SEQ ID NO: 3204 - protein, 81 aa, Pan paniscus
MNVMLENYKNLVFLAGIAVSKQDPITSLEQEKEPWNMKICEIVDESPAMCSSFIRDLWPEQDIKDSFQQVILRRHGKCEHE

SEQ ID NO: 3205 - protein, 81 aa, Pan paniscus
MNVMLENYKNLVFLGIAVSKQDPITSLEQEKEPWNMKICEIVDESPAMCSSFIRDLWPEQDIKDSFQQVILRRHGKCEHEN

SEQ ID NO: 3206 - protein, 81 aa, Pan paniscus
SGCPGAERNLLVYSYFEKETLTFRDVAIEFSLEEWECLNPAQQNLYMNVMLENYKNLVFLGVAVSKQDPVTCLEQEKEPWN

SEQ ID NO: 3207 - protein, 81 aa, Pan paniscus
SQVQVILLPQPPELLGLQETLTFRDVAIEFSLEEWECLNPAQQNLYMNVMLENYKNLVFLGVAVSKQDPVTCLEQEKEPWN

SEQ ID NO: 3208 - protein, 81 aa, Pan paniscus
ASGCPGAERNLLVYSYFEKETLTFRDVAIEFSLEEWECLNPAQQNLYMNVMLENYKNLVFLAGVAVSKQDPVTCLEQEKEP

SEQ ID NO: 3209 - protein, 81 aa, Pan paniscus
MGPLTFMDVAIEFSLEEWQCLDTAQQNLYRNVMLENYRNLVFLGIAVSNLDLITCLEQGKEPWNMKIHEMVAKPPAMCSHF

SEQ ID NO: 3210 - protein, 81 aa, Pan paniscus
SGYPGAERNLLEYSYFEKGPLTFRDVVIEFSQEEWQCLDTAQQDLYRKVMLENFRNLVFLGIDVSKPDLITCLEQGKDPWN

SEQ ID NO: 3211 - protein, 81 aa, Pan paniscus
TPGPPESLEMGPLTFRDVAIEFSLEEWQCLDTAQQDLYRKVMLENYRNLVFLAGIAVSKPDLVTCLEQGKDPWNMKRHSTV

SEQ ID NO: 3212 - protein, 81 aa, Pan paniscus
MGPLTFRDVAIEFSLEEWQCLDTAQQDLYRKVMLENYRNLVFLGIAVSKPDLVTCLEQGKDPWNMKRHSTVVKPPVICSHF

SEQ ID NO: 3213 - protein, 81 aa, Pan paniscus
TPGPPESLEMGPLTFRDVAIEFSLEEWQCLDTAQQDLYRKVMLENYRNLVFLGIAVSKPDLVTCLEQGKDPWNMKRHSTVV

SEQ ID NO: 3214 - protein, 81 aa, Pan paniscus
GPLTFRDVAIEFSLEEWQCLDTAQQDLYRKVMLENYRNLVFLAGIAVSKPDLVTCLEQGKDPWNMKRHSTVVKPPGGDCSI

SEQ ID NO: 3215 - protein, 81 aa, Pan paniscus; identical to SEQ ID NO: 2392

SEQ ID NO: 3216 - protein, 81 aa, Pan paniscus
MGPLTFTDVAIEFSLEEWQCLDTAQQNLYRNVMLENYRNLVFLGIAVSKPDLITCLEKEKEPCKMKRHEMVDEPPDGVSLL

SEQ ID NO: 3217 - protein, 81 aa, Pan paniscus
RRYDKRGHENLQLRKGYKTVGDCKLYKGGYNGLNQCLTLTQSKMYHCDIYVKVFYAFSNADRYKTRHTGKKPFQCKKCGKP

SEQ ID NO: 3218 - protein, 81 aa, Pan paniscus
MGPLTFTDVAIEFSLEEWQCLDTAQQNLYRNVMLENYRNLVFLVVCSHFAEDFWPEQDIKDSFQKVTLRRYDKRGHENLQL

SEQ ID NO: 3219 - protein, 81 aa, Pan paniscus
MPGHPGSWEMGPLTFMDVAIEFCLEEWQCLDTAQQNLYRNVMLENYRNLVFLGIAVSKPDLITCLEQEKEPWEPVRRHEMV

SEQ ID NO: 3220 - protein, 81 aa, Pan paniscus
MDVAIEFCLEEWQCLDTAQQNLYRNVMLENYRNLVFLGIAVSKPDLITCLEQEKEPWEPVRRHEMVAKPPVMCSHFTQDFW

SEQ ID NO: 3221 - protein, 81 aa, Pan paniscus
MGPLTFMDVAIEFCLEEWQCLDTAQQNLYRNVMLENYRNLVFLGIAVSKPDLITCLEQEKEPWEPVRRHEMVAKPPVMCSH

SEQ ID NO: 3222 - protein, 81 aa, Pan paniscus
MDVAIEFCLEEWQCLDTAQQNLYRNVMLENYRNLVFLGIAVSKPDLITCLEQEKEPWEPVRRHEMVAKPPGGIVSLLNVFF

SEQ ID NO: 3223 - protein, 81 aa, Pan paniscus
MGSLTFRDVAIEFSLEEWQCLDTAQQNLYRNVMLENYRNLVFLGIAAFKPDLIIFLEEGKEPWNMKRHEMVEESPVICSHF

SEQ ID NO: 3224 - protein, 81 aa, Pan paniscus
MGSLTFRDVAIEFSLEEWQCLDTAQQNLYRNVMLENYRNLVFLGIAAFKPDLIIFLEEGKEPWNMKRHEMVEESPGMVGSS

SEQ ID NO: 3225 - protein, 81 aa, Pan paniscus
MGPLTIRDVTVEFSLEEWHCLDTAQQNLYRDVMLENYRNLVFLGIAVSKPDLITCLEQGKEPCNMKRHEMVAKPPDSHSVS

SEQ ID NO: 3226 - protein, 81 aa, Pan paniscus
MGPLTIRDVTVEFSLEEWHCLDTAQQNLYRDVMLENYRNLVFLGIAVSKPDLITCLEQGKEPCNMKRHEMVAKPPDGVSLF

SEQ ID NO: 3227 - protein, 81 aa, Pan paniscus; identical to SEQ ID NO: 2393

SEQ ID NO: 3228 - protein, 81 aa, Pan paniscus
MGPLTIRDVTVEFSLEEWHCLDTAQQNLYRDVMLENYRNLVFLGIAVSKPDLITCLEQGKEPCNMKRHEMVAKPPAFYLMG

SEQ ID NO: 3229 - protein, 81 aa, Pan paniscus
MPGAPGSLEMGPLTFRDVTIEFSLEEWQCLDTVQQNLYRDVMLENYRNLVFLGMAVFKPDLITCLKQGKEPWNMKRHEMVT

SEQ ID NO: 3230 - protein, 81 aa, Pan paniscus
CLKQGKEPWNMKRHEMVTKPPVMRSHFTQDLWPDQSTKDSFQEVILRTYARCGHKNLRLRKDCKSANEGKMHEEGYNKLNQ

SEQ ID NO: 3231 - protein, 81 aa, Pan paniscus
MLENYRNLVFMGIAASKPDLITCLEQGKEPWNVKRHEMVAEPPVVCSYFAQDLWPKQGKKNYFQKVVLRRYKKCGCENLQL

SEQ ID NO: 3232 - protein, 81 aa, Pan paniscus
MPGPLGSLEVGVLTFRDVAIEFSLEEWQCLDTAQQNLYRNVMLENYRNLVFMGIAASKPDLITCLEQGKEPWNVKRHEMVA

SEQ ID NO: 3233 - protein, 81 aa, Pan paniscus
PIPTSSMWSPMVRLGGFSPELQHLPQTLLHRCPLGQPRMGVLTFRDVAIEFSLEEWQCLDTAQQNLYRNVMLENYRNLVFM

SEQ ID NO: 3234 - protein, 81 aa, Pan paniscus
MGSLTFRDVTIEFSLEEWQCLDTAQQNLYRNVMLENYRNLVFLGIAVSKPDLITCLKQGKEPWNMKRHEMVTKPPVISSHF

SEQ ID NO: 3235 - protein, 81 aa, Pan paniscus
SEKCTRLILYDLKIALKNGSLTFRDVTIEFSLEEWQCLDTAQQNLYRNVMLENYRNLVFLGIAVSKPDLITCLKQGKEPWN

SEQ ID NO: 3236 - protein, 81 aa, Pan paniscus
MGPLTFTDVAIKFSLEEWQFLDTAQQNLYRDVMLENYRNLVFLGVGVSKPDLITCLEQGEEPWKRHKMVSKPPVVCSHFAQ

SEQ ID NO: 3237 - protein, 81 aa, Pan paniscus
MGSLTFWDVAIQFSLEEWQCLDTAQQNLYRNVMLENYRNLVFLGIAAPKPDLIIFLEQGKEPWNMKRHELVKEPPVICSHF

SEQ ID NO: 3238 - protein, 81 aa, Pan paniscus
MGALTFRDVAIEFSLEEWQCLDTEQQNLHRNVMLENYRNLVFLGIAVSKPDLITCLEQEKEPWNLKTHDMVAKPPVICSHI

SEQ ID NO: 3239 - protein, 81 aa, Pan paniscus; identical to SEQ ID NO: 2394

SEQ ID NO: 3240 - protein, 81 aa, Pan paniscus
MDVAIEFSVEEWQCLDTAQQNLYRNVMLENYRNLVFLGIAVSKPDLITCLEQGKEPWNMERHEMVAKPPGMCCYFAQDLWP

SEQ ID NO: 3241 - protein, 81 aa, Pan paniscus
TPGTPGSLEMGLLTFRDVAIEFSPEEWQCLDTAQQNLYRNVMLENYRNLAFLGIAVSKPDLITCLEQGKEPWNMKQHEMVD

SEQ ID NO: 3242 - protein, 81 aa, Pan paniscus
QYWRATAKTPGTPGSLEMGLLTFRDVAIEFSPEEWQCLDTAQQNLYRNVMLENYRNLAFLGIAVSKPDLITCLEQGKEPWN

SEQ ID NO: 3243 - protein, 81 aa, Pan paniscus
TPGTPGSLEMGLLTFRDVAIEFSPEEWQCLDTAQQNLYRNVMLENYRNLAFLGICPHFPQDFWPEQSMEDSFQKVLLRKYE

SEQ ID NO: 3244 - protein, 81 aa, Pan paniscus
MGLLTFRDVAIEFSLEEWQCLDTAQRNLYKNVILENYRNLVFLGIAVSKQDLITCLEQEKEPLTVKRHEMVNEPPGSVGQT

SEQ ID NO: 3245 - protein, 81 aa, Pan paniscus
MGLLTFRDVAIEFSLEEWQCLDTAQRNLYKNVILENYRNLVFLGIAVSKQDLITCLEQEKEPLTVKRHEMVNEPPGLPLMP

SEQ ID NO: 3246 - protein, 81 aa, Pan paniscus; identical to SEQ ID NO: 2395

SEQ ID NO: 3247 - protein, 81 aa, Pan paniscus
MGLLTFRDVAIEFSLEEWQCLDTAQRNLYKNVILENYRNLVFLGIAVSKQDLITCLEQEKEPLTVKRHEMVNEPPAVDKHP

SEQ ID NO: 3248 - protein, 81 aa, Pan paniscus
MGLLTFRDVAIEFSLEEWQCLDTAQRNLYKNVILENYRNLVFLGIAVSKQDLITCLEQEKEPLTVKRHEMVNEPPESCPVV

SEQ ID NO: 3249 - protein, 81 aa, Pan paniscus; identical to SEQ ID NO: 2396

SEQ ID NO: 3250 - protein, 81 aa, Pan paniscus
MGLLTFRDVAIEFSLEEWQCLDTAQKNLYRNVMLENYRNLAFLGIAVSKPDLIICLEKEKEPWNMKRDEMVDEPPDGVSLC

SEQ ID NO: 3251 - protein, 81 aa, Pan paniscus
MGLLTFRDVAIEFSLEEWQCLDTAQKNLYRNVMLENYRNLAFLGIAVSKPDLIICLEKEKEPWNMKRDEMVDEPPGLAVSN

SEQ ID NO: 3252 - protein, 81 aa, Pan paniscus; identical to SEQ ID NO: 2397

SEQ ID NO: 3253 - protein, 81 aa, Pan paniscus; identical to SEQ ID NO: 2398

SEQ ID NO: 3254 - protein, 81 aa, Pan paniscus
MPGPPRSLEMGLLTFRDVAIEFSLEEWQHLDIAQQNLYRNVMLENYRNLAFLGIAVSKPDLITCLEQGKEPWNMKRHEMVD

SEQ ID NO: 3255 - protein, 81 aa, Pan paniscus; identical to SEQ ID NO: 2399

SEQ ID NO: 3256 - protein, 81 aa, Pan paniscus; identical to SEQ ID NO: 2400

SEQ ID NO: 3257 - protein, 81 aa, Pan paniscus; identical to SEQ ID NO: 2401

SEQ ID NO: 3258 - protein, 81 aa, Pan paniscus
MSQVTFSDVAIDFSHEEWACLDSAQRDLYKDVMVQNYENLVSVGLSVTKPYVIMLLEDGKEPWMMEKKLSKDWESRWENKE

SEQ ID NO: 3259 - protein, 81 aa, Pan paniscus
EELVGQNHGMEGEACTGGDVTFSDVAIDFSHEEWACLDSAQRDLYKDVMVQNYENLVSVGLSVTKPYVIMLLEDGKEPWMM

SEQ ID NO: 3260 - protein, 81 aa, Pan paniscus
MSQVTFSDVAIDFSHEEWACLDSAQRDLYKDVMVQNYENLVSVGLSVTKPYVIMLLEDGKEPWMMEKKLSKGMIPDWESRW

SEQ ID NO: 3261 - protein, 81 aa, Pan paniscus
MSQVTFSDVAIDFSHEEWACLDSAQRDLYKDVMVQNYENLVSVAGLSVTKPYVIMLLEDGKEPWMMEKKLSKGMIPDWESR

SEQ ID NO: 3262 - protein, 81 aa, Pan paniscus
SNEELVGQNHGMEGEACIGGDVTFNDVAIDFSHEEWGWLSSAQRDLYKDVMVQNYENLVSVAGLSITKPYVITLLEDGKEP

SEQ ID NO: 3263 - protein, 81 aa, Pan paniscus
MPQVTFNDVAIDFSHEEWGWLSSAQRDLYKDVMVQNYENLVSVAGLSITKPYVITLLEDGKEPWMMEKKLSKGMIPHWESR

SEQ ID NO: 3264 - protein, 81 aa, Pan paniscus
MPQVTFNDVAIDFSHEEWGWLSSAQRDLYKDVMVQNYENLVSVGLSITKPYVITLLEDGKEPWMMEKKLSKGMIPHWESRR

SEQ ID NO: 3265 - protein, 81 aa, Pan paniscus
MPQVTFNDVAIDFSHEEWGWLSSAQRDLYKDVMVQNYENLVSVAGLSITKPYVITLLEDGKEPWMMEKKLSKDWESRRENK

SEQ ID NO: 3266 - protein, 81 aa, Pan paniscus
MAAPALALVSFEDVVVTFTGEEWGHLDLAQRTLYQEVMLETCRLLVSLGHPVPKPELIYLLEHGQELWTVKRGLSQSTCTG

SEQ ID NO: 3267 - protein, 81 aa, Pan paniscus
MAAPALALVSFEDVVVTFTGEEWGHLDLAQRTLYQEVMLETCRLLVSLGHPVPKPELIYLLEHGQELWTVKRGLSQSTCTA

SEQ ID NO: 3268 - protein, 81 aa, Pan paniscus
MAHKYVGLQYQGSVTFEDVAIAFSQQEWESLDSSQRGLYRDVMLENYRNLVSMAGHSLSKPHVIALLEQWKEPEVTVRKDG

SEQ ID NO: 3269 - protein, 81 aa, Pan paniscus
MAHKYVGLQYQGSVTFEDVAIAFSQQEWESLDSSQRGLYRDVMLENYRNLVSMGHSLSKPHVIALLEQWKEPEVTVRKDGR

SEQ ID NO: 3270 - protein, 81 aa, Pan paniscus
MAAAALRDPAQGCVTFEDVTIYFSQEEWVLLDEAQRLLYCDVMLENFALIASLGLISFRSHIVSQLEMGKEPWVPDSVDMT

SEQ ID NO: 3271 - protein, 81 aa, Pan paniscus
MAQGLVTFRDVAIEFSLEEWKCLEPAQRDLYREVTLENFGHLASLGLSISKPDVVSLLEQGKDPWMIANDVTGPWCPDLES

SEQ ID NO: 3272 - protein, 81 aa, Pan paniscus
EESREIRAGQIVLKAMAQGLVTFRDVAIEFSLEEWKCLEPAQRDLYREVTLENFGHLASLGLSISKPDVVSLLEQGKDPWM

SEQ ID NO: 3273 - protein, 81 aa, Pan paniscus
MAHGSVTFRDVAIDFSQEEWEFLDPAQRDLYRDVMWENYSNFISLGPSISKPDVITLLDEERKEPGMVVREGTRRYCPDLE

SEQ ID NO: 3274 - protein, 81 aa, Pan paniscus
MAHGSVTFRDVAIDFSQEEWEFLDPAQRDLYRDVMWENYSNFISLAGPSISKPDVITLLDEERKEPGMVVREGTRRYCPGE

SEQ ID NO: 3275 - protein, 81 aa, Pan paniscus
MALRSVMFSDVSIDFSPEEWEYLDLEQKDLYRDVMLENYSNLVSLGCFISKPDVISSLEQGKEPWKVVRKGRRQYPDLETK

SEQ ID NO: 3276 - protein, 81 aa, Pan paniscus
MALRSVMFSDVSIDFSPEEWEYLDLEQKDLYRDVMLENYSNLVSLAGCFISKPDVISSLEQGKEPWKVVRKGRRQYPDLET

SEQ ID NO: 3277 - protein, 81 aa, Pan paniscus
MAQESVMFSDVSVDFSQEEWECLNDDQRDLYRDVMLENYSNLVSMGHSISKPNVISYLEQGKEPWLVDRELTRGQWPVLES

SEQ ID NO: 3278 - protein, 81 aa, Pan paniscus
MAQESVMFSDVSVDFSQEEWECLNDDQRDLYRDVMLENYSNLVSMAGHSISKPNVISYLEQGKEPWLVDRELTRGQWPVLE

SEQ ID NO: 3279 - protein, 81 aa, Pan paniscus
PVLESRCETKKLFLKKEIYEIESTQWEIMEKLTRHDFQCSSFRDDWECNRQFKKELGSQGGHFNQLVFTHEDLPTLSHHPS

SEQ ID NO: 3280 - protein, 81 aa, Pan paniscus
MPEVEFPDQFFTVLTMDHELVTLRDVVINFSQEEWEYLDSAQRNLYWDVMMENYSNLLSLDLESRNETKHLSVGKDIKNTG

SEQ ID NO: 3281 - protein, 81 aa, Pan paniscus
MMENYSNLLSLDLESRNETKHLSVGKDIKNTGSQWEVMESSKLCGLEGSIFRNDWQSKSKIEVQGPEVGYFSQMKIISENV

SEQ ID NO: 3282 - protein, 81 aa, Pan paniscus
FTVLTMDHELVTLRDVVINFSQEEWEYLDSAQRNLYWDVMMENYSNLLSLDLESRNETKHLSVGKDIKNTGSQWEVMESSK

SEQ ID NO: 3283 - protein, 81 aa, Pan paniscus
MPLQGSVSFKDVTVDFTQEEWQQLDPAQKALYRDVMLENYCHFVSVGFHMAKPDMIRKLEQGEELWTQRIFPSYSYLEEDG

SEQ ID NO: 3284 - protein, 81 aa, Pan paniscus
FHMAKPDMIRKLEQGEELWTQRIFPSYSYLEEDGKTEDVLVKFKEYQDRHSRSLILINHKKLIKERSNIYGKTFTLGRNRI

SEQ ID NO: 3285 - protein, 81 aa, Pan paniscus
MSQGSVSFKDVTVDFTQEEWQQLDPAQKALYRDVMLENYCHFVSVGFHMAKPDMIRKLEQGEELWTQRIFPSYSYLEEDGK

SEQ ID NO: 3286 - protein, 81 aa, Pan paniscus
MPLQGSVSFKDVTVDFTQEEWQQLDPAQKALYRDVMLENYCHFVSVGFHMAKPDMIRKLEQGEELWTQRIFPSYSYLEDGK

SEQ ID NO: 3287 - protein, 81 aa, Pan paniscus
GFHMAKPDMIRKLEQGEELWTQRIFPSYSYLEDGKTEDVLVKFKEYQDRHSRSLILINHKKLIKERSNIYGKTFTLGRNRI

SEQ ID NO: 3288 - protein, 81 aa, Pan paniscus
MAHELVMFRDVAIDVSQEEWECLNPAQRNLYKEVMLENYSNLVSLGLSVSKPAVISSLEQGKEPWMVVREETGRWCPGTWK

SEQ ID NO: 3289 - protein, 81 aa, Pan paniscus
MAHELVMFRDVAIDVSQEEWECLNPAQRNLYKEVMLENYSNLVSLGLSVSKPAVISSLEQGKEPWMVVREETGRWCPDLAS

SEQ ID NO: 3290 - protein, 81 aa, Pan paniscus
LTHELVMFRDVAIDVSQEEWECLNPAQRNLYKEVMLENYSNLVSLGLSVSKPAVISSLEQGKEPWMVVREETGRWCPGTWK

SEQ ID NO: 3291 - protein, 81 aa, Pan paniscus
MAQGSVSFNDVTVDFTQEEWQHLDHAQKTLYMDVMLENYCHLISVGCHMTKPDVILKLERGEEPWTSFAGHTCLEENWKAE

SEQ ID NO: 3292 - protein, 81 aa, Pan paniscus
MDVMLENYCHLISVGCHMTKPDVILKLERGEEPWTSFAGHTCLEENWKAEDFLVKFKEHQEKYSRSVVSINHKKLVKEKSK

SEQ ID NO: 3293 - protein, 81 aa, Pan paniscus
MNMEGLVMFQDLSIDFSQEEWECLDAAQKDLYRDVMMENYSSLVSLGLSIPKPDVISLLEQGKEPWMVSRDVLGGWCRDRL

SEQ ID NO: 3294 - protein, 81 aa, Pan paniscus
MNMEGLVMFQDLSIDFSQEEWECLDAAQKDLYRDVMMENYSSLVSLDSEFRCKTKDSCLPKEIYEVTSSQWVRMEKCHSLV

SEQ ID NO: 3295 - protein, 81 aa, Pan paniscus
MNMEGLVMFQDLSIDFSQEEWECLDAAQKDLYRDVMMENYSSLVSLGLSIPKPDVISLLEQGKEPWMVSRDVLGGWCRDSE

SEQ ID NO: 3296 - protein, 81 aa, Pan paniscus
MAHLMMFRDVAVDFSQEEWECLDLEQRGLYRDVMLENYSNMVSLGLCIYQPEAFSLLEKGKEPWKILRDETRGPCPDMQSR

SEQ ID NO: 3297 - protein, 81 aa, Pan paniscus
HPEEEERMHDELLQAVSKGPVMFRDVSIDFSQEEWECLDAGQMNLYKEVMLENFSNLVSVGLSNSKPAVISLLEQGKEPWM

SEQ ID NO: 3298 - protein, 81 aa, Pan paniscus
CSQESALSEEEEDTTRPLETVTFKDVAVDLTQEEWEQMKPAQRNLYRDVMLENYSNLVTVGCQVTKPDVIFKLEQEEEPWV

SEQ ID NO: 3299 - protein, 81 aa, Pan paniscus
QEEWEQMKPAQRNLYRDVMLENYSNLVTVGCQVTKPDVIFKLEQEEEPWVMEEEMFGRHCPERRGENCCASEVMAEMEFCS

SEQ ID NO: 3300 - protein, 81 aa, Pan paniscus
MKPAQRNLYRDVMLENYSNLVTVGCQVTKPDVIFKLEQEEEPWVMEEEMFGRHCPEVWEVDEQIKKQQETLVRKVTSISKK

SEQ ID NO: 3301 - protein, 81 aa, Pan paniscus
RHCPERRGENCCASEVMAEGLKFKDVVIYFSQKEWECLHSAQKDLYRDVMLENYGNLVLLGLSDTKPNVISLLEQKKEPWM

SEQ ID NO: 3302 - protein, 81 aa, Pan paniscus
MKPAQRNLYRDVMLENYSNLVTVGCQVTKPDVIFKLEQEEEPWVMEEEMFGRHCPERRGENCCASEVMAEGLKFKDVVIYF

SEQ ID NO: 3303 - protein, 81 aa, Pan paniscus
MAEGLKFKDVVIYFSQKEWECLHSAQKDLYRDVMLENYGNLVLLGLSDTKPNVISLLEQKKEPWMVKRKETKEWCPDWEFG

SEQ ID NO: 3304 - protein, 81 aa, Pan paniscus
MARKLVMFRDVAIDFSQEEWECLDSAQRDLYRDVMLENYSNLVSLDLPSRCASKDLSPEKNTYETELSQWEMSDRFENCDL

SEQ ID NO: 3305 - protein, 81 aa, Pan paniscus
TELSQWEMSDRFENCDLEESNSRDYLEAKGKMEKQQENQKEYFRQGMIIYDKMSIFNQHTYLSQHSRCHSTEKPYKCKECG

SEQ ID NO: 3306 - protein, 81 aa, Pan paniscus
LAPEDHGSSYEGSVSFRDVAIDFSREEWRHLDPSQRNLYRDVMLETYSHLLSVGYQVPEAEVVMLQQGKEPWALQGERPRH

SEQ ID NO: 3307 - protein, 81 aa, Pan paniscus
SPQKSSTLAPEDHGSSYEGSVSFRDVAIDFSREEWRHLDLSQRNLYRDVMLETYSHLLSVGYQVPKPEVVMLEQGKEPWAL

SEQ ID NO: 3308 - protein, 81 aa, Pan paniscus
SPQKSSALAPEDHGSSYEGSVSFRDVAIDFSREEWRHLDPSQRNLYRDVMLETYSHLLSVGYQVPEAEVVMLQQGKEPWAL

SEQ ID NO: 3309 - protein, 81 aa, Pan paniscus
MQLNEEINKGSVSFRDVAIDFSREEWRHLDLSQRNLYRDVMLETYSHLLSVGYQVPKPEVVMLEQGKEPWALQGERPRHSC

SEQ ID NO: 3310 - protein, 81 aa, Pan paniscus
REEWRHLDLSQRNLYRDVMLETYSHLLSVGYQVPKPEVVMLEQGKEPWALQGERPRHSCPGEKLWDHNQHRKIIGYKPASS

SEQ ID NO: 3311 - protein, 81 aa, Pan paniscus
NEEINKGSVSFRDVAIDFSREEWRHLDLSQRNLYRDVMLETYSHLLSVGYQVPKPEVVMLEQGKEPWALQGERPRHSCPGE

SEQ ID NO: 3312 - protein, 81 aa, Pan paniscus
MAEGSVMFSDVSIDFSQEEWDCLDPVQRDLYRDVMLENYSNLVSMGLYTPKPQVISLLEQGKEPWMVGRELTRGLCSDLES

SEQ ID NO: 3313 - protein, 81 aa, Pan paniscus
MAEGSVMFSDVSIDFSQEEWDCLDPVQRDLYRDVMLENYSNLVSMGKGICTSDSQFSSGMSASSTVNFSAAFQDFTLLSLK

SEQ ID NO: 3314 - protein, 81 aa, Pan paniscus
MLETYNHLVSLEIPSSKPKLIAQLERGEEPWREERKCPLDLCPESKPEIQLSPSCPLIFSNQQALSQHVWLSHLSQLFSSL

SEQ ID NO: 3315 - protein, 81 aa, Pan paniscus
GEEPWREERKCPLDLCPESKPEIQLSPSCPLIFSNQQALSQHVWLSHLSQLFSSLWAGNPLQLGKHYPEDPKQQQDPFCLS

SEQ ID NO: 3316 - protein, 81 aa, Pan paniscus
MATGLLRAKKEEEWRLLSPAQRTLHREVMLETYNHLVSLEIPSSKPKLIAQLERGEEPWREERKCPLDLCPAESKPEIQLS

SEQ ID NO: 3317 - protein, 81 aa, Pan paniscus
KLIAQLERGEEPWREERKCPLDLCPAESKPEIQLSPSCPLIFSNQQALSQHVWLSHLSQLFSSLWAGNPLQLGKHYPEDPK

SEQ ID NO: 3318 - protein, 81 aa, Pan paniscus
MATGLLRAKKEAFVAFRDVAVDFTQEEWRLLSPAQRTLHREVMLETYNHLVSLEIPSSKPKLIAQLERGEEPWREERKCPL

SEQ ID NO: 3319 - protein, 81 aa, Pan paniscus
PWREERKCPLDLCPESKPEIQLSPSCPLIFSNQQALSQHVWLSHLSQLFSSLWAGNPLQLGKHYPEDPKQQQDPFCLSGKA

SEQ ID NO: 3320 - protein, 81 aa, Pan paniscus
WREERKCPLDLCPAESKPEIQLSPSCPLIFSNQQALSQHVWLSHLSQLFSSLWAGNPLQLGKHYPEDPKQQQDPFCLSGKA

SEQ ID NO: 3321 - protein, 81 aa, Pan paniscus
TCMVHRQTMSCSGAGGITAFVAFRDVAVDFTQEEWRLLSPAQRTLHREVMLETYNHLVSLEIPSSKPKLIAQLERGEEPWR

SEQ ID NO: 3322 - protein, 81 aa, Pan paniscus
MAVGLCKAMSQGLVTFRDVALDFSQEEWEWLKPSQKDLYRDVMLENYRNLVWLGLSISKPNMISLLEQGKEPWMVERKMSQ

SEQ ID NO: 3323 - protein, 81 aa, Pan paniscus
MAVGLCKAMSQGLVTFRDVALDFSQEEWEWLKPSQKDLYRDVMLENYRNLVWLDWESWCEIEELSPKWFIDEDEISQEMVM

SEQ ID NO: 3324 - protein, 81 aa, Pan paniscus
MAVGLCKAMSQGLVTFRDVALDFSQEEWEWLKPSQKDLYRDVMLENYRNLVWLGDGCSCHSTLRTTVTAEASSSSSSIQAS

SEQ ID NO: 3325 - protein, 81 aa, Pan paniscus
MTESQGTVTFKDVAIDFTQEEWKRLDPAQRKLYRNVMLENYNNLITVGYPFTKPDVIFKLEQEEEPWVMEEEVLRRHWQGE

SEQ ID NO: 3326 - protein, 81 aa, Pan paniscus
TSAGPIPSQKEEEMTESQGTVTFKDVAIDFTQEEWKRLDPAQRKLYRNVMLENYNNLITVGYPFTKPDVIFKLEQEEEPWV

SEQ ID NO: 3327 - protein, 81 aa, Pan paniscus
EMTESQGTVTFKDVAIDFTQEEWKRLDPAQRKLYRNVMLENYNNLITVGYPFTKPDVIFKLEQEEEPWVMEEEVLRRHWQG

SEQ ID NO: 3328 - protein, 81 aa, Pan paniscus
KSQEEERMAVGLLKAMYQELVTFRDVAVDFSQEEWDCLDSSQRHLYSNVMLENYRILVSLGLCFSKPSVILLLEQGKAPWM

SEQ ID NO: 3329 - protein, 81 aa, Pan paniscus
PICETEELTPKQDFYEEHQSQKIIETLTSYNLEYSSLREEWKCEGYFERQPRNQKACFKEEIITHEEPLFDEREQEYKSWG

SEQ ID NO: 3330 - protein, 81 aa, Pan paniscus
MAVGLLKAMYQELVTFRDVAVDFSQEEWDCLDSSQRHLYSNVMLENYRILVSLGLCFSKPSVILLLEQGKAPWMVKRELTK

SEQ ID NO: 3331 - protein, 81 aa, Pan paniscus
QGKAPWMVKRELTKGLCSGWEPICETEELTPKQDFYEEHQSQKIIETLTSYNLEYSSLREEWKCEGYFERQPRNQKACFKE

SEQ ID NO: 3332 - protein, 81 aa, Pan paniscus
MIEYQIPVSFKDVVVGFTQEEWHQLSPAQRALYRDVMLETYSNLVSVGYEGTKPDVILRLEQEEAPWIGEAACPGCHCWED

SEQ ID NO: 3333 - protein, 81 aa, Pan paniscus
MIEYQIPVSFKDVVVGFTQEEWHQLSPAQRALYRDVMLETYSNLVSVGYEGTKPDVILRLEQEEAPWIGEAACPGCHCWGI

SEQ ID NO: 3334 - protein, 81 aa, Pan paniscus
VVVGFTQEEWHQLSPAQRALYRDVMLETYSNLVSVGYEGTKPDVILRLEQEEAPWIGEAACPGCHCWGISKLWPTDWPPAL

SEQ ID NO: 3335 - protein, 81 aa, Pan paniscus
MIEYQIPVSFKDVVVGFTQEEWHQLSPAQRALYRDVMLETYSNLVSVGYEGTKPDVILRLEQEEAPWIGEAACPGCHCWGK

SEQ ID NO: 3336 - protein, 81 aa, Pan paniscus
EWHQLSPAQRALYRDVMLETYSNLVSVGYEGTKPDVILRLEQEEAPWIGEAACPGCHCWGKCDKSSKKGTEGGWHLWNFVQ

SEQ ID NO: 3337 - protein, 81 aa, Pan paniscus
EWHQLSPAQRALYRDVMLETYSNLVSVGYEGTKPDVILRLEQEEAPWIGEAACPGCHCWEDIWRVNIQRKRRQDMLLRQGA

SEQ ID NO: 3338 - protein, 81 aa, Pan paniscus
SFKDVVVGFTQEEWHQLSPAQRALYRDVMLETYSNLVSVGYEGTKPDVILRLEQEEAPWIGEAACPGCHCWALTVLRELQP

SEQ ID NO: 3339 - protein, 81 aa, Pan paniscus
FKDVVVGFTQEEWHQLSPAQRALYRDVMLETYSNLVSVGYEGTKPDVILRLEQEEAPWIGEAACPGCHCWALTVLRELQPH

SEQ ID NO: 3340 - protein, 81 aa, Pan paniscus
MAHALVTFRDVAIDFSQKEWECLDTTQRKLYRDVMLENYNNLVSLGYSGSKPDVITLLEQGKEPCVAARDVTGRQCPGLLS

SEQ ID NO: 3341 - protein, 81 aa, Pan paniscus
MAHALVTFRDVAIDFSQKEWECLDTTQRKLYRDVMLENYNNLVSLGLLSLHKTKKLSSEKDIHEISLSKGSIIEKSKTLHV

SEQ ID NO: 3342 - protein, 81 aa, Pan paniscus
MAHALVTFRDVAIDFSQKEWECLDTTQRKLYRDVMLENYNNLVSLAGYSGSKPDVITLLEQGKEPCVAARDVTGRQCPGLL

SEQ ID NO: 3343 - protein, 81 aa, Pan paniscus
MPHLLVTFRDVAIDFSQEEWECLDPAQRDLYRDVMLENYSNLISLEPARTHEEQHNLPVPKAGSVNLAAGFGHSRSQTGCG

SEQ ID NO: 3344 - protein, 81 aa, Pan paniscus
MPHLLVTFRDVAIDFSQEEWECLDPAQRDLYRDVMLENYSNLISLDLESSCVTKKLSPEKEIYEMESLQWENMGKLTNHHL

SEQ ID NO: 3345 - protein, 81 aa, Pan paniscus
MDLLFQLLVTFRDVAIDFSQEEWECLDPAQRDLYRDVMLENYSNLISLDLESSCVTKKLSPEKEIYEMESLQWENMGKLTN

SEQ ID NO: 3346 - protein, 81 aa, Pan paniscus
MARDLVMFRDVAVDFSQEEWECLNSYQRNLYRDVILENYSNLVSLGCSISKPDVITLLEQGKEPWMVVRDEKRRWTLGPTF

SEQ ID NO: 3347 - protein, 81 aa, Pan paniscus
MARDLVMFRDVAVDFSQEEWECLNSYQRNLYRDVILENYSNLVSLAGCSISKPDVITLLEQGKEPWMVVRDEKRRWTLDLE

SEQ ID NO: 3348 - protein, 81 aa, Pan paniscus
MARDLVMFRDVAVDFSQEEWECLNSYQRNLYRDVILENYSNLVSLGCSISKPDVITLLEQGKEPWMVVRDEKRRWTLDLES

SEQ ID NO: 3349 - protein, 81 aa, Pan paniscus
MAYGSITFGDVAIDFSHQEWEYLSLVQKTLYQEVMMENYDNLVSLAGHSVSKPDLITLLEQGKEPWMIVREETRGECTDLD

SEQ ID NO: 3350 - protein, 81 aa, Pan paniscus
MAYGSITFGDVAIDFSHQEWEYLSLVQKTLYQEVMMENYDNLVSLGHSVSKPDLITLLEQGKEPWMIVREETRGECTDLDS

SEQ ID NO: 3351 - protein, 81 aa, Pan paniscus
MAYGSITFGDVAIDFSHQEWEYLSLVQKTLYQEVMMENYDNLVSLGHSVSKPDLITLLEQGKEPWMIVREETRGECTAELQ

SEQ ID NO: 3352 - protein, 81 aa, Pan paniscus
CNWGRPLKVCPTKYMKFQELVTFRDVAIDFSRQEWEYLDPNQRDLYRDVMLENYRNLVSLGGHSISKPVVVDLLERGKEPW

SEQ ID NO: 3353 - protein, 81 aa, Pan paniscus
HQVGLIRSYNSKTMTCFQELVTFRDVAIDFSRQEWEYLDPNQRDLYRDVMLENYRNLVSLGGHSISKPVVVDLLERGKEPW

SEQ ID NO: 3354 - protein, 81 aa, Pan paniscus
MLENYRNLVSLDLDLQCEIISYIEVPTYETDISSTQLQSIYKREKLYECKKCQKKFSSGYQLILHHRFHVIERPYECKECG

SEQ ID NO: 3355 - protein, 81 aa, Pan paniscus
HQVGLIRSYNSKTMTCFQELVTFRDVAIDFSRQEWEYLDPNQRDLYRDVMLENYRNLVSLEMRSRCVARVGLKLLVSSDPP

SEQ ID NO: 3356 - protein, 81 aa, Pan paniscus
EPHQVGLIRSYNSKTMTCELVTFRDVAIDFSRQEWEYLDPNQRDLYRDVMLENYRNLVSLGGHSISKPVVVDLLERGKEPW

SEQ ID NO: 3357 - protein, 81 aa, Pan paniscus
MTCFQELVTFRDVAIDFSRQEWEYLDPNQRDLYRDVMLENYRNLVSLGGHSISKPVVVDLLERGKEPWMILREETQFTVRI

SEQ ID NO: 3358 - protein, 81 aa, Pan paniscus
TCNWGRPLKVCPTKYMKFQELVTFRDVAIDFSRQEWEYLDPNQRDLYRDVMLENYRNLVSLGGHSISKPVVVDLLERGKEP

SEQ ID NO: 3359 - protein, 81 aa, Pan paniscus
EETQGELTSSCGSKTMANVSLAFRDVSIDLSQEEWECLDTVQRDLYKDVMLENYSNLVSLGYTIPKPDVITLLEQEKEPWI

SEQ ID NO: 3360 - protein, 81 aa, Pan paniscus
MQVDPPLHGPPNDFLIFQIIPLHSLSIMPRFLWILCFSMEETQGELTSSCGSKTMANVSLAFRDVSIDLSQEEWECLDTVQ

SEQ ID NO: 3361 - protein, 81 aa, Pan paniscus
MVHGSVTFRDVAIDFSQEEWECLQPDQRTLYRDVMLENYSHLISLGSSISKPDVITLLEQEKEPWIVVSKETSRWYPDLES

SEQ ID NO: 3362 - protein, 81 aa, Pan paniscus
MVHGSVTFRDVAIDFSQEEWECLQPDQRTLYRDVMLENYSHLISLAGSSISKPDVITLLEQEKEPWIVIWSQNMDLRKYLQ

SEQ ID NO: 3363 - protein, 81 aa, Pan paniscus
MLENYSHLISLGSSISKPDVITLLEQEKEPWMVVRKETSRRYPDLESKYGPEKASPENDTSEVNLPKQVIKQISTTLGVEA

SEQ ID NO: 3364 - protein, 81 aa, Pan paniscus
GRSPRKIDQFCNSSNMVHGSVTFRDVAIDFSQEEWECLQPDQRTLYRDVMLENYSHLISLGSSISKPDVITLLEQEKEPWM

SEQ ID NO: 3365 - protein, 81 aa, Pan paniscus
MVHGSVTFRDVAIDFSQEEWECLQPDQRTLYRDVMLENYSHLISLGSSISKPDVITLLEQEKEPWMVVRKETSRRYPDLES

SEQ ID NO: 3366 - protein, 81 aa, Pan paniscus
MVHGSVTFRDVAIDFSQEEWECLQPDQRTLYRDVMLENYSHLISLAGSSISKPDVITLLEQEKEPWMVVRKETSRRYPDLE

SEQ ID NO: 3367 - protein, 81 aa, Pan paniscus
ESHGALISSRSSRTMTDGLVTFRDVAIDFSQEEWECLDPAQRDLYVDVMLENYSNLVSLDLESTTYETKKIFSENDIFEIN

SEQ ID NO: 3368 - protein, 81 aa, Pan paniscus
EESHGALISSRSSRTMTDGLVTFRDVAIDFSQEEWECLDPAQRDLYVDVMLENYSNLVSLDLESTTYETKKIFSENDIFEI

SEQ ID NO: 3369 - protein, 81 aa, Pan paniscus
ESCSGFSGFCASPIEESHGALISSRSSRTMTDGLVTFRDVAIDFSQEEWECLDPAQRDLYVDVMLENYSNLVSLGKLICLK

SEQ ID NO: 3370 - protein, 81 aa, Pan paniscus
MAQVPLTFSYVAIDFSQEEWEYLNSDQRDLYRDVMLENYTNLVSLEFDFTTESDKLSSEKRNYEVNAYHQETWKRNKTFNL

SEQ ID NO: 3371 - protein, 81 aa, Pan paniscus
FQVPLTFSYVAIDFSQEEWEYLNSDQRDLYRDVMLENYTNLVSLEFDFTTESDKLSSEKRNYEVNAYHQETWKRNKTFNLM

SEQ ID NO: 3372 - protein, 81 aa, Pan paniscus
MTKSKEAVTFKDVAVVFSEEELQLLDLAQRKLYQDVMLENFRNVVSVGHQSTPDGLPQLEREEKLWMMKMATQRDNSSGAK

SEQ ID NO: 3373 - protein, 81 aa, Pan paniscus
MLENFRNVVSVGHQSTPDGLPQLEREEKLWMMKMATQRDNSSGAKNLKEMETLQEVGLRYLPHEELFCSQIWQQITRELIK

SEQ ID NO: 3374 - protein, 81 aa, Pan paniscus
HLGLCKFPEVEGKMTTFKETVTFKDVAVVFTEEELGLLDPAQRKLYRDVMLENFRSLLLVGNQPFHQDTFHFLRKEEFWMM

SEQ ID NO: 3375 - protein, 81 aa, Pan paniscus
AQRKLYRDVMLENFRSLLLVGNQPFHQDTFHFLRKEEFWMMKTTSQREGNSGGKIQIEMETVPEAGPHEEWSYQQIREQIA

SEQ ID NO: 3376 - protein, 81 aa, Pan paniscus
MTTFKEAVTFKDVAVVFTEEELGLLDPAQRKLYRDVMLENFRNLLSVGHQPFHQDTCHFLREEKFWMMGTATQREGNSGGK

SEQ ID NO: 3377 - protein, 81 aa, Pan paniscus
FKDVAVVFTEEELGLLDPAQRKLYRDVMLENFRNLLSVGHQPFHQDTCHFLREEKFWMMGTATQREGNSGGKIQTELESVP

SEQ ID NO: 3378 - protein, 81 aa, Pan paniscus
LREEKFWMMGTATQREGNSGGKIQTELESVPEAGAHEEWSCQQIWEQIAKDLTRSQDCIINNSQFFENGDVPSQVEAGLPT

SEQ ID NO: 3379 - protein, 81 aa, Pan paniscus
MIKRSKVLVFCSKIMEEAVTFKDVAVVFTEEELGLLDPAQRKLYRDVMLENFRNLLSVGHQPFHQDTCHFLREEKFWMMGT

SEQ ID NO: 3380 - protein, 81 aa, Pan paniscus
DPAQRKLYRDVMLENFRNLLSVGHQPFHQDTCHFLREEKFWMMGTATQREGNSGGKIQTELESVPEAGAHEEWSCQQIWEQ

SEQ ID NO: 3381 - protein, 81 aa, Pan paniscus
DVMLENFRNLLSVGHQPFHQDTCHFLREEKFWMMGTATQREGNSGGKIQTELESVPEAGAHEEWSCQQIWEQIAKDLTRSQ

SEQ ID NO: 3382 - protein, 81 aa, Pan paniscus
MTTCKEAVTFKDVAVFFTEEELGLLDPAQRKLYQDVMLENFTNLLSVGHQPFHPFHFLREEKFWMMETATQREGNSGGKTV

SEQ ID NO: 3383 - protein, 81 aa, Pan paniscus
INNSHFFEQGDVPSQVEAGLSIIHTGQKPSQNGKCKQSFSDVAIFDPPQQFHSGEKSHTCNECGKSFCYISALRIHQRVHL

SEQ ID NO: 3384 - protein, 81 aa, Pan paniscus
MTTCKEAVTFKDVAVFFTEEELGLLDPAQRKLYQDVMLENFTNLLSVGHQPFHPFHFLREEKFWMMETATQREGNSGKKQA

SEQ ID NO: 3385 - protein, 81 aa, Pan paniscus
MIDSGEKKPGRRAEEAVTFKDVAVIFTEEELGLLDPAQRKLYRDVMLENFRNLLSVGHQPFHGDTFHFLREEKFWVMGTTS

SEQ ID NO: 3386 - protein, 81 aa, Pan paniscus
GRRAEEAVTFKDVAVIFTEEELGLLDPAQRKLYRDVMLENFRNLLSVGHQPFHGDTFHFLREEKFWVMGTTSQREGNLGPL

SEQ ID NO: 3387 - protein, 81 aa, Pan paniscus
MAKLYEAVTFKDVAVIFTEEELGLLDPAQRKLYRDVMLENFRNLLSVGGKIQTEMETVPEAGTHEEFSCKQIWEQIASDLT

SEQ ID NO: 3388 - protein, 81 aa, Pan paniscus
HSGLCKFPKVGGKMTMSKEAVTFKDVAVVFTEEELGLLDLAQRKLYRDVMLENFRNLLSVGHQPFHRDTFHFLREEKFWMM

SEQ ID NO: 3389 - protein, 81 aa, Pan paniscus
MTMSKEAVTFKDVAVVFTEEELGLLDLAQRKLYRDVMLENFRNLLSVGHQPFHRDTFHFLREEKFWMMDIATQREGNSGGK

SEQ ID NO: 3390 - protein, 81 aa, Pan paniscus
MTMSKEAVTFKDVAVVFTEEELGLLDLAQRKLYRDVMLENFRNLLSVGHQPFHRDTFHFLREEKFWMMDIATQREGNSGKK

SEQ ID NO: 3391 - protein, 81 aa, Pan paniscus
TFKDVAVVFTEEELGLLDLAQRKLYRDVMLENFRNLLSVGHQPFHRDTFHFLREEKFWMMDIATQREGNSGKKHATVCPCL

SEQ ID NO: 3392 - protein, 81 aa, Pan paniscus
MTMSKEAVTFKDVAVVFTEEELGLLDLAQRKLYRDVMLENFRNLLSVGHQPFHRDTFHFLREEKFWMMDIATQREGNSGGS

SEQ ID NO: 3393 - protein, 81 aa, Pan paniscus
MLENFRNLLSVGHQPFHRDTFHFLREEKFWMMDIATQREGNSGGKIQPEMKTFPEAGPHEGWSCQQIWEEIASDLTRPQDS

SEQ ID NO: 3394 - protein, 81 aa, Pan paniscus
MTMFKEAVTFKDVAVVFTEEELGLLDVSQRKLYRDVMLENFRNLLSVGHQLSHRDTFHFQREEKFWIMETATQREGNSGGK

SEQ ID NO: 3395 - protein, 81 aa, Pan paniscus
QREEKFWIMETATQREGNSGGKIQTELESVPETGPQEEWSCQQIWEQTASELTRPQDSISSSQFSTQGDVPSQVDAGLSII

SEQ ID NO: 3396 - protein, 81 aa, Pan paniscus
MTTFKEAMTFKDVAVVFTEEELGLLDLAQRKLYRDVMLENFRNLLSVGHQAFHRDTFHFLREEKIWMMKTAIQREGNSGDK

SEQ ID NO: 3397 - protein, 81 aa, Pan paniscus
MTTLKEAVTFKDVAVVFTEEELRLLDLAQRKLYREVMLENFRNLLSVGHQSLHRDTFYFLKEEKFWMMEIATQREGNLGGK

SEQ ID NO: 3398 - protein, 81 aa, Pan paniscus
ELRLLDLAQRKLYREVMLENFRNLLSVGHQSLHRDTFYFLKEEKFWMMEIATQREGNLGGKIQTEMETVSESGTHEGLFSH

SEQ ID NO: 3399 - protein, 81 aa, Pan paniscus
RNLLSVGHQSLHRDTFYFLKEEKFWMMEIATQREGNLGGKIQTEMETVSESGTHEGLFSHQTWEQISSDLTRFQDSMVNSF

SEQ ID NO: 3400 - protein, 81 aa, Pan paniscus
MTTLKEAVTFKDVAVVFTEEELRLLDLAQRKLYREVMLENFRNLLSVGHQSLHRDTFYFLKEEKFWMMEIATQREGNLGPA

SEQ ID NO: 3401 - protein, 81 aa, Pan paniscus
KDVAVVFTEEELRLLDLAQRKLYREVMLENFRNLLSVGHQSLHRDTFYFLKEEKFWMMEIATQREGNLGPAFQIPIKTEGF

SEQ ID NO: 3402 - protein, 81 aa, Pan paniscus
MTTFKEGLTFKDVAVVFTEEELGLLDPVQRNLYQDVMLENFRNLLSVGHHPFKHDVFLLEKEKKLDIMKTAIQRKGKSADK

SEQ ID NO: 3403 - protein, 81 aa, Pan paniscus
MTTFKEGLTFKDVAVVFTEEELGLLDPVQRNLYQDVMLENFRNLLSVADKIQSEVETVPEAGRHEELYWGQIWKQIASDLI

SEQ ID NO: 3404 - protein, 81 aa, Pan paniscus
MNMFKEAVTFKDVAVAFTEEELGLLGPAQRKLYRDVMVENFRNLLSVGHQPFKQDVSPIERNEQLWIMTTATRRQGNLGEK

SEQ ID NO: 3405 - protein, 81 aa, Pan paniscus
VGHQPFKQDVSPIERNEQLWIMTTATRRQGNLGEKNQSKLITVQDRESEEELSCWQIWQQIANDLTRCQDSMINNSQCHKQ

SEQ ID NO: 3406 - protein, 81 aa, Pan paniscus
MNMFKEAVTFKDVAVAFTEEELGLLGPAQRKLYRDVMVENFRNLLSVGHQPFKQDVSPIERNEQLWIMTTATRRQGNLGKN

SEQ ID NO: 3407 - protein, 81 aa, Pan paniscus
MNMFKEAVTFKDVAVAFTEEELGLLGPAQRKLYRDVMVENFRNLLSVGHQPFKQDVSPIERNEQLWIMTTATRRQGNLDTL

SEQ ID NO: 3408 - protein, 81 aa, Pan paniscus
MVENFRNLLSVGHQPFKQDVSPIERNEQLWIMTTATRRQGNLGEKNQSKLITVQDRESEEELSCWQIWQQIANDLTRCQDS

SEQ ID NO: 3409 - protein, 81 aa, Pan paniscus
RNEQLWIMTTATRRQGNLGEKNQSKLITVQDRESEEELSCWQIWQQIANDLTRCQDSMINNSQCHKQGDFPYQVGTELSIQ

SEQ ID NO: 3410 - protein, 81 aa, Pan paniscus
IERNEQLWIMTTATRRQGNLGEKNQSKLITVQDRESEEELSCWQIWQQIANDLTRCQDSMINNSQCHKQGDFPYQVGTELS

SEQ ID NO: 3411 - protein, 81 aa, Pan paniscus
SQNYDLPQKKQEKMTKFQEAVTFKDVAVVFSREELRLLDLTQRKLYRDVMVENFKNLVAVGHLPFQPDMVSQLEAEEKLWM

SEQ ID NO: 3412 - protein, 81 aa, Pan paniscus
SQNYDLPQKKQEKMTKFQEAVTFKDVAVVFSREELRLLDLTQRKLYRDVMVENFKNLVAVGSKHQNKMETLQKFALKYLSN

SEQ ID NO: 3413 - protein, 81 aa, Pan paniscus; identical to SEQ ID NO: 2402

SEQ ID NO: 3414 - protein, 81 aa, Pan paniscus
MTKFQEAVTFKDVAVVFSREELRLLDLTQRKLYRDVMVENFKNLVAVGHLPFQPDMVSQLEAEEKLWMMETETQRKMRSCC

SEQ ID NO: 3415 - protein, 81 aa, Pan paniscus
MTKFQEAVTFKDVAVVFSREELRLLDLTQRKLYRDVMVENFKNLVAVDMVSQLEAEEKLWMMETETQRSSKHQNKMETLQK

SEQ ID NO: 3416 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGKHSET

SEQ ID NO: 3417 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGKHSVW

SEQ ID NO: 3418 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGKHSGF

SEQ ID NO: 3419 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGKHSGD

SEQ ID NO: 3420 - protein, 81 aa, Pan paniscus
MTKFQEAVTFKDVAVAFTEEELGLLDSAQRKLYRDVMLENFRNLVSVGHQSFKPDMISQLEREEKLWMKELQTQRGDRNQN

SEQ ID NO: 3421 - protein, 81 aa, Pan paniscus
SPRTLPFPRRRGKMTKFQEAVTFKDVAVAFTEEELGLLDSAQRKLYRDVMLENFRNLVSVGHQSFKPDMISQLEREEKLWM

SEQ ID NO: 3422 - protein, 81 aa, Pan paniscus
MTKFQEMVTFKDVAVVFTREELGLLDLAQRKLYQDVTLENFRNLLSVGYQPFKLDVILQLGKEDKLLMMETEIQGDGCSGE

SEQ ID NO: 3423 - protein, 81 aa, Pan paniscus
MTKFQEMVTFKDVAVVFTREELGLLDLAQRKLYQDVTLENFRNLLSVGYQPFKLDVILQLGKEDKLLMMETEIQGDGCSGH

SEQ ID NO: 3424 - protein, 81 aa, Pan paniscus
FWRYNLVLPSQDPALPQKEQEKMTKFQEMVTFKDVAVVFTREELGLLDLAQRKLYQDVTLENFRNLLSVGYQPFKLDVILQ

SEQ ID NO: 3425 - protein, 81 aa, Pan paniscus
MTKFQEMVTFKDVAVVFTREELGLLDLAQRKLYQDVTLENFRNLLSVGYQPFKLDVILQLGKEDKLLMMETEIQGDGCSGL

SEQ ID NO: 3426 - protein, 81 aa, Pan paniscus
MTKFQEMVTFKDVAVVFTREELGLLDLAQRKLYQDVTLENFRNLLLSTLQTRCDITVGKRRQASDDGDRNPRRWVFRTQES

SEQ ID NO: 3427 - protein, 81 aa, Pan paniscus
MVTFKDVAVVFTEEELGLLDSVQRKLYRDVMLENFRNLLLVAHQPFKPDLISQLEREEKLLMVETETPGDGCSGRKNQQKM

SEQ ID NO: 3428 - protein, 81 aa, Pan paniscus
MTKFQEMVTFKDVAVVFTEEELGLLDSVQRKLYRDVMLENFRNLLLVAHQPFKPDLISQLEREEKLLMVETETPGDGCSGR

SEQ ID NO: 3429 - protein, 81 aa, Pan paniscus
SLPFSRKRKRKMTKFQEMVTFKDVAVVFTEEELGLLDSVQRKLYRDVMLENFRNLLLVAHQPFKPDLISQLEREEKLLMVE

SEQ ID NO: 3430 - protein, 81 aa, Pan paniscus
MIKFQMVTFKDVAVVFTEEELGLLDSVQRKLYRDVMLENFRNLLLVAHQPFKPDLISQLEREEKLLMVETETPGDGCSGRK

SEQ ID NO: 3431 - protein, 81 aa, Pan paniscus
MIKFQERVTFKDVAVVFTKEELALLDKAQINLYQDVMLENFRNLMSVRDGIKNNILNLQAKGLSYLSQEVLHCWQIWKQRI

SEQ ID NO: 3432 - protein, 81 aa, Pan paniscus
MIKFQIQGIHVQERVTFKDVAVVFTKEELALLDKAQINLYQDVMLENFRNLMSVRDGIKNNILNLQAKGLSYLSQEVLHCW

SEQ ID NO: 3433 - protein, 81 aa, Pan paniscus
HSQASAISQDREEKIMSQEPLSFKDVAVVFTEEELELLDSTQRQLYQDVMQENFRNLLSVGDKNGKDMEYIQDEELRFFSH

SEQ ID NO: 3434 - protein, 81 aa, Pan paniscus
HSQASAISQDREEKIMSQEPLSFKDVAVVFTEEELELLDSTQRQLYQDVMQENFRNLLSVGERNPLGDKNGKDMEYIQDEE

SEQ ID NO: 3435 - protein, 81 aa, Pan paniscus
TLTSRHEKRALHSQASAISQDREEKIMSQEPLSFKDVAVVFTEEELELLDSTQRQLYQDVMQENFRNLLSVGERNPLGNWN

SEQ ID NO: 3436 - protein, 81 aa, Pan paniscus
LHSQASAISQDREEKIMSQEPLSFKDVAVVFTEEELELLDSTQRQLYQDVMQENFRNLLSVAEKSSLGISFLRTRISFLGV

SEQ ID NO: 3437 - protein, 81 aa, Pan paniscus
IIIKVEGEDTGSLTIPSQEGVNFKIVTVDFTQEEQGTWNPAQRTLDRDVILENHRDLVSWDLATAVGKKDSTSKQRIFDEE

SEQ ID NO: 3438 - protein, 81 aa, Pan paniscus
SMEEQDEKPPEPPKACAQEGVNFKIVTVDFTQEEQGTWNPAQRTLDRDVILENHRDLVSWDLATAVGKKDSTSKQRIFDEE

SEQ ID NO: 3439 - protein, 81 aa, Pan paniscus
MSQDSVTFADVAVNFTKEEWTLLDPAQRNLYRDVMLENSRNLAFIDWATPCKTKDATPQPDILPKRTFPEANRVCLTSISS

SEQ ID NO: 3440 - protein, 81 aa, Pan paniscus
PSSASRVAETTGTRPHSRDSVTFADVAVNFTKEEWTLLDPAQRNLYRDVMLENSRNLAFIDWATPCKTKDATPQPDILPKR

SEQ ID NO: 3441 - protein, 81 aa, Pan paniscus
MAEEFVTLKDVGMDFTLGDWEQLGLEQGDTFWDTALDNCQDLFLLDPPRPNLTSHPDGGEDLEPLAGGSPEATGPDVTETK

SEQ ID NO: 3442 - protein, 81 aa, Pan paniscus
MDFTLGDWEQLGLEQGDTFWDTALDNCQDLFLLDPPRPNLTSHPDGGEDLEPLAGGSPEATGPDVTETKNSPLMEDFFEEG

SEQ ID NO: 3443 - protein, 81 aa, Pan paniscus
LSQKPQVLGPEKQDGSCEASVSFEDVTVDFSREEWQQLDPAQRCLYRDVMLELYSHLFSVGYHIPNPEVIFRMLKEKEPRV

SEQ ID NO: 3444 - protein, 81 aa, Pan paniscus
NATIVMSVRREQGSSSGEGSLSFEDVAVGFTREEWQFLDQSQKVLYREVMLEDYSNLVSIGYQGTKPDSLFKLEQGEPPGI

SEQ ID NO: 3445 - protein, 81 aa, Pan paniscus
MTKAQESLTLEDVAVDFTWEEWQFLSPAQKNLYRDVMLENYSNLVAVGYQAGKPDALTKLEQGEPLWTLEDEIHSPAHPEI

SEQ ID NO: 3446 - protein, 81 aa, Pan paniscus; identical to SEQ ID NO: 2403

SEQ ID NO: 3447 - protein, 81 aa, Pan paniscus
YSNLVSVGYQASKPDALFKLEQGEPWTVENEIHSQICPEIKKVDNHLQMHSQKQRCLKRVEQCHKHNAFGNIIHQRKSDFP

SEQ ID NO: 3448 - protein, 81 aa, Pan paniscus
MIKSQESLTLEDVAVEFTWEEWQLLGPAQKDLYRDVMLENYSNLVSVGYQASKPDALFKLEQGEPWTVENEIHSQICPEIK

SEQ ID NO: 3449 - protein, 81 aa, Pan paniscus
MIQAQESLTLEDVAVDFTWEEWQLLSPAQKDLYRDVMLENYSNLVAVGYQASKPDALFKLEQGEQPWTTEDGIHSGACSDI

SEQ ID NO: 3450 - protein, 81 aa, Pan paniscus
FAYMSCLVKHKRIHTREKQEAAKVENPPAERHSSLHTSDVMQEKNSANGVTTQVPSVAPQTSLNISGLLANRNVVLVGQPV

SEQ ID NO: 3451 - protein, 81 aa, Pan paniscus
MLENYSNLVAVGYQASKPDALFKLEQGEQPWTTEDGIHSGACSDIWKVDHVLERLQSESLVNRRKPCHEHDAFENIVHCSK

SEQ ID NO: 3452 - protein, 81 aa, Pan paniscus
MMQAQESLTLEDVAVDFTWEEWQFLSPAQKDLYQDVMLENYSNLVAVGYQASKPDAFSKLERGEETCTTEDEIYSRICSDS

SEQ ID NO: 3453 - protein, 81 aa, Pan paniscus
MMQAQESLTLEDVAVDFTWEEWQFLSPAQKDLYQDVMLENYSNLVAVGYQASKPDAFSKLERGEETCTTEDEIYSRICSEI

SEQ ID NO: 3454 - protein, 81 aa, Pan paniscus
MRPEPTKFWEESLTLEDVAVDFTWEEWQFLSPAQKDLYQDVMLENYSNLVAVGYQASKPDAFSKLERGEETCTTEDEIYSR

SEQ ID NO: 3455 - protein, 81 aa, Pan paniscus
MMQAQESLTLEDVAVDFTWEEWQFLSPAQKDLYQDVMLENYSNLVAVGYQASKPDAFSKLERGEETCTTEDEIYSRICSGR

SEQ ID NO: 3456 - protein, 81 aa, Pan paniscus
MESLTLEDVAVDFTWEEWQFLSPAQKDLYQDVMLENYSNLVAVGYQASKPDAFSKLERGEETCTTEDEIYSRICSDSGGAS

SEQ ID NO: 3457 - protein, 81 aa, Pan paniscus
MIKTQESLTLEDVAVEFSWEEWQLLDTAQKNLYRDVMVENYNHLVSLGYQTSKPDVLSKLAHGQEPWITDGKIQNKNCPGI

SEQ ID NO: 3458 - protein, 80 aa, Pan paniscus
MIKTQESLTLEDVAVEFSWEEWQLLDTAQKNLYRDVMVENYNHLVSLGYQTSKPDVLSKLAHGQEPWITDGKIQNKNCPD

SEQ ID NO: 3459 - protein, 81 aa, Pan paniscus
MINAQELLTLEDVTVEFTWEEWQLLGPFQKDLYRDVMLEIYSNLLSMGYQVSKPDALSKLERGEEPWTMEDERHSRICPEN

SEQ ID NO: 3460 - protein, 81 aa, Pan paniscus
ALSKLERGEEPWTMEDERHSRICPENNKVDDHLQDHLENQRMLKSVEQYHEHNAFGNTASQTKSLCLFRENHDTFELYIKT

SEQ ID NO: 3461 - protein, 81 aa, Pan paniscus
LLSMGYQVSKPDALSKLERGEEPWTMEDERHSRICPENNKVDDHLQDHLENQRMLKSVEQYHEHNAFGNTASQTKSLCLFR

SEQ ID NO: 3462 - protein, 81 aa, Pan paniscus
MINAQELLTLEDVTVEFTWEEWQLLGPFQKDLYRDVMLEIYSNLLSMGYQVSKPDALSKLERGEEPWTMEDERHSRICPGT

SEQ ID NO: 3463 - protein, 81 aa, Pan paniscus
MALPQGSLTFRDVAIEFSQEEWKCLDSVQKALYRDVMLENYRNLGFLGLCLPDLNIISVLEQGKEPWTVVSQVKIARNPNC

SEQ ID NO: 3464 - protein, 81 aa, Pan paniscus
MATQGHLTFKDVAIEFSQEEWKCLEPMQKALYKDVMLENYRNLVFLGISPKYVIKELPPTENSNTGERFQTVPLERHQSYD

SEQ ID NO: 3465 - protein, 81 aa, Pan paniscus
MALTQGPLTFRDVAIEFSQEEWKSLDPVQKALYWDVMLENYRNLVFLGILPKCMTKELPPIGNSNTGEKCQTVTLERHECY

SEQ ID NO: 3466 - protein, 81 aa, Pan paniscus
CIDKSSPIAHVEMCFSFQGPLTFRDVAIEFSQEEWKSLDPVQKALYWDVMLENYRNLVFLGILPKCMTKELPPIGNSNTGE

SEQ ID NO: 3467 - protein, 81 aa, Pan paniscus
LDPVQKALYWDVMLENYRNLVFLGILPKCMTKELPPIGNSNTGEKCQTVTLERHECYDVENFYLREIQKNLQDLEFQWKDG

SEQ ID NO: 3468 - protein, 81 aa, Pan paniscus
MALTQGPLTFRDVAIEFSQEEWKSLDPVQKALYWDVMLENYRNLVFLGKDNFALEVKICPRVFLYFLCCLSWEPFHYLTET

SEQ ID NO: 3469 - protein, 81 aa, Pan paniscus
MAQLRRGHLTFRDVAIEFSQEEWKCLDPVQKALYRDVMLENYRNLVSLGICLPDLSIISMMKQRTEPWAVENEMKVAKNPD

SEQ ID NO: 3470 - protein, 81 aa, Pan paniscus
EGEAQKRNAEESGMPLTQGHLTFRDVAIEFSQEEWKCLDPVQKALYRDVMLENYRNLVSLGICLPDLSIISMMKQRTEPWA

SEQ ID NO: 3471 - protein, 81 aa, Pan paniscus
MLENYRNLVSLGICLPDLSIISMMKQRTEPWAVENEMKVAKNPDRWEGIKDINTGRSCAVRSKAGNKPITNQLGLTFHLPL

SEQ ID NO: 3472 - protein, 81 aa, Pan paniscus
MGHLTFRDVAIEFSQEEWKCLDPVQKALYRDVMLENYRNLVSLGICLPDLSIISMMKQRTEPWAVENEMKVAKNPDRWEGI

SEQ ID NO: 3473 - protein, 81 aa, Pan paniscus
AQKRRKRKAKESGMALPQGHLTFRDVAIEFSQAEWKCLDPAQRALYKDVMLENYRNLVSLGISLPDLNINSMLEQRREPWS

SEQ ID NO: 3474 - protein, 81 aa, Pan paniscus
AQKRRKRKAKESGMALPQGHLTFRDVAIEFSQAEWKCLDPAQRALYKDVMLENYRNLVSLGSSYALGSNAEDKPIKKQLGV

SEQ ID NO: 3475 - protein, 81 aa, Pan paniscus
PWSGENEVKIAKNSDGKECIKGVNTGWSAMVQSRLTATSTSWVQAVLLPQPPEQLGLQGAAMHWEAMQKTNQLKNNLEYPF

SEQ ID NO: 3476 - protein, 81 aa, Pan paniscus
DEEAQKRKAKESGMALPQGHLTFTDVAIEFSQEEWKSLDPGQRALYRDVMLENYRNLVFLGICLPDLSIISMLKQRREPLI

SEQ ID NO: 3477 - protein, 81 aa, Pan paniscus
DEEAQKRKAKESGMALPQGHLTFTDVAIEFSQEEWKSLDPGQRALYRDVMLENYRNLVFLGRSCVLGSNAENKPIKNQLGL

SEQ ID NO: 3478 - protein, 81 aa, Pan paniscus
MLRRGHLTFRDVAIEFSQEEWKCLDPAQRTLYREVMVENYRNLVFLGICLPDLSVISMLEQRRDPRNLQSEVKIANNPGGR

SEQ ID NO: 3479 - protein, 81 aa, Pan paniscus
MLRRGHLTFRDVAIEFSQEEWKCLDPAQRTLYREVMVENYRNLVFLGICLPDLSVISMLEQRRDPRNLQSEVKIANNPGSC

SEQ ID NO: 3480 - protein, 81 aa, Pan paniscus
MALTQGPLKFMDVAIEFSQEEWKCLDPAQRTLYRDVMLENYRNLVSLGICLPDLSVTSMLEQKRDPWTLQSEEKIANDPDG

SEQ ID NO: 3481 - protein, 81 aa, Pan paniscus
MDVAIEFSQEEWKCLDPAQRTLYRDVMLENYRNLVSLGICLPDLSVTSMLEQKRDPWTLQSEEKIANDPDGRECIKGVNTV

SEQ ID NO: 3482 - protein, 81 aa, Pan paniscus
KEATRKRKEKKSGMALTQGPLKFMDVAIEFSQEEWKCLDPAQRTLYRDVMLENYRNLVSLGICLPDLSVTSMLEQKRDPWT

SEQ ID NO: 3483 - protein, 81 aa, Pan paniscus
LYRDVMLENYRNLVSLGICLPDLSVTSMLEQKRDPWTLQSEEKIANDPDGRECIKGVNTDSPLLQCITSVPCVFCTASMIN

SEQ ID NO: 3484 - protein, 81 aa, Pan paniscus
MALAQGQLSFSDVAIEFSQEEWKCLDPGQKALYRDVMLENYRNLISLGICLPDLSVTSMLEQKRDPWTLQSEVKIVNNPDG

SEQ ID NO: 3485 - protein, 81 aa, Pan paniscus
MALAQGQLSFSDVAIEFSQEEWKCLDPGQKALYRDVMLENYRNLISLGEDNVPPEACFCSGICLPDLSVTSMLEQKRDPWT

SEQ ID NO: 3486 - protein, 81 aa, Pan paniscus
MALAQGQLSFSDVAIEFSQEEWKCLDPGQKALYRDVMLENYRNLISLDFSLLAWDARVSRVEAWRASGGAEEPTDPNFVGN

SEQ ID NO: 3487 - protein, 81 aa, Pan paniscus
EEAAQKRKGKEPGMALPQGRLTFRDVAIEFSLAEWKFLNPSQRALYREVMLENYRNLEAVDISSKRMMKEVLSTGQGNTEV

SEQ ID NO: 3488 - protein, 81 aa, Pan paniscus
EEAAQKRKGKEPGMALPQGRLTFRDVAIEFSLAEWKCLNPSQRALYREVMLENYRNLEAVDISSKRMMKEVLSTGQGNTEV

SEQ ID NO: 3489 - protein, 81 aa, Pan paniscus
REEAAQKRKGKEPGMALPQGRLTFRDVAIEFSLAEWKCLNPSQRALYREVMLENYRNLEAVDISSKRMMKEVLSTGQGNTE

SEQ ID NO: 3490 - protein, 81 aa, Pan paniscus
KTRKRKRKAKESGMALPQGLLTFRDVAIEFSQEEWKCLDPAQRTLYRDVMLENYRNLVFLDTSSKCMMKMFSSTGQGNTEV

SEQ ID NO: 3491 - protein, 81 aa, Pan paniscus
MALPQGLLTFRDVAIEFSQEEWKCLDPAQRTLYRDVMLENYRNLVFLDTSSKCMMKMFSSTGQGNTEVVHTGTLQIHASHH

SEQ ID NO: 3492 - protein, 81 aa, Pan paniscus
EEAAQKRKGREPGMALPQGRLTFRDVAIEFSLAEWKFLNPAQRALYREVMLENYRNLEAVDISSKRMMKEVLSTGQGNTEV

SEQ ID NO: 3493 - protein, 81 aa, Pan paniscus
EEAAQKRKGREPGMALPQGRLTFRDVAIEFSLAEWKFLNPAQRALYREVMLENYRNLEAVESHFVTQAGVQWCDPGSLQPL

SEQ ID NO: 3494 - protein, 80 aa, Pan paniscus
MLREEAAQKRKGREPGMALPQGRLTFRDVAIEFSLAEWKFLNPAQRALYREVMLENYRNLEAVETGFHCVSQDGLNLLTS

SEQ ID NO: 3495 - protein, 81 aa, Pan paniscus
MALPQGLLTFRDVAIEFSQEEWKCLDPAQRTLYRDVMLENYRNLVSLDISSKCMMKTFFSTGQGNTEVIHTGTLQRQASHH

SEQ ID NO: 3496 - protein, 81 aa, Pan paniscus
MALPQGLLTFRDVAIEFSQEEWKCLDPAQRTLYRDVMLENYRNLVSLDFRSVTQAKVQWCHLGSLQPPLPRFKQFSCLSLP

SEQ ID NO: 3497 - protein, 81 aa, Pan paniscus
MALPQGLLTFRDVAIEFSQEEWKCLDPAQRTLYRDVMLENYRNLVSLDISSKCMLKTLSSTGQGNTEVIHTGTLQRQASHH

SEQ ID NO: 3498 - protein, 81 aa, Pan paniscus
MALPQGLLTFRDVAIEFSQEEWKCLDPAQRTLYRDVMLENYRNLVSLEFWSVTPAKVQWCHLRSLQPLLPRFKQFSCLSLP

SEQ ID NO: 3499 - protein, 81 aa, Pan paniscus
KCLDPAQRTLYRDVMLENYRNLVSLEFWSVTPAKVQWCHLRSLQPLLPRFKQFSCLSLPSTWDYRYLFQMHVEDVVINRAR

SEQ ID NO: 3500 - protein, 81 aa, Pan paniscus
LEFWSVTPAKVQWCHLRSLQPLLPRFKQFSCLSLPSTWDYRYLFQMHVEDVVINRARQYRSDPHRDIAKTSKSSHWRILFP

SEQ ID NO: 3501 - protein, 81 aa, Pan paniscus
MALPQGLLTFRDVAIEFSQEEWKCLDPAQRTLYRDVMLENYRNLVSLVRRSEVCCTDIWAEVIVADISSKCMLKTLSSTGQ

SEQ ID NO: 3502 - protein, 81 aa, Pan paniscus
MSLVQGLLTFRDVAIEFSQEEWKCLDPAQRTLYRDVMLENYRNLVSLEFWSVTPAKVQWCHLRSLQPLLPRFKQFSCLSLP

SEQ ID NO: 3503 - protein, 81 aa, Pan paniscus
MALPQSLLTFRDVAIEFSQEEWKCLDPAQRTLYRDVMLENYRNLVSLGLISRDLCYVRKTPRRQRKGARDGSSSGMLDFQR

SEQ ID NO: 3504 - protein, 81 aa, Pan paniscus
MALPQSLLTFRDVAIEFSQEEWKCLDPAQRTLYRDVMLENYRNLVSLDISSKCMMNTLSSTGQGNTEVIHTGTLQRQASYH

SEQ ID NO: 3505 - protein, 81 aa, Pan paniscus
MALPQSLLTFRDVAIEFSQEEWKCLDPAQRTLYRDVMLENYRNLVSLGQGNTEVIHTGTLQRQASYHIGAFCSQEIEKDIH

SEQ ID NO: 3506 - protein, 81 aa, Pan paniscus
MALPQGLLTFRDVAIEFSQEEWKCLDPAQRTLYRDVMLENYRNLVSLDISSKCMMKEFSSIGKGNTEVIHTGTLQRLARHH

SEQ ID NO: 3507 - protein, 81 aa, Pan paniscus
EEATKKSKEKEPGMALPQGRLTFRDVAIEFSLEEWKCLNPAQRALYRAVMLENYRNLEFVDISSKCMMKVFSSTAQGNREM

SEQ ID NO: 3508 - protein, 81 aa, Pan paniscus
LTGSTDQYDQRHAGNKLIKGQLGSSSHSHLPEHIFQPEWKIANQVEKSIINASLILTSQRISCSPKTHISNNYGNNSLHSS

SEQ ID NO: 3509 - protein, 81 aa, Pan paniscus
EEATKKSKEKEPGMALPQGRLTFRDVAIEFSLEEWKCLNPAQRALYRAVMLENYRNLEFVDSSLKSMMEFSSTRHSNTGEV

SEQ ID NO: 3510 - protein, 81 aa, Pan paniscus
EEATKKSKEKEPGMALPQGRLTFRDVAIEFSLEEWKCLNPAQRALYRAVMLENYRNLEFVGEENVPPDMRNLHLSILALSG

SEQ ID NO: 3511 - protein, 81 aa, Pan paniscus
MALTQVRLTFRDVAIEFSQEEWKCLGPAQRILYRDVMLENYWNLVSLGLCHFDMNIISMLEEGKEPWTVKSCVKIARKPRM

SEQ ID NO: 3512 - protein, 81 aa, Pan paniscus
MLENYWNLVSLGLCHFDMNIISMLEEGKEPWTVKSCVKIARKPRMRECVKGVVTDIPPKCTIKDLLPKEKSSTEAVFHTVV

SEQ ID NO: 3513 - protein, 81 aa, Pan paniscus
MAFTQLTFRDVAIEFSQDEWKCLNSTQRTLYRDVMLENYRNLVSLDLSRNCVIKELAPQQEGNPGEVFHTVTLEQHEKHDI

SEQ ID NO: 3514 - protein, 81 aa, Pan paniscus
MAFTQLTFRDVAIEFSQDEWKCLNSTQRTLYRDVMLENYRNLVSLEYYPMWEHRKEPWTIESQVQVARKPKGWEWIKGVKT

SEQ ID NO: 3515 - protein, 81 aa, Pan paniscus
MDGDGLTFRDVAIEFSQDEWKCLNSTQRTLYRDVMLENYRNLVSLDLSRNCVIKELAPQQEGNPGEVFHTVTLEQHEKHDI

SEQ ID NO: 3516 - protein, 81 aa, Pan paniscus
AHEEETQKRRAKESGMAFTQLTFRDVAIEFSQDEWKCLNSTQRTLYRDVMLENYRNLVSLDLSRNCVIKELAPQQEGNPGE

SEQ ID NO: 3517 - protein, 81 aa, Pan paniscus
MDGDGLTFRDVAIEFSQDEWKCLNSTQRTLYRDVMLENYRNLVSLEYYPMWEHRKEPWTIESQVQVARKPKGWEWIKGVKT

SEQ ID NO: 3518 - protein, 81 aa, Pan paniscus
MALTQGQVTFRDVAIEFSQEEWTCLDPAQRTLYRDVMLENYRNLASLGISCFDLSIISMLEQGKEPFTVESQVQIARNPDG

SEQ ID NO: 3519 - protein, 81 aa, Pan paniscus
MALTQGQVTFRDVAIEFSQEEWTCLDPAQRTLYRDVMLENYRNLASLAGISCFDLSIISMLEQGKEPFTVESQVQIARNPD

SEQ ID NO: 3520 - protein, 81 aa, Pan paniscus
MLENYRNLASLGISCFDLSIISMLEQGKEPFTVESQVQIARNPDGWEWIKAVITALSSEFVMKDLPHKGKSNTGEVFQTVM

SEQ ID NO: 3521 - protein, 81 aa, Pan paniscus
SMLEQGKEPFTVESQVQIARNPDGWEWIKAVITALSSEFVMKDLPHKGKSNTGEVFQTVMLERQESQDIEGCSFRELQKNT

SEQ ID NO: 3522 - protein, 81 aa, Pan paniscus
MALPQGQLTFKDVAIEFSQEEWTCLDPAQKTLYRDVMLENYRNLVSLDISCKCVNTDLPPKGKNNMGEAFYTVKLERLESC

SEQ ID NO: 3523 - protein, 81 aa, Pan paniscus
MALSQGLFTFKDVAIEFSQEEWECLDPAQRALYRDVMLENYRNLLSLDEDNIPPENDISVGFTSKGLSPKENNKEELYHLV

SEQ ID NO: 3524 - protein, 81 aa, Pan paniscus
ALYRDVMLENYRNLLSLDEDNIPPENDISVGFTSKGLSPKENNKEELYHLVILERKESHGINNFDLKEVWENMPKFDSLWD

SEQ ID NO: 3525 - protein, 81 aa, Pan paniscus
LYRDVMLENYRNLLSLDEDNIPPENDISVGFTSKGLSPKENNKEELYHLVILERKESHGINNFDLKEVWENMPKFDSLWDY

SEQ ID NO: 3526 - protein, 80 aa, Pan paniscus
MALSQGLFTFKDVAIEFSQEEWECLDPAQRALYRDVMLENYRNLLSLDEDNIPPENAFYSIQELRETLVFLIPYSSKICL

SEQ ID NO: 3527 - protein, 81 aa, Pan paniscus
MALPQSLLTFRDVAIEFSQEEWKCLDPAQRTLYRDVMLENYRNLVSLDISSKCMMKEFSSTAQGNTEVIHTGTLQRHERHH

SEQ ID NO: 3528 - protein, 81 aa, Pan paniscus
MALPQGLLTFRDVAIEFSQEEWKCLDPAQRTLYRDVMLENYRNLVSLGSCCAVEVGLDLLGSRHPPRPPKKLGLQAPTPVP

SEQ ID NO: 3529 - protein, 81 aa, Pan paniscus
MALPQGLLTFRDVAIEFSQEEWKCLDPAQRTLYRDVMLENYRNLVSLGISSKCTMKEFSSTAQGNTEVIHTGTLQRHESHH

SEQ ID NO: 3530 - protein, 81 aa, Pan paniscus
MLENYRNLVSLGISSKCTMKEFSSTAQGNTEVIHTGTLQRHESHHIGDFSFQEIEKDIHNFEFQWQEDERNGHEAPMTKIK

SEQ ID NO: 3531 - protein, 81 aa, Pan paniscus
MALPQGLLTFRDVAIEFSQEEWKCLDPAQRTLYRDVMLENYRNLVSLDISSKCMMKEFSSTAQGNREVFHAGTSQRHESHH

SEQ ID NO: 3532 - protein, 81 aa, Pan paniscus
MAFSQGLLTFRDVAIEFSQEEWKCLDPAQRTLYRDVMLENYRNLVSLDISSKCTMKEFLSTAQGNREVFHAGTLQIHESHH

SEQ ID NO: 3533 - protein, 81 aa, Pan paniscus
MALPQGLLTFRDVAIEFSQEEWKCLDPAQRTLYRDVMLENYRNLVSLDISSKCMMKEVLSTAQGNTEVIHTGTLQRHESHH

SEQ ID NO: 3534 - protein, 81 aa, Pan paniscus
MALPQGLLTFRDVAIEFSQEEWKCLDPAQRTLYRDVMLENYRNLVSLDTGFLLFCLADLKLLPSGDPSTSASKTAAITDIS

SEQ ID NO: 3535 - protein, 81 aa, Pan paniscus
MAQCLVTFADVAIDFSQEEWACLNSAQRDLYWDVMLENYSNLVSLDLESAYENKSLPTEKNIHEIRASKRNSDRRSKSLGR

SEQ ID NO: 3536 - protein, 81 aa, Pan paniscus
PVTTQDTVPAQCALAMSQGSVTFQDVAIDFSKEEWGFLNPAQRDLYTTVMLENYQNLVWLGLSISKSVISLLEKRKLPWIM

SEQ ID NO: 3537 - protein, 81 aa, Pan paniscus
MSLGSELFRDVAIVFSQEEWQWLAPAQRDLYRDVMLETYSNLVSLGLAVSKPDVISFLEQGKEPWMVERVVSGGLCPGAKG

SEQ ID NO: 3538 - protein, 81 aa, Pan paniscus
MSLGSELFRDVAIVFSQEEWQWLAPAQRDLYRDVMLETYSNLVSLGLAVSKPDVISFLEQGKEPWMVERVVSGGLCPVLES

SEQ ID NO: 3539 - protein, 81 aa, Pan paniscus
DTKELFPKQHVYEVESTQWEIMESLTSYGLECSSFQDDWECRNQFDRQQGNPDRHFHQMIIRHEEMPTFDQHASLTFYQKI

SEQ ID NO: 3540 - protein, 81 aa, Pan paniscus
MSKDLVTFGDVAVNFSQEEWEWLNPAQRNLYRKVMLENYRSLVSLGVSVSKPDVISLLEQGKEPWMVKKEGTRGPCPDWEY

SEQ ID NO: 3541 - protein, 81 aa, Pan paniscus
ITHKEILPEVQNKEYNKSWQTFHQDTIFDIEQSFPTKEKAHKHEPQKKSYRKKSVEMKHRKVYVEKKLLKCNDCEKVFNQS

SEQ ID NO: 3542 - protein, 81 aa, Pan paniscus
MPSARGKSKSKAPITFGDLAIYFSQEEWEWLSPIQKDLYEDVMLENYRNLVSLGLSFRRPNVITLLEKGKAPWMVEPVRRR

SEQ ID NO: 3543 - protein, 81 aa, Pan paniscus
MNVEVVKVMPQDLVTFKDVAIDFSQEEWQWMNPAQKRLYRSMMLENYQSLVSLGLCISKPYVISLLEQGREPWEMTSEMTR

SEQ ID NO: 3544 - protein, 81 aa, Pan paniscus
NKKLEAVGTGIEPKTMSQGLVTFGDVAVDFSQEEWEWLNPIQRNLYRKVMLENYRNLASLGLCVSKPDVISSLEQGKEPWT

SEQ ID NO: 3545 - protein, 81 aa, Pan paniscus
LEYSLLGEHWDYDALFETQPGLVTIKNLAVDFRQQLHPAQKNFCKNGIWENNSDLGSAGHCVAKPDLVSLLEQEKEPWMVK

SEQ ID NO: 3546 - protein, 81 aa, Pan paniscus
SQEEVEVAGIKLCKAMSLGSVTFTDVAIDFSQDEWEWLNLAQRSLYKKVMLENYRNLVSVGLCISKPDVISLLEQEKDPWV

SEQ ID NO: 3547 - protein, 81 aa, Pan paniscus
MAAQLLTDEAVESVTFRDVTVDFTQEEWQQLEPAQKDLYRDVMLENYRNLVSLDWETRPEMKELDPKNDISEDKLSVVGVA

SEQ ID NO: 3548 - protein, 81 aa, Pan paniscus
RDSRAYESRSQDAESYQNVVDLAEDRKPHNTIQDNMENYRKLLSLGFLAQDSVPAEKRNTEMLDNLPSAGSQFLDFKHLGT

SEQ ID NO: 3549 - protein, 81 aa, Pan paniscus
AGSQFLDFKHLGTFLVFEELVTFEDVLVDFSPEELSSLSAAQRNLYREVMLENYRNLVSLGHQFSKPDVISRLEEEESHAM

SEQ ID NO: 3550 - protein, 81 aa, Pan paniscus
MNNSQGRVTFEDVTVNFTQGEWQRLNPEQRNLYRDVMLENYSNLVSVGQEETTKPDVILRLEQGKEPWSEEEEVLGSGRAE

SEQ ID NO: 3551 - protein, 81 aa, Pan paniscus
MAAAVLTDRAQVSVTFDDVAVTFTKEEWGQLDLAQRTLYQEVMLENCGLLVSLGCPVPKAELICHLEHGQEPWTRKEDLSQ

SEQ ID NO: 3552 - protein, 81 aa, Pan paniscus
MAAAVLTDRAQVSVTFDDVAVTFTKEEWGQLDLAQRTLYQEVMLENCGLLVSLAPSQTHPGSIRCILQSNQVDTLIKIPEH

SEQ ID NO: 3553 - protein, 81 aa, Pan paniscus
MAAAVLTDRAQVSVTFDDVAVTFTKEEWGQLDLAQRTLYQEVMLENCGLLVSLGDKGKPKTTEPTTCEPALSEGISLQGQV

SEQ ID NO: 3554 - protein, 81 aa, Pan paniscus
MAMALTDPAQVSVTFDDVAVTFTQEEWGQLDLAQRTLYQEVMLENCGLLVSLGCPVPRPELICHLEHEQEPWTRKEDLSQG

SEQ ID NO: 3555 - protein, 81 aa, Pan paniscus
MAAAWMAPAQESVTFEDVAVTFTQEEWGQLDVTQRALYVEVMLETCGLLVALGDSTKPETVEPIPSHLALPEEVSLQEQLA

SEQ ID NO: 3556 - protein, 81 aa, Pan paniscus
MAASAQVSVTFQDVAVTFTQEEWGQLDAAQRTLYQEVMLETCGLLMSLGCPLFKPELIYQLDHRQELWMATKDLSQSSYPG

SEQ ID NO: 3557 - protein, 81 aa, Pan paniscus
MAAAVLMDRVQSCVTFEDVFVYFSREEWELLEEAQRFLYRDVMLENFALVATLGFWCEAEHEAPSEQSVSVEGVSQVRTAE

SEQ ID NO: 3558 - protein, 81 aa, Pan paniscus
MAAAVLMDRVQSCVTFEDVFVYFSREEWELLEEAQRFLYRDVMLENFALVATLAFIFPVPCSCAVGGGRKPWVPDRADITA

SEQ ID NO: 3559 - protein, 81 aa, Pan paniscus
MAEMNPAQGRVVFEDVAIYFSQEEWGHLDEAQRLLYRDVMLENLALLSSLGCCHGAEDEEAPLEPGVSVGVSQVMAPKPCL

SEQ ID NO: 3560 - protein, 81 aa, Pan paniscus
MYSSFPIWQGRVVFEDVAIYFSQEEWGHLDEAQRLLYRDVMLENLALLSSLGCCHGAEDEEAPLEPGVSVGVSQVMAPKPC

SEQ ID NO: 3561 - protein, 81 aa, Pan paniscus
VSVGVSQVMAPKPCLSTQNTQPCETCSSLLKDILRLAEHDGTHPEQGLYTCPAHLHQHQKEQIREKLSRGDGGRPTFVKNH

SEQ ID NO: 3562 - protein, 81 aa, Pan paniscus
MAEMNPAQGRVVFEDVAIYFSQEEWGHLDEAQRLLYRDVMLENLALLSSLGSWHGAEDEEAPSQQGFSVGVSEVTTSKPCL

SEQ ID NO: 3563 - protein, 81 aa, Pan paniscus
MNLTEGRVVFEDVAIYFSQEEWGHLDEAQRLLYRDVMLENLALLSSLGSWHGAEDEEAPSQQGFSVGVSEVTTSKPCLSSQ

SEQ ID NO: 3564 - protein, 81 aa, Pan paniscus
MNLTESPLAMAEMDPTQGRVVFEDVAIYFSQEEWGHLDEAQRLLYRDVMLENLALLSSLGSWHGAEDEEAPSQQGFSVGVS

SEQ ID NO: 3565 - protein, 81 aa, Pan paniscus
MNLTESPLAMAEMDPTQGRVVFEDVAIYFSQEEWGHLDEAQRLLYRDVMLENLALLSSLGKALTLAQCPGLGCVTPFYPKA

SEQ ID NO: 3566 - protein, 81 aa, Pan paniscus
MAEMDPTQGRVVFEDVAIYFSQEEWGHLDEAQRLLYRDVMLENLALLSSLGSWHGAEDEEAPSQQGFSVGVSEVTTSKPCL

SEQ ID NO: 3567 - protein, 81 aa, Pan paniscus
MNLTESPLAMAEMDPTQGRVVFEDVAIYFSQEEWGHLDEAQRLLYRDVMLENLALLSSLGFIAVAAMLMDAGQDYMVFEDV

SEQ ID NO: 3568 - protein, 81 aa, Pan paniscus
AIYFSQEEWGHLDEAQRLLYRDVMLENLALLSSLGFIAVAAMLMDAGQDYMVFEDVAIHFSQEEWGILNDVQRHLHSDVML

SEQ ID NO: 3569 - protein, 81 aa, Pan paniscus
MNLTESPLAMAEMDPTQDYMVFEDVAIHFSQEEWGILNDVQRHLHSDVMLENFALLSSVGCWHGAKDEEAPSKQCVSVGVS

SEQ ID NO: 3570 - protein, 81 aa, Pan paniscus
MLMDAGQDYMVFEDVAIHFSQEEWGILNDVQRHLHSDVMLENFALLSSVGCWHGAKDEEAPSKQCVSVGVSQVTTLKPALS

SEQ ID NO: 3571 - protein, 81 aa, Pan paniscus
MNLTEDYMVFEDVAIHFSQEEWGILNDVQRHLHSDVMLENFALLSSVGCWHGAKDEEAPSKQCVSVGVSQVTTLKPALSTQ

SEQ ID NO: 3572 - protein, 81 aa, Pan paniscus
MNLTEDCMVFEDVAIYFSQEEWGILNDAQRHLHSNVMLENFALLSSVGCWHGAKDEEVPSKQCVSVRVLQVTIPKPALSTL

SEQ ID NO: 3573 - protein, 81 aa, Pan paniscus
MGPAQVPMNSEVIVDPIQGQVNFEDVFVYFSQEEWVLLDEAQRLLYRDVMLENFALMASLGIPQTMAAFGLKYLLNDTGYT

SEQ ID NO: 3574 - protein, 81 aa, Pan paniscus
MGPAQVPMNSEVIVDPIQGQVNFEDVFVYFSQEEWVLLDEAQRLLYRDVMLENFALMASLGHTSFMSHIVASLVMGSEPWV

SEQ ID NO: 3575 - protein, 81 aa, Pan paniscus
MGPAQVPMNSEVIVDPIQGQVNFEDVFVYFSQEEWVLLDEAQRLLYRDVMLENFALMASLGCWHGMEDEEIPFEPSFSIGM

SEQ ID NO: 3576 - protein, 81 aa, Pan paniscus
MAAAEPMGPAQGQVNFEDVFVYFSQEEWVLLDEAQRLLYRDVMLENFALMASLGHTSFMSHIVASLVMGSEPWVPDWVDMT

SEQ ID NO: 3577 - protein, 81 aa, Pan paniscus
MNSEVIVDPIQGQVNFEDVFVYFSQEEWVLLDEAQRLLYRDVMLENFALMASLGHTSFMSHIVASLVMGSEPWVPDWVDMT

SEQ ID NO: 3578 - protein, 81 aa, Pan paniscus
MAAAALRDPAQQGYVTFEDVAVYFSQEEWRLLDDAQRLLYRNVMLENFTLLASLGLASSKTHEITQLESWEEPFMPAWEVV

SEQ ID NO: 3579 - protein, 81 aa, Pan paniscus
MAAAALRDPAQGYVTFEDVAVYFSQEEWRLLDDAQRLLYRNVMLENFTLLASLGLASSKTHEITQLESWEEPFMPAWEVVT

SEQ ID NO: 3580 - protein, 81 aa, Pan paniscus
DPAQVPVAADLLTDHEEQGYVTFEDVAVYFSQEEWRLLDDAQRLLYRNVMLENFTLLASLGKVLTPHPSILSWARLFLLFL

SEQ ID NO: 3581 - protein, 81 aa, Pan paniscus
MAAAALRDPAQGYVTFEDVAVYFSQEEWRLLDDAQRLLYRNVMLENFTLLASLGKVLTPHPSILSWARLFLLFLGRGLFFP

SEQ ID NO: 3582 - protein, 81 aa, Pan paniscus
DPAQVPVAADLLTDHEEQGYVTFEDVAVYFSQEEWRLLDDAQRLLYRNVMLENFTLLASLGLASSKTHEITQLESWEEPFM

SEQ ID NO: 3583 - protein, 81 aa, Pan paniscus
DPAQVPVAADLLTDHEEQGYVTFEDVAVYFSQEEWRLLDDAQRLLYRNVMLENFTLLASLGCWQGAEAEEAPEQSASVGLL

SEQ ID NO: 3584 - protein, 81 aa, Pan paniscus
MAAAALRDPAQGYVTFEDVAVYFSQEEWRLLDDAQRLLYRNVMLENFTLLASLGCWQGAEAEEAPEQSASVGLLSSNIQQH

SEQ ID NO: 3585 - protein, 81 aa, Pan paniscus; identical to SEQ ID NO: 2404

SEQ ID NO: 3586 - protein, 81 aa, Pan paniscus
MAAAALRDPAQQGYVTFEDVAVYFSQEEWRLLDDAQRLLYRNVMLENFTLLASLGCWQGAEAEEAPEQSASVGLLSSNIQQ

SEQ ID NO: 3587 - protein, 81 aa, Pan paniscus
RDPAQVPVAADLLTDHEEGYVTFEDVAVYFSQEEWRLLDDAQRLLYRNVMLENFTLLASLGLASSKTHEITQLESWEEPFM

SEQ ID NO: 3588 - protein, 81 aa, Pan paniscus
RDPAQVPVAADLLTDHEEGYVTFEDVAVYFSQEEWRLLDDAQRLLYRNVMLENFTLLASLGCWQGAEAEEAPEQSASVGLL

SEQ ID NO: 3589 - protein, 81 aa, Pan paniscus
MAEAALVNTPQGHVTFEDIAVYFSQEEWGLLDEAQRCLYHDVMLENFSLMASVGCLHGIEAEEAPSEQTVSAQGVSQARTP

SEQ ID NO: 3590 - protein, 81 aa, Pan paniscus
VNTPQIPMVTEEFVKPSQGHVTFEDIAVYFSQEEWGLLDEAQRCLYHDVMLENFSLMASVGCLHGIEAEEAPSEQTVSAQG

SEQ ID NO: 3591 - protein, 81 aa, Pan paniscus
LVNTPQIPMVTEEFVKPSQGHVTFEDIAVYFSQEEWGLLDEAQRCLYHDVMLENFSLMASVAGLSQSNHKDSCSQQKVPVS

SEQ ID NO: 3592 - protein, 81 aa, Pan paniscus
MAETKDAAQMLVTFKDVAVTFTREEWRQLDLAQRTLYREVMLETCGLLVSLGHRVPKPELVHLLEHGQELWIVKRGLSHAT

SEQ ID NO: 3593 - protein, 81 aa, Pan paniscus
MLVTFKDVAVTFTREEWRQLDLAQRTLYREVMLETCGLLVSLGDRAQVHTREPTTYPPVLSERAFLRGSLTLESSTSSDSR

SEQ ID NO: 3594 - protein, 81 aa, Pan paniscus
RDSTSVPVTAEAKLMGFTQGCVTFEDVAIYFSQEEWGLLDEVQRLLYRDVMLENFALITALVCWHGMEDEETPEQSVSVEG

SEQ ID NO: 3595 - protein, 81 aa, Pan paniscus
MDLTKGCVTFEDIAIYFSQDEWGLLDEAQRLLYLEVMLENFALVASLGCGHGTEDEETPSDQNVSVGVSQSKAGSSTQKTQ

SEQ ID NO: 3596 - protein, 81 aa, Pan paniscus
MAAAALRAPTQGCVTFEDIAIYFSQDEWGLLDEAQRLLYLEVMLENFALVASLGCGHGTEDEETPSDQNVSVGVSQSKAGS

SEQ ID NO: 3597 - protein, 81 aa, Pan paniscus
RAPTQVTVSPETHMDLTKGCVTFEDIAIYFSQDEWGLLDEAQRLLYLEVMLENFALVASLGCGHGTEDEETPSDQNVSVGV

SEQ ID NO: 3598 - protein, 81 aa, Pan paniscus; identical to SEQ ID NO: 2405

SEQ ID NO: 3599 - protein, 81 aa, Pan paniscus
MAAALRAPTQQGFVAFEDVAIYFSQEEWELLDEMQRLLYRDVMLENFAVMASLGCWCGAVDEGAPSAESVSVEELSQGRTP

SEQ ID NO: 3600 - protein, 81 aa, Pan paniscus
PASASQVAGTTGMRHHAQGSVTFEDVAVYFSWEEWDLLDEAQKHLYFDVMLENFALTSSLGCWCGVEHEETPSEQRISGER

SEQ ID NO: 3601 - protein, 81 aa, Pan paniscus
VQLRPQTRMATALRDPASGSVTFEDVAVYFSWEEWDLLDEAQKHLYFDVMLENFALTSSLGLTLSWSHVVAQLGLGEVPSV

SEQ ID NO: 3602 - protein, 81 aa, Pan paniscus
RDPASVPIATEVLFKLTQGSVTFEDVAVYFSWEEWDLLDEAQKHLYFDVMLENFALTSSLGCWCGVEHEETPSEQRISGER

SEQ ID NO: 3603 - protein, 81 aa, Pan paniscus
VQLRPQTRMATALRDPASGSVTFEDVAVYFSWEEWDLLDEAQKHLYFDVMLENFALTSSLGCWCGVEHEETPSEQRISGER

SEQ ID NO: 3604 - protein, 81 aa, Pan paniscus
RDPASVPIATEVLFKLTQGSVTFEDVAVYFSWEEWDLLDEAQKHLYFDVMLENFALTSSLGLTLSWSHVVAQLGLGEVPSV

SEQ ID NO: 3605 - protein, 81 aa, Pan paniscus
MTFEDVAIYFSQEEWELLDESQRFLYCDVMLENFAHVTSLGYCHGMENEAIASEQSVSIQVRTSKGNTPTQKTHLSEIKMC

SEQ ID NO: 3606 - protein, 81 aa, Pan paniscus
SLPSPRSSMAAVALRDSAQGMTFEDVAIYFSQEEWELLDESQRFLYCDVMLENFAHVTSLGYCHGMENEAIASEQSVSIQV

SEQ ID NO: 3607 - protein, 81 aa, Pan paniscus
MAAVALRDSAQGTVTFEDVAVNFSQEEWSLLSEAQRCLYHDVMLENLTLISSLGCWYGAKDETPSKQTLSIQQESPLRTHW

SEQ ID NO: 3608 - protein, 81 aa, Pan paniscus
MAAATLRTPTQGTVTFEDVAVHFSWEEWGLLDEAQRCLYREVMLENLALLTSLDVHHQKQHLGEKHFRSNVGRALFVKTCT

SEQ ID NO: 3609 - protein, 81 aa, Pan paniscus
PAAVRAHGPMAELTDSARGCVVFEDVFVYFSREEWELLDDAQRLLYHDVMLENFALLASLGIAFSRSRAVMKLERGEEPWV

SEQ ID NO: 3610 - protein, 81 aa, Pan paniscus
MAAAALRSPAQGTVTFEDVAVNFSQEEWSLLSEAQRCLYHDVMLENLTLISSLGCWYGAKDETPSKQTLSIQQESPLRTHW

SEQ ID NO: 3611 - protein, 81 aa, Pan paniscus
MAAAAALRAPAQSSVTFEDVAVNFSLEEWSLLNEAQGCLYHDVMLETLTLISSLGGVPPHTLFPTGACGPQVPSSRIRPSP

SEQ ID NO: 3612 - protein, 81 aa, Pan paniscus
MAAAAALRAPAQSSVTFEDVAVNFSLEEWSLLNEAQRCLYRDVMLETLTLISSLGCWHGGEDEAAPSKQSTCIHIYKDQGG

SEQ ID NO: 3613 - protein, 81 aa, Pan paniscus
MAAAALRFPVQGTVTFEDVAVKFTQEEWNLLSEAQRCLYRDVTLENLALMSSLGCWCGVEDEAAPSKQSIYIQRETQVRTP

SEQ ID NO: 3614 - protein, 81 aa, Pan paniscus
MAAAAPRRPTQGTVTFEDVAVKFTQEEWNLLSEAQRCLYRDVTLENLALISSLGCWCGVEDEAAPSKQSIYIQRETQVRTP

SEQ ID NO: 3615 - protein, 81 aa, Pan paniscus
MAVAVTLRLSAQGTVTFEDVAVKFTQEEWNLLSEAQRCLYRDVTLENLALISSLGCWCGVEDEAAPSKQSIYIQRETQVRT

SEQ ID NO: 3616 - protein, 81 aa, Pan paniscus
MAAAAPRRPTQGTVTFEDVAVNFSQEEWCLLSEAQRCLYRDVMLENLALISSLGCWCGSKDEEAPCKQSISVQRESQSRTP

SEQ ID NO: 3617 - protein, 81 aa, Pan paniscus
MAAAAPRRPTQQGTVTFEDVAVNFSQEEWCLLSEAQRCLYRDVMLENLALISSLGCWCGSKDEEAPCKQSISVQRESQSRT

SEQ ID NO: 3618 - protein, 81 aa, Pan paniscus
MAAAATLRLSAQGTVTFEDVAVNFTWEEWNLLSEAQRCLYRDVTLENLALISSLDPALDGSADNTQTGNLGQSVLPSHPEQ

SEQ ID NO: 3619 - protein, 81 aa, Pan paniscus
WRDHGSPQPPPTGDILIQGTVTFEDVAVNFTWEEWNLLSEAQRCLYRDVTLENLALISSLDPALDGSADNTQTGNLGQSVL

SEQ ID NO: 3620 - protein, 81 aa, Pan paniscus
MAAAATLRLSAQGTVTFEDVAVNFTWEEWNLLSEAQRCLYRDVTLENLALISSLGMTFLHVCQALDSLRQVIHPPRPPKML

SEQ ID NO: 3621 - protein, 81 aa, Pan paniscus
LSAQGTVTFEDVAVNFTWEEWNLLSEAQRCLYRDVTLENLALISSLGMTFLHVCQALDSLRQVIPTSASQNAGITGSHSIP

SEQ ID NO: 3622 - protein, 81 aa, Pan paniscus
MAAAATLRLSAQGTVTFEDVAVNFTWEEWNLLSEAQRCLYRDVTLENLALISSLGCWCGVEDEAAPSKQSIYIQRGTQVRT

SEQ ID NO: 3623 - protein, 81 aa, Pan paniscus
VAVNFSQEEWCLLSEAQRCLYRDVMLENLALISSLDCHLHLCQFLDLSPCWRVCLDKPYLFLRPAALRWVKEWNVCASAKA

SEQ ID NO: 3624 - protein, 81 aa, Pan paniscus
MAAAAPRRPTQQGTVTFEDVAVNFSQEEWCLLSEAQRCLYRDVMLENLALISSLGCWCGSKDEEAPCKQRISVQRESQSRT

SEQ ID NO: 3625 - protein, 81 aa, Pan paniscus
MAAAAPRRPTQGTVTFEDVAVNFSQEEWCLLSEAQRCLYRDVMLENLALISSLGCWCGSKDEEAPCKQRISVQRESQSRTP

SEQ ID NO: 3626 - protein, 81 aa, Pan paniscus
MQGTVAFEDVAVNFSQEEWSLLSEVQRCLYHDVMLENWVLISSLGCWCGSEDEEAPSKKSISIQRVSQVSTPGAGVSPKKA

SEQ ID NO: 3627 - protein, 81 aa, Pan paniscus
MQQGTVAFEDVAVNFSQEEWSLLSEVQRCLYHDVMLENWVLISSLGCWCGSEDEEAPSKKSISIQRVSQVSTPGAGVSPKK

SEQ ID NO: 3628 - protein, 81 aa, Pan paniscus
HRMTWDCIAIGSHENSVQGTVAFEDVAVNFSQEEWSLLSEVQRCLYHDVMLENWVLISSLGCWCGSEDEEAPSKKSISIQR

SEQ ID NO: 3629 - protein, 81 aa, Pan paniscus
MQGTVAFEDVAVNFSQEEWSLLSEVQRCLYHDVMLENWVLISSLGCWCGSEDEEAPSKKSISIQRVSQSVRLSAQAGVARS

SEQ ID NO: 3630 - protein, 81 aa, Pan paniscus
MAPAALRLPAQQGTVAFEDVAVNFSQEEWSLLSEVQRCLYHDVMLENWVLISSLGCWCGSEDEEAPSKKSISIQRVSQVST

SEQ ID NO: 3631 - protein, 81 aa, Pan paniscus
MAAAELTAPAQGIVTFEDVAVYFSWKEWGLLDEAQKCLYHDVMLENLTLTTSLGGSGAGDEEAPYEQSTSPQRVSQVRIPK

SEQ ID NO: 3632 - protein, 81 aa, Pan paniscus
GSLEEGRRATGLPAAQVQEPVTFKDVAVDFTQEEWGQLDLVQRTLYRDVMLETYGHLLSVGNQIAKPEVISLLEQGEEPWS

SEQ ID NO: 3633 - protein, 81 aa, Pan paniscus
RRRSVGCRCRGLCLAVRREQVTFEDVVVDFSQEEWGQLKPAQRTLYRDVMLDTFRLLVSVGHWLPKPNVISLLEQEAELWA

SEQ ID NO: 3634 - protein, 81 aa, Pan paniscus
MTPGVRVSTDPEQVTFEDVVVDFSQEEWGQLKPAQRTLYRDVMLDTFRLLVSVGHWLPKPNVISLLEQEAELWAVDSGLPQ

SEQ ID NO: 3635 - protein, 81 aa, Pan paniscus
QEEKQEDAAICPVTVLPEEPVTFQDVAVDFSREEWGLLGPTQRTEYRDVMLETFGHLVSVGWETTLENKELAPNSDIPEEE

SEQ ID NO: 3636 - protein, 81 aa, Pan paniscus
MASRLPTAWSCEPVTFEDVTLGFTPEEWGLLDLKQKSLYREVMLENYRNLVSVEHQLSKPDVVSQLEEAEDFWPVERGIPQ

SEQ ID NO: 3637 - protein, 81 aa, Pan paniscus
MASRLPTAWSCEPVTFEDVTLGFTPEEWGLLDLKQKSLYREVMLENYRNLVSVEYPELQLDPKLDPLPAESPLMNIEVVEV

SEQ ID NO: 3638 - protein, 81 aa, Pan paniscus; identical to SEQ ID NO: 2406

SEQ ID NO: 3639 - protein, 81 aa, Pan paniscus
MEARSMLVPPQASVCFEDVAMAFTQEEWEHLDLAQRTLYREVTLETWEHIVSLGLFLSKSDVISQLEQEEDLCRAEQEAPR

SEQ ID NO: 3640 - protein, 81 aa, Pan paniscus
EDVAMAFTQEEWEHLDLAQRTLYREVTLETWEHIVSLGLFLSKSDVISQLEQEEDLCRAEQEAPRDGVSLLLPRLECNGTI

SEQ ID NO: 3641 - protein, 81 aa, Pan paniscus
EDVAMAFTQEEWEHLDLAQRTLYREVTLETWEHIVSLGLFLSKSDVISQLEQEEDLCRAEQEAPRGTRASKKQRRYRARRI

SEQ ID NO: 3642 - protein, 81 aa, Pan paniscus
MEARSMLVPPQASVCFEDVAMAFTQEEWEHLDLAQRTLYREVTLETWEHIVSLDWKATLEENRLNSEKDAREELSHHVEVY

SEQ ID NO: 3643 - protein, 81 aa, Pan paniscus
PQASVCFEDVAMAFTQEEWEHLDLAQRTLYREVTLETWEHIVSLGLFLSKSDVISQLEQEEDLCRAEQEAPRGTSGLSQVH

SEQ ID NO: 3644 - protein, 81 aa, Pan paniscus
DEGVAGVMSVGPPAARLQEPVTFRDVAVDFTQEEWGQLDPTQRILYRDVMLETFGHLLSIGPELPKPEVISQLEQGTELWV

SEQ ID NO: 3645 - protein, 81 aa, Pan paniscus
MAGEAEAQLDPSLQGLVMFEDVTVYFSREEWGLLNVTQKGLYRDVMLENFALVSSLGLAPSRSPVFTQLEDDEQSWVPSWV

SEQ ID NO: 3646 - protein, 81 aa, Pan paniscus
MAGEAEGLVMFEDVTVYFSREEWGLLNVTQKGLYRDVMLENFALVSSLGLAPSRSPVFTQLEDDEQSWVPSWVDVTPVSRA

SEQ ID NO: 3647 - protein, 81 aa, Pan paniscus
GPAQHTSWPCGSAVPTLKGMVTFEDVAVYFSQEEWELLDAAQRHLYHSVMLENLELVTSLGCWRGVEGEEAHPEQNVSVEV

SEQ ID NO: 3648 - protein, 81 aa, Pan paniscus
PTLKGMVTFEDVAVYFSQEEWELLDAAQRHLYHSVMLENLELVTSLGNALSQHDVFTCSVEADLPNCFPNWLHHFTSLSAV

SEQ ID NO: 3649 - protein, 81 aa, Pan paniscus
MTFEDVAVYFSQEEWGLLDTTQRALYRHVMLENFTLVTSLGLSTSRPHVVIQLERGEEPWVPSGKDMTLARNTYGRLNSGS

SEQ ID NO: 3650 - protein, 81 aa, Pan paniscus
MTFEDVAVYFSQEEWGLLDTTQRALYRHVMLENFTLVTSLGLSTSRPHVVIQLERGEEPWVPSGKDMTLARNTYGRLNSGE

SEQ ID NO: 3651 - protein, 81 aa, Pan paniscus; identical to SEQ ID NO: 2407

SEQ ID NO: 3652 - protein, 81 aa, Pan paniscus
PLAAQSPEGHHGHQEPASTSFHPPRIQEEWGLLDRSQKELYWDAMLEKYGTVVSLGLPPHQPEAQAQSELGMLLTGTGVCR

SEQ ID NO: 3653 - protein, 81 aa, Pan paniscus; identical to SEQ ID NO: 2408

SEQ ID NO: 3654 - protein, 81 aa, Pan paniscus
LPSNDTDCPQKKEGKAQIVVPVTFRDVTVIFTEAEWKRLSPEQRNLYKEVMLENYRNLLSLAEPKPEIYTCSSCLLAFSCQ

SEQ ID NO: 3655 - protein, 81 aa, Pan paniscus
PSNDTDCPQKKEGKAQIVVPVTFRDVTVIFTEAEWKRLSPEQRNLYKEVMLENYRNLLSLDGVSLLLPRLECTRAISAHHN

SEQ ID NO: 3656 - protein, 81 aa, Pan paniscus
AKGLPSNDTDCPQKKEGKAQIVVPVTFRDVTVIFTEAEWKRLSPEQRNLYKEVMLENYRNLLSLGQEIETILANIVKSHLY

SEQ ID NO: 3657 - protein, 81 aa, Pan paniscus; identical to SEQ ID NO: 2409

SEQ ID NO: 3658 - protein, 81 aa, Pan paniscus
MAFRDVAVDFTQDEWRLLSPAQRTLYREVMLENYSNLVSLGISFSKPELITQLEQGKETWREEKKCSPATCPDPEPELYLD

SEQ ID NO: 3659 - protein, 81 aa, Pan paniscus; identical to SEQ ID NO: 2410

SEQ ID NO: 3660 - protein, 81 aa, Pan paniscus
MAFRDVAVDFTQDEWRLLSPAQRTLYREVMLENYSNLVSLGISFSKPELITQLEQGKETWREEKKCSPATCPDHQEYGNNC

SEQ ID NO: 3661 - protein, 81 aa, Pan paniscus
MAHMAFRDVAVDFTQDEWRLLSPAQRTLYREVMLENYSNLVSLGISFSKPELITQLEQGKETWREEKKCSPATCPADPEPE

SEQ ID NO: 3662 - protein, 81 aa, Pan paniscus
DCLLGKGGTPELLTAQLQAHMAFRDVAVDFTQDEWRLLSPAQRTLYREVMLENYSNLVSLGISFSKPELITQLEQGKETWR

SEQ ID NO: 3663 - protein, 81 aa, Pan paniscus
MGPQGARRQAFLAFGDVTVDFTQKEWRLLSPAQRALYREVTLENYSHLVSLGILHSKPELIRRLEQGEAPWGEERRRRPGP

SEQ ID NO: 3664 - protein, 81 aa, Pan paniscus
MENEKERPVSFQDLTVNFTQEEWQQLDPAQRLLYRDVMLENYSNLVSVGYHVSKPDVIFKLEQGEEPWIVEEFSNQNYPDV

SEQ ID NO: 3665 - protein, 81 aa, Pan paniscus
LKMKKFQRPVSFQDLTVNFTQEEWQQLDPAQRLLYRDVMLENYSNLVSVGYHVSKPDVIFKLEQGEEPWIVEEFSNQNYPD

SEQ ID NO: 3666 - protein, 81 aa, Pan paniscus
MLENYSNLVSVGYHVSKPDVIFKLEQGEEPWIVEEFSNQNYPDVDDALEKNKEIQDKHLTQTVFFSNKTLITERENVFGKT

SEQ ID NO: 3667 - protein, 81 aa, Pan paniscus
MAAVSPTTRCQESVTFEDVAVVFTDEEWSRLVPIQRDLYKEVMLENYNSIVSLGLPVPQPDVIFQLKRGDKPWMVDLHGSE

SEQ ID NO: 3668 - protein, 81 aa, Pan paniscus
MAAVSPTTRCQESVTFEDVAVVFTDEEWSRLVPIQRDLYKEVMLENYNSIVSLDWETKPEIHDASDKKSEGSLRECLGRQS

SEQ ID NO: 3669 - protein, 81 aa, Pan paniscus
MTFEDVAVEFSQWEWGQLNPAQKDLYREVMLENFRNLAILGLLVSKPYVICQLEEGGEPFMVEREISTGAHSDWERRSKSK

SEQ ID NO: 3670 - protein, 81 aa, Pan paniscus
EEAAQKRKEKEPGMALPQGHLTFRDVAIEFSLEEWKCLDPMQRALYRAMMLENYRNLHSVDISSKCMMKKFSSTAQGNTEV

SEQ ID NO: 3671 - protein, 81 aa, Pan paniscus
MLQTVWFQGLGRNLLFQEPVTFEDVAVYFTQNEWASLHPMQRALHREVMLENYANVTSLYPTAGGFPLDTDRTEKVPGALS

SEQ ID NO: 3672 - protein, 81 aa, Pan paniscus
MLQTVWFQGLGRNLLFQEPVTFEDVAVYFTQNEWASLHPMQRALHREVMLENYANVTSLSAFPFPKPDLIFQLKQGEAAWG

SEQ ID NO: 3673 - protein, 81 aa, Pan paniscus
MFQTAWRQEPVTFEDVAVYFTQNEWASLDSVQRALYREVMLENYANVASLAFPFTTPVLVSQLEQGELPWGLDPWEPMGRE

SEQ ID NO: 3674 - protein, 81 aa, Pan paniscus
MLQTTWPQESVTFEDVAVYFTQNQWASLDPAQRALYGEVMLENYANVASLVAFPFPKPALISHLERGEAPWGPDPWDTEIL

SEQ ID NO: 3675 - protein, 81 aa, Pan paniscus
MMTAVSLTTRPQESVAFEDVAVYFTTKEWAIMVPAERALYRDVMLENYEAVAFVVPPTSKPALVSHLEQGKESCFTQPQGV

SEQ ID NO: 3676 - protein, 81 aa, Pan paniscus
LGLVLELLPGQPALPRARRESVTFEDVAVYFSENEWIGLGPAQRALYRDVMLENYGAVASLAFPFPKPALISQLERGETPW

SEQ ID NO: 3677 - protein, 81 aa, Pan paniscus
AQILELLVLEQFLSILPGELRVWVQLHNPESGEEAVALLEELQRDLDGTSWRDPGPAQSPDVHWMGTGALRSAQIWSLASP

SEQ ID NO: 3678 - protein, 81 aa, Pan paniscus
EGCPGDQVTPTRSLTAQLQETMTFKDVEVTFSQDEWGWLDSAQRNLYRDVMLENYRNMASLVGPFTKPALISWLEAREPWG

SEQ ID NO: 3679 - protein, 81 aa, Pan paniscus; identical to SEQ ID NO: 2411

SEQ ID NO: 3680 - protein, 81 aa, Pan paniscus
EDYTQKKWKGLTLSQRALHWNMMLENDRSMASLAGRNMMESSELTPKQEIFKGSESSNSTSGGLFGVVPGGTETGDVCEDT

SEQ ID NO: 3681 - protein, 81 aa, Pan paniscus
MVRPQDTVAYEDLSEDYTQKKWKGLTLSQRALHWNMMLENDRSMASLGRNMMESSELTPKQEIFKGSESSNSTSGGLFGVV

SEQ ID NO: 3682 - protein, 81 aa, Pan paniscus
YNSSLMVHQRTHTGEKPYKCNSCGKAFSDSSQLTVHQRVHTGKNLMNVLSVGKPLVSVLLLITTSELTLERSPQVWLGHLL

SEQ ID NO: 3683 - protein, 81 aa, Pan paniscus
VGNSGDQAGATVLRMVRPQDTVAYEDLSVDYTQKKWKGLTLSQRALQWNMMPENHHSMASLAGENMMKGSELTPKQEIFKG

SEQ ID NO: 3684 - protein, 81 aa, Pan paniscus
DFAQCTSPVPTLPQVGNSGDQAGATVLRMVRPQDTVAYEDLSVDYTQKKWKGLTLSQRALQWNMMPENHHSMASLGWSTMA

SEQ ID NO: 3685 - protein, 81 aa, Pan paniscus
GNSGDQAGATVLRMVRPQDTVAYEDLSVDYTQKKWKGLTLSQRALQWNMMPENHHSMASLGENMMKGSELTPKQEIFKGSE

SEQ ID NO: 3686 - protein, 81 aa, Pan paniscus
TLPQVGNSGDQAGATVLRMVRPQDTVAYEDLSVDYTQKKWKGLTLSQRALQWNMMPENHHSMASLDGETGTEEELIPKHHS

SEQ ID NO: 3687 - protein, 81 aa, Pan paniscus
APEASALSQEENPRNQLMALMLLTAQPQELVMFEEVSVCFTSEEWACLGPIQRALYWDVMLENYGNVTSLGYRKYRRQRNK

SEQ ID NO: 3688 - protein, 81 aa, Pan paniscus
ENPRNQLMALMLLTAQPQELVMFEEVSVCFTSEEWACLGPIQRALYWDVMLENYGNVTSLEWETMTENEEVTSKPSSSQRA

SEQ ID NO: 3689 - protein, 81 aa, Pan paniscus
EALPAKDSAWPWEEKPRYLGPVTFEDVAVLFTEAEWKRLSLEQRNLYKEVMLENLRNLVSLVLELGSPRSGLLPLDLNLDL

SEQ ID NO: 3690 - protein, 80 aa, Pan paniscus
MWAPREQLLGWAAEALPAKDSAWPWEEKPRYLGPVTFEDVAVLFTEAEWKRLSLEQRNLYKEVMLENLRNLVSLVLSYQI

SEQ ID NO: 3691 - protein, 81 aa, Pan paniscus
EALPAKDSAWPWEEKPRYLGPVTFEDVAVLFTEAEWKRLSLEQRNLYKEVMLENLRNLVSLAESKPEVHTCPCCPLAFGSP

SEQ ID NO: 3692 - protein, 81 aa, Pan paniscus
ALPAKDSAWPWEEKPRYLGPVTFEDVAVLFTEAEWKRLSLEQRNLYKEVMLENLRNLVSLESKPEVHTCPCCPLAFGSPQF

SEQ ID NO: 3693 - protein, 81 aa, Pan paniscus
REQLLGWAAEALPAKDSAWPWEEKPRYLGPVTFEDVAVLFTEAEWKRLSLEQRNLYKEVMLENLRNLVSLELTIFQYRRHP

SEQ ID NO: 3694 - protein, 81 aa, Pan paniscus
MELLTFRDVAIEFSPEEWKCLDPAQQNLYRDVMLENYRNLVSLAICSPFSQDLSPVQGIEDSFHKLILRRYEKCGHENLQL

SEQ ID NO: 3695 - protein, 81 aa, Pan paniscus
MELLTFRDVAIEFSPEEWKCLDPAQQNLYRDVMLENYRNLVSLGFVISNPDLVTCLEQIKEPCNLKIHETAAKPPVVQHFW

SEQ ID NO: 3696 - protein, 81 aa, Pan paniscus
MELLTFRDVAIEFSPEEWKCLDPAQQNLYRDVMLENYRNLVSLGFVISNPDLVTCLEQIKEPCNLKIHETAAKPPAICSPF

SEQ ID NO: 3697 - protein, 81 aa, Pan paniscus
MELLTFKDVAIEFSPEEWKCLDTSQQNLYRDVMLENYRNLVSLGVTISNPDLVTCLEQRKEPYNLKIHETAARPPAVCSHF

SEQ ID NO: 3698 - protein, 81 aa, Pan paniscus
MELLTFKDVAIEFSPEEWKCLDTSQQNLYRDVMLENYRNLVSLGVTISNPDLVTCLEQRKEPYNLKIHETAARPPGHYRKR

SEQ ID NO: 3699 - protein, 81 aa, Pan paniscus
MLENYRNLVSLGVTISNPDLVTCLEQRKEPYNLKIHETAARPPAVCSHFTQNLWTVQGIEDSFHKLIPKGHEKHGHENLRK

SEQ ID NO: 3700 - protein, 81 aa, Pan paniscus
MSPCPVHLLRVAVPEWHLLEYAGVGAHSASLSSELLTFRDVAIEFSPEEWKCLDPDQQNLYRDVMLENYRNLVSLGVAISN

SEQ ID NO: 3701 - protein, 81 aa, Pan paniscus
WHLLEYAGVGAHSASLSSELLTFRDVAIEFSPEEWKCLDPDQQNLYRDVMLENYRNLVSLGVAISNPDLAIYLEQRKEPYK

SEQ ID NO: 3702 - protein, 81 aa, Pan paniscus
MELLTFRDVAIEFSPEEWKCLDPDQQNLYRDVMLENYRNLVSLGVAISNPDLAIYLEQRKEPYKVKIHETVAKHPAVCSHF

SEQ ID NO: 3703 - protein, 81 aa, Pan paniscus
ELLTFRDVAIEFSPEEWKCLDPDQQNLYRDVMLENYRNLVSLGVAISNPDLAIYLEQRKEPYKVKIHETVAKHPAVCSHFT

SEQ ID NO: 3704 - protein, 81 aa, Pan paniscus
MELLTFRDVAIEFSPEEWKCLDPDQQNLYRDVMLENYRNLVSLGVAISNPDLVTCLEQRKEPYNVKIHKIVARPPAVCSHF

SEQ ID NO: 3705 - protein, 81 aa, Pan paniscus
SLGVAISNPDLVTCLEQRKEPYNVKIHKIVARPPAVCSHFTQDHWPVQGIEDSFHKLILRRYEKCGHDNLQLRKGCKSLNE

SEQ ID NO: 3706 - protein, 81 aa, Pan paniscus
LGVAISNPDLVTCLEQRKEPYNVKIHKIVARPPAVCSHFTQDHWPVQGIEDSFHKLILRRYEKCGHDNLQLRKGCKSLNEC

SEQ ID NO: 3707 - protein, 81 aa, Pan paniscus
MELLTFRDVAIEFSPEEWKCLDPDQQNLYRDVMLENYRNLVSLGVAISNPDLVTCLEQRKEPYNVKIHKIVARPPEFFHLY

SEQ ID NO: 3708 - protein, 81 aa, Pan paniscus
MEPLTFRDVAIEFSPEEWKCLDPAQQNLYRDVMLENYRNLVSLAMCSHFTQDFLPVQGIEDSFHKLILRRYEKFSSLVSSC

SEQ ID NO: 3709 - protein, 81 aa, Pan paniscus
MLENYRNLVSLAMCSHFTQDFLPVQGIEDSFHKLILRRYEKCGHDNLQLRKGCKSMNVCKVQKGVYNGINQCLSNTQSKIF

SEQ ID NO: 3710 - protein, 81 aa, Pan paniscus
MEPLTFRDVAIEFSPEEWKCLDPAQQNLYRDVMLENYRNLVSLAMCSHFTQDFLPVQGIEDSFHKLILRRYEKCGHDNLQL

SEQ ID NO: 3711 - protein, 81 aa, Pan paniscus
SQEESPEGDTERTERKPMVKDAFKDISIYFTKEEWAEMGDWGKTRYRIVKMNYNALITIGLRATRPAFMCHRRQAIKLQVD

SEQ ID NO: 3712 - protein, 81 aa, Pan paniscus
RKPMVKDAFKDISIYFTKEEWAEMGDWGKTRYRIVKMNYNALITIGLRATRPAFMCHRRQAIKLQVDDTEDSDEEWTPRQQ

SEQ ID NO: 3713 - protein, 81 aa, Pan paniscus
MMKSQGLVSFKDVAVDFTQEEWQQLDPSQRTLYRDVMLENYSHLVSMGYPVSKPDVISKLEQGEEPWIIKGDISNWIYPDE

SEQ ID NO: 3714 - protein, 81 aa, Pan paniscus
MLENYSHLVSMGYPVSKPDVISKLEQGEEPWIIKGDISNWIYPDEYQADGRQDRKSNLHNSQSCILGTVSFHHKTLKGVTR

SEQ ID NO: 3715 - protein, 81 aa, Pan paniscus
AETSSSGLLEEQKMMKSQGLVSFKDVAVDFTQEEWQQLDPSQRTLYRDVMLENYSHLVSMGYPVSKPDVISKLEQGEEPWI

SEQ ID NO: 3716 - protein, 81 aa, Pan paniscus
MAAGQREARPQVSLTFEDVAVLFTRDEWRKLAPSQRNLYRDVMLENYRNLVSLGLPFTKPKVISLLQQGEDPWEVEKDGSG

SEQ ID NO: 3717 - protein, 81 aa, Pan paniscus
MAAGQREARPQVSLTFEDVAVLFTWDEWRKLAPSQRNLYRDVMLENYRNLVSLGLSFTKPKVISLLQQGEDPWEVEKDSSG

SEQ ID NO: 3718 - protein, 81 aa, Pan paniscus
MAVSHLPTMVQESVTFKDVAILFTQEEWGQLSPAQRALYRDVMLENYSNLVSLGLLGPKPDTFSQLEKREVWMPEDTPGGF

SEQ ID NO: 3719 - protein, 81 aa, Pan paniscus
MARRLLPAHVQESVTFRDVAVFFSQDEWLHLDSAQRALYREVMLENYSILVSLGILFSKPKVISQLEQGEDPWMVESGVPQ

SEQ ID NO: 3720 - protein, 81 aa, Pan paniscus
MAVDLLSAQEPVTFRDVAVFFSQDEWLHLDSAQRALYREVMLENYGSLVSLGIPFSMPKLIHQLQQGEDPCMVEREVPSDT

SEQ ID NO: 3721 - protein, 81 aa, Pan paniscus
DSTLLQGGHNLLSSASFQESVTFKDVIVDFTQEEWKQLDPGQRDLFRDVTLENYTHLVSIGLQVSKPDVISQLEQGTEPWI

SEQ ID NO: 3722 - protein, 81 aa, Pan paniscus
GSSGDQEMTATLLTAGFQTLEKIEDMAVSLIREEWLLDPSQKDLSRDNRPEDFRNVFSLGGETRSENRELASKQVISTGIH

SEQ ID NO: 3723 - protein, 81 aa, Pan paniscus
GGCCREDAMVASRLTPGSQGLLKMEDVALTLTPGWTQLDSSQVNLYRDEKQESHSSLVSLGGEIQTKSRDLPPVKKLPEKE

SEQ ID NO: 3724 - protein, 81 aa, Pan paniscus
GGCCREDAVVASRLTPESRGLLKVEDVALTLTPEWTQQDSSQGNLCRDEKQENHGSLVSLGDEKQTKSRDLPPAEELPEKE

SEQ ID NO: 3725 - protein, 81 aa, Pan paniscus
GSQGNLPQAEITLMNQAQESVTFEDVAVNFTNREWQCLTYAQRHLYKDVMLENYGNMVSLGFPFPKPPLISHLEREVDPCV

SEQ ID NO: 3726 - protein, 81 aa, Pan paniscus
AEITLMNQAQDSRSILFQESVTFEDVAVNFTNREWQCLTYAQRHLYKDVMLENYGNMVSLGFPFPKPPLISHLEREVDPCV

SEQ ID NO: 3727 - protein, 81 aa, Pan paniscus
ATLQEAMKRDCWREARVKKKPVTFEDVAVNFTQEEWDCLDASQRVLYQDVMSETFKNLTSVARIFLHKPELITKLEQEEEQ

SEQ ID NO: 3728 - protein, 81 aa, Pan paniscus
EQLKPIEPRDCWREARVKKKPVTFEDVAVNFTQEEWDCLDASQRVLYQDVMSETFKNLTSVARIFLHKPELITKLEQEEEQ

SEQ ID NO: 3729 - protein, 81 aa, Pan paniscus
MAAGEPRSLLFFQKPVTFEDVAVNFTQEEWDCLDASQRVLYQDVMSETFKNLTSVARIFLHKPELITKLEQEEEQWRETRV

SEQ ID NO: 3730 - protein, 81 aa, Pan paniscus
MNTLQGPVSFKDVAVDFTQEEWQQLDPDEKITYRDVMLENYSHLVSVGYDTTKPNVIIKLEQGEEPWIMGGEFPCQHSPEA

SEQ ID NO: 3731 - protein, 81 aa, Pan paniscus
MNTLQGPVSFKDVAVDFTQEEWQQLDPDEKITYRDVMLENYSHLVSVGYDTTKPNVIIKLEQGEEPWIMGGEFPCQHSPAA

SEQ ID NO: 3732 - protein, 81 aa, Pan paniscus
MNKSLGPVSFKDVAVDFTQEEWQQLDPEQKITYRDVMLENYSNLVSVGYHIIKPDVISKLEQGEEPWIVEGEFLLQSYPDE

SEQ ID NO: 3733 - protein, 81 aa, Pan paniscus
MLENYSNLVSVGYHIIKPDVISKLEQGEEPWIVEGEFLLQSYPDEVWQTDDLIERIQEEENKPSRQTVFIETLIEEREYIS

SEQ ID NO: 3734 - protein, 81 aa, Pan paniscus
EEEEEDEDEDDLLTAGCQGLVTFEDVAVYFSLEEWERLEADQRGLYQEVMQENYGILVSLGYPIPKPDLIFRLEQGEEPWV

SEQ ID NO: 3735 - protein, 81 aa, Pan paniscus
MEEKEMNDGSQMVRSQESLTFQDVAVDFTREEWDQLYPAQKNLYRDVMLENYRNLVALGYQLCKPEVIAQLELEEEWVIER

SEQ ID NO: 3736 - protein, 81 aa, Pan paniscus
GNMEEKEMNDGSQMVRSQESLTFQDVAVDFTREEWDQLYPAQKNLYRDVMLENYRNLVALGYQLCKPEVIAQLELEEEWVI

SEQ ID NO: 3737 - protein, 81 aa, Pan paniscus; identical to SEQ ID NO: 2412

SEQ ID NO: 3738 - protein, 81 aa, Pan paniscus
MGPLTFRDVKIEFSLEEWQCLDTAQRNLYRDVMLENYRNLVFLVMCSHFAQDVWPEHSIKDSFQKVILRTYGKYGHENLQL

SEQ ID NO: 3739 - protein, 81 aa, Pan paniscus
GIGRSTAKTPGLPGSLEMGPLTFRDVAIEFSLEEWQCLDTSQQNLYRNVMLDNYRNLVFLGIAVSKPDLITCLEQGKEPCN

SEQ ID NO: 3740 - protein, 81 aa, Pan paniscus
MEPLTFKDVAIEFSLEEWQCLDTAQRDLYRNVLLENYRNLVFLVMSFHFAQDLWPEQNIKDSFQKVTLRRYGKCEYENLQL

SEQ ID NO: 3741 - protein, 81 aa, Pan paniscus
MEPLTFKDVAIEFSLEEWQCLDTAQRDLYRNVLLENYRNLVFLGIAVSKPYLITCLEQKKEPWNIKRHEMVAKPPVMSFHF

SEQ ID NO: 3742 - protein, 81 aa, Pan paniscus
MPGPPGSLEMGPLTFRDVAIEFSLEEWQCLNTAQRNLYRKVMFENYRNLVFLGIAVSKPHLITCLEQGKQPWNRKRQEMVA

SEQ ID NO: 3743 - protein, 81 aa, Pan paniscus; identical to SEQ ID NO: 2413

SEQ ID NO: 3744 - protein, 81 aa, Pan paniscus
MAKRRGSPGSREMGLLTFRDVVIEFSLEEWQCLDHAQQNLYRDVMLENYRNLVSLGIAVSKPDLITCLEQNKDPWNIKRNE

SEQ ID NO: 3745 - protein, 81 aa, Pan paniscus
MAKRPGPPGSREMGLLTFRDIAIEFSLAEWQCLDRAQQNLYRDVMLENYRNLFSLGMTVSKPDLIACLEQNKEPQNIKRNE

SEQ ID NO: 3746 - protein, 81 aa, Pan paniscus; identical to SEQ ID NO: 2414

SEQ ID NO: 3747 - protein, 81 aa, Pan paniscus
MAERPGSAGSREMRLLTFRDIAIEFSLEEWQCLDCAQQNLYRDVMLENYRNLVSLGIADSKPDLITCLEQNKEAWNIKRNE

SEQ ID NO: 3748 - protein, 81 aa, Pan paniscus
MFPPARGKELLSFEDVAMYFTREEWGHLNWGQKDLYRDVMLENYRNMVLLGFQFPKPEMICQLENWDEQWILDLPRAGNRK

SEQ ID NO: 3749 - protein, 81 aa, Pan paniscus
MELLSFEDVAMYFTREEWGHLNWGQKDLYRDVMLENYRNMVLLGFQFPKPEMICQLENWDEQWILDLPRAGNRKASGSACP

SEQ ID NO: 3750 - protein, 81 aa, Pan paniscus
GEEAVAVVRALQRALDGTSSQGMVTFEDMAVSLTWEEWERLDPARSDFCRESAQKDSGSTVPPSLESRVENKELIPVQQIL

SEQ ID NO: 3751 - protein, 81 aa, Pan paniscus
SEEHGNKCKQSFHMVTWHVLKPHKSDSGDSFHHSSLFETQRQLHEERPYKCGNCGKSFKQRSDLFRHQRIHTGEKPYGCQE

SEQ ID NO: 3752 - protein, 81 aa, Pan paniscus
SQELTASLLSTGSQKLVKIEEVADVAVSFILEEWGHLDQSQKSLYRDDRKENYGSITSMGYESRDNMELIVKQISDDSESH

SEQ ID NO: 3753 - protein, 81 aa, Pan paniscus
DSQELTASLLSTGSQLVKIEEVADVAVSFILEEWGHLDQSQKSLYRDDRKENYGSITSMGYESRDNMELIVKQISDDSESH

SEQ ID NO: 3754 - protein, 81 aa, Pan paniscus
REGSPGDQAAALLTARYQEFVTFEDVAVHLTREEWGYLDPVQRDLYREVMLENYGNVVSLGILLRLPTTRIHSVNSCPALS

SEQ ID NO: 3755 - protein, 81 aa, Pan paniscus
LTGAPPVPQVPALPREGSPGDQAAALLTARYQEFVTFEDVAVHLTREEWGYLDPVQRDLYREVMLENYGNVVSLGTVGSWD

SEQ ID NO: 3756 - protein, 81 aa, Pan paniscus
QVPALPREGSPGDQAAALLTARYQSSQDVLFQEFVTFEDVAVHLTREEWGYLDPVQRDLYREVMLENYGNVVSLGTVGSWD

SEQ ID NO: 3757 - protein, 81 aa, Pan paniscus
GPGLPAVNPRDQEMAAGFFTAGSQGLGPFKDMALAFPEEEWRHVTPAQIDCFGEYVEPQDCRVSPGGGSKEKEAKPPQEDL

SEQ ID NO: 3758 - protein, 81 aa, Pan paniscus
MASALFTADSQAMVKIEDMAVSLILEEWGCQNLARRNLSRDNRQENYGSAFPQGGENRNENEESTSKAETSEDSASRGETT

SEQ ID NO: 3759 - protein, 81 aa, Pan paniscus
EGSPRDQAMASALFTADSQAMVKIEDMAVSLILEEWGCQNLARRNLSRDNRQENYGSAFPQGGENRNENEESTSKAETSED

SEQ ID NO: 3760 - protein, 81 aa, Pan paniscus
METQADLVSQEPQALLDSALPSKVPAFSDKDSLGDEMLAAALLKAKSQELVTFEDVAVYFIRKEWKRLEPAQRDLYRDVML

SEQ ID NO: 3761 - protein, 81 aa, Pan paniscus
DSLGDEMLAAALLKAKSQELVTFEDVAVYFIRKEWKRLEPAQRDLYRDVMLENYGNVFSLDWIHVSLTTQKVMLAWLTGTL

SEQ ID NO: 3762 - protein, 81 aa, Pan paniscus
DSLGDEMLAAALLKAKSQELVTFEDVAVYFIRKEWKRLEPAQRDLYRDVMLENYGNVFSLDRETRTENDQEISEDTRSHGV

SEQ ID NO: 3763 - protein, 81 aa, Pan paniscus
MLAAALLKAKSQELVTFEDVAVYFIRKEWKRLEPAQRDLYRDVMLENYGNVFSLDRETRTENDQEISEDTRSHGVLLGRFQ

SEQ ID NO: 3764 - protein, 81 aa, Pan paniscus
VPAFSDKDSLGDEMLAAALLKAKSQELVTFEDVAVYFIRKEWKRLEPAQRDLYRDVMLENYGNVFSLDRETRTENDQEISE

SEQ ID NO: 3765 - protein, 81 aa, Pan paniscus
MAEPPRLPLTFEDVAIYFSEQEWQDLEAWQKELYKHVMRSNYETLISLDDGLPKPELISWIEHGGEPFRKWRESQKSGNII

SEQ ID NO: 3766 - protein, 81 aa, Pan paniscus
MAEPASVTVTFDDVALYFSEQEWEILEKWQKQMYKQEMKTNYETLDSLGYAFSKPDLITWMEQGRMLLISEQGCLDKTRRT

SEQ ID NO: 3767 - protein, 81 aa, Pan paniscus
QEMKTNYETLDSLGYAFSKPDLITWMEQGRMLLISEQGCLDKTRRTTSPPTDEQLNMKNTGKLLCFDDEGTPRTKEEDCRL

SEQ ID NO: 3768 - protein, 81 aa, Pan paniscus
MAEPASVTVTFDDVALYFSEQEWEILEKWQKQMYKQEMKTNYETLDSLDLITWMEQGRMLLISEQGCLDKTRRTTSPPTDE

SEQ ID NO: 3769 - protein, 81 aa, Pan paniscus
WQKQMYKQEMKTNYETLDSLDLITWMEQGRMLLISEQGCLDKTRRTTSPPTDEQLNMKNTGKLLCFDDEGTPRTKEEDCRL

SEQ ID NO: 3770 - protein, 81 aa, Pan paniscus
GGGCRLCRNSGPCRSWIGVTVTFDDVALYFSEQEWEILEKWQKQMYKQEMKTNYETLDSLGYAFSKPDLITWMEQGRMLLI

SEQ ID NO: 3771 - protein, 81 aa, Pan paniscus
EMKTNYETLDSLGYAFSKPDLITWMEQGRMLLISEQGCLDKTRRTTSPPTDEQLNMKNTGKLLCFDDEGTPRTKEEDCRLN

SEQ ID NO: 3772 - protein, 81 aa, Pan paniscus
SLGYAFSKPDLITWMEQGRMLLISEQGCLDKTRRTTSPPTDEQLNMKNTGKLLCFDDEGTPRTKEEDCRLNGPQKQDLCAA

SEQ ID NO: 3773 - protein, 81 aa, Pan paniscus
KKLASCEKTVTELGNQLEGKWAVLGTLLQEYGLLQRRLENLENLLRNRNFWILRLPPGIKGDIPKVPVAFDDVSIYFSTPE

SEQ ID NO: 3774 - protein, 81 aa, Pan paniscus
RNFWILRLPPGIKGDIPKVPVAFDDVSIYFSTPEWEKLEEWQKELYKNIMKGNYESLISMDYAINQPDVLSQIQPEGEHNT

SEQ ID NO: 3775 - protein, 81 aa, Pan paniscus
KKLADCEKTAVEFGNHMESKWAVLGTLLQEYGLLQRRLENLENLLRNRNFWVLRLPPGSKGEAPKVPVTFVDIAVYFSEDE

SEQ ID NO: 3776 - protein, 81 aa, Pan paniscus
RNFWVLRLPPGSKGEAPKVPVTFVDIAVYFSEDEWKNLDEWQKELYNNLVKENYKTLMSLDAEGSVPKPDAPVQAEPREEP

SEQ ID NO: 3777 - protein, 81 aa, Pan paniscus
TLCVRGQRGLEERAIPTESITDSPISAQDLLSRIKQEEHQCVWDQQDLADRDIPTDPNSESLISAHDILSWIKQEEQPYPW

SEQ ID NO: 3778 - protein, 81 aa, Pan paniscus
KKLADCEKMAVEFGNQLEGKWAVLGTLLQEYGLLQRRLENVENLLRNRNFWILRLPPGSKGEAPKVSRSLENDGVCFTEQE

SEQ ID NO: 3779 - protein, 81 aa, Pan paniscus
RNFWILRLPPGSKGEAPKVSRSLENDGVCFTEQEWENLEDWQKELYRNVMESNYETLVSLKVLGQTEGEAELGTEMLGDLE

SEQ ID NO: 3780 - protein, 81 aa, Pan paniscus
PGGAHPAGGVMIKQELQYTQEGPADLPGEFSCIAEEQAFLSPEQTKLWGGQGSSVLLETGPGDSTLEEPVGSRDPSSSRTV

SEQ ID NO: 3781 - protein, 81 aa, Pan paniscus
YGLLQRRLENVENLLRNRNFWILRLPPGSKGEAPKVSRSLENDGVCFTEQEWENLEDWQKELYRNVMESNYETLVSLSSSD

SEQ ID NO: 3782 - protein, 81 aa, Pan paniscus
NFWILRLPPGSKGEAPKVSRSLENDGVCFTEQEWENLEDWQKELYRNVMESNYETLVSLSSSDSPASASRVAEITEVLGQT

SEQ ID NO: 3783 - protein, 81 aa, Pan paniscus
LEEEGPGGAHPAGGVMIKQELQYTQEGPADLPGEFSCIAEEQAFLSPEQTKLWGGQGSSVLLETGPGDSTLEEPVGSRDPS

SEQ ID NO: 3784 - protein, 81 aa, Pan paniscus
KKLADCEKTAVEFGNQLEGKWAVLGTLLQEYGLLQRRLENVENLLRNRNFWILRLPPGSKGEAPKVPVTFDDVAVYFSELE

SEQ ID NO: 3785 - protein, 81 aa, Pan paniscus
RNFWILRLPPGSKGEAPKVPVTFDDVAVYFSELEWGKLEDWQKELYKHVMRGNYETLVSLDYAISKPDILTRIERGEEPCL

SEQ ID NO: 3786 - protein, 81 aa, Pan paniscus
KIADCEKTAVEFANHLESKWVVLGTLLQEYGLLQRRLENMENLLKNRNFWILRLPPGSNGEVPKVPVTFDDVAVHFSEQEW

SEQ ID NO: 3787 - protein, 81 aa, Pan paniscus
RNFWILRLPPGSNGEVPKVPVTFDDVAVHFSEQEWGNLSEWQKELYKNVMRGNYESLVSMDYAISKPDLMSQMERGERPTM

SEQ ID NO: 3788 - protein, 81 aa, Pan paniscus
KKLADCEKTAVEFGNQLEGKWAVLGTLLQEYGLLQRRLENVENLLRNRNFWILRLPPGSKGESPKVPVTFDDVAVYFSEQE

SEQ ID NO: 3789 - protein, 81 aa, Pan paniscus
RNFWILRLPPGSKGESPKVPVTFDDVAVYFSEQEWGKLEDWQKELYKHVMRGNYETLVSLDYAISKPEVLSQIEQGKEPCN

SEQ ID NO: 3790 - protein, 81 aa, Pan paniscus
KKLADCEKTAVEFGNQLEGKWAVLGTLLQEYGLLQRRLENVENLLRNRNFWILRLPPGSKGESPKEWGKLEDWQKELYKHV

SEQ ID NO: 3791 - protein, 81 aa, Pan paniscus
LENVENLLRNRNFWILRLPPGSKGESPKEWGKLEDWQKELYKHVMRGNYETLVSLDYAISKPEVLSQIEQGKEPCNWRRPG

SEQ ID NO: 3792 - protein, 81 aa, Pan paniscus
MARQVSITFKDLAVRFSEEEWRLLEEGQREFYRDVMRENYETLVSVGTAELLPLSAFLSPSEPGRAVGGGSHADEGQEPAG

SEQ ID NO: 3793 - protein, 81 aa, Pan paniscus
MRENYETLVSVGTAELLPLSAFLSPSEPGRAVGGGSHADEGQEPAGCGDPQGGQPRHSLHLTALVQLVKEIPEFLFGEVKG

SEQ ID NO: 3794 - protein, 81 aa, Pan paniscus
MEPRESGKAPVTFDDITVYLLQEEWVLLSQQQKELCGSNKLVAPLGPTVANPELFCKFGRGPEPWLGSVQGQRSLLEHHPG

SEQ ID NO: 3795 - protein, 81 aa, Pan paniscus
QDPSAEGLSEEVPVVFEELPVVFEDVAVYFTREEWGMLDKRQKELYRDVMRMNYELLASLGPAAAKPDLISKLERRAAPWI

SEQ ID NO: 3796 - protein, 81 aa, Pan paniscus
MAPVTFDDITVYLLQEEWVLLSQQQKELCGSNKLVAPLGPTVANPELFCKFGRGPEPWLGSVQGQRSLLEHHPGKKQMGYM

SEQ ID NO: 3797 - protein, 81 aa, Pan paniscus
MPSPDSMTFEDIIVDFTQEEWALLDTSQRKLFQDVMLENISHLVSIGKQLCKSVVLSQLEQVEKLSTQRISFLQGREVGIK

SEQ ID NO: 3798 - protein, 81 aa, Pan paniscus
DFTQEEWALLDTSQRKLFQDVMLENISHLVSIGKQLCKSVVLSQLEQVEKLSTQRISFLQGREVGIKHQEIPFIQHIYQKG

SEQ ID NO: 3799 - protein, 81 aa, Pan paniscus
GIKHQEIPFIQHIYQKGTSTISTMRSHTQEDPFLCNDLGEDFTQHMALTQNVITYMRKKHFESGRSSEHRSVVTATSIRTW

SEQ ID NO: 3800 - protein, 81 aa, Pan paniscus
STQRISFLQGREVGIKHQEIPFIQHIYQKGTSTISTMRSHTQEDPFLCNDLGEDFTQHMALTQNVITYMRKKHFVSKKFGK

SEQ ID NO: 3801 - protein, 81 aa, Pan paniscus
SVVLSQLEQVEKLSTQRISFLQGREVGIKHQEIPFIQHIYQKGTSTISTMRSHTQEDPFLCNDLGEDFTQHMALTQNVITY

SEQ ID NO: 3802 - protein, 81 aa, Pan paniscus
MDMAQEPVTFRDVAIYFSREEWACLEPSQRTLYRDVMLDNFSSVAALGFCSPRPDLVSRLEQWEEPWVEDRERPELQAVRR

SEQ ID NO: 3803 - protein, 81 aa, Pan paniscus
MDMAQEPVTFRDVAIYFSREEWACLEPSQRTLYRDVMLDNFSSVAALAPDRTLSLAWNSGRSRGLKTGRDLSSRQCGGDPG

SEQ ID NO: 3804 - protein, 81 aa, Pan paniscus
MAATFQLPGHQEMPLTFQDVAVYFSQAEGQQLGPQQRALYRDVMLENYGNVASLGFPVPKPELISQLEQGKELWVLNLLGA

SEQ ID NO: 3805 - protein, 81 aa, Pan paniscus
AAHAHRMAATFQLPGHQEMPLTFQDVAVYFSQAEGQQLGPQQRALYRDVMLENYGNVASLGFPVPKPELISQLEQGKELWV

SEQ ID NO: 3806 - protein, 81 aa, Pan paniscus
RKPNPQAMAALFLSAPPQAEVTFEDVAVYLSREEWGRLGPAQRGLYRDVMLETYGNLVSLGVGPAGPKPGVISQLERGDEP

SEQ ID NO: 3807 - protein, 81 aa, Pan paniscus
MAALFLSAPPQAEVTFEDVAVYLSREEWGRLGPAQRGLYRDVMLETYGNLVSLGVGPAGPKPGVISQLERGDEPWVLDVQG

SEQ ID NO: 3808 - protein, 81 aa, Pan paniscus
MAALFLSAPPQAEVTFEDVAVYLSREEWGRLGPAQRGLYRDVMLETYGNLVSLALGTRTEYKELTSQETFGEEDPQGSEPV

SEQ ID NO: 3809 - protein, 81 aa, Pan paniscus
LRKPNPQAMAALFLSAPPQAEVTFEDVAVYLSREEWGRLGPAQRGLYRDVMLETYGNLVSLALGTRTEYKELTSQETFGEE

SEQ ID NO: 3810 - protein, 81 aa, Pan paniscus
MAALFLSAPPQAEVTFEDVAVYLSREEWGRLGPAQRGLYRDVMLETYGNLVSLGKALTRTQLWEQPWGPRAQQRLGWGPHP

SEQ ID NO: 3811 - protein, 81 aa, Pan paniscus
MAMALPMPGPQEAVVLEDVAVYFTRIEWSCLAPDQQALYRDVMLENYGNLASLGFLVAKPALISLLEQGEEPGALILQVAE

SEQ ID NO: 3812 - protein, 81 aa, Pan paniscus
MAMALPMPGPQEAVVLEDVAVYFTRIEWSCLAPDQQALYRDVMLENYGNLASLALISLLEQGEEPGALILQVAEQSVAKAS

SEQ ID NO: 3813 - protein, 81 aa, Pan paniscus
ENYGNLASLALISLLEQGEEPGALILQVAEQSVAKASLCTDSRMEAGIMESPLQRKLSRQAGLPGTVWGCLPWGHPAPPHP

SEQ ID NO: 3814 - protein, 81 aa, Pan paniscus
MEVVTFGDVAVHFSREEWQCLDPGQRALYREVMLENHSSVAGLAGFLVFKPELISRLEQGEEPWVLDLQGAEGTEAPRTSK

SEQ ID NO: 3815 - protein, 81 aa, Pan paniscus
MGFLGCCCVSFQEVVTFGDVAVHFSREEWQCLDPGQRALYREVMLENHSSVAGLAGFLVFKPELISRLEQGEEPWVLDLQG

SEQ ID NO: 3816 - protein, 81 aa, Pan paniscus; identical to SEQ ID NO: 2415

SEQ ID NO: 3817 - protein, 81 aa, Pan paniscus
MEVVTFGDVAVHFSREEWQCLDPGQRALYREVMLENHSSVAGLAFSDPTLWFGYLCPCFPHDGNLWAWPSRGAAAFPGFLV

SEQ ID NO: 3818 - protein, 81 aa, Pan paniscus
MAAARLLPVPAGPQAKLTFEDVAVLLSQDEWDRLCPAQRGLYRNVMMETYGNVVSLGLPGSKPDIISQLERGEDPWVLDRK

SEQ ID NO: 3819 - protein, 81 aa, Pan paniscus
AAARLLPVPAGPQPLSFQAKLTFEDVAVLLSQDEWDRLCPAQRGLYRNVMMETYGNVVSLGLPGSKPDIISQLERGEDPWV

SEQ ID NO: 3820 - protein, 81 aa, Pan paniscus
MNMSQASVSFQDVTVEFTREEWQHLGPVERTLYRDVMLENYSHLVSVGYCITKPKVISKLEKGEEPWSLEDEFLNQRYPGY

SEQ ID NO: 3821 - protein, 81 aa, Pan paniscus
MLENYSHLVSVGYCITKPKVISKLEKGEEPWSLEDEFLNQRYPGYFKVDHIKGIREKQEKPLWQEIFINDADKTLSKEGQK

SEQ ID NO: 3822 - protein, 81 aa, Pan paniscus
MTKSLESVSFKDVTVDFSRDEWQQLDLAQKSLYREVMLENYFNLISVGCQVPKPEVIFSLEQEEPCMLDGEIPSQSRPDGD

SEQ ID NO: 3823 - protein, 81 aa, Pan paniscus
MSVQSLPESVSFKDVTVDFSRDEWQQLDLAQKSLYREVMLENYFNLISVGCQVPKPEVIFSLEQEEPCMLDGEIPSQSRPD

SEQ ID NO: 3824 - protein, 81 aa, Pan paniscus
MAPGLLTTRKEALMAFWDVAVAFTQKEWKLLSSAQRTLYREVMLENYSHLVSLGIAFSKPKLIEQLEQGDEPWREENEHLL

SEQ ID NO: 3825 - protein, 81 aa, Pan paniscus
LENYSHLVSLGIAFSKPKLIEQLEQGDEPWREENEHLLDLCPGEWEALGKRGCRAVRSSAGKEGGSIFEVLGGSSSSGLLG

SEQ ID NO: 3826 - protein, 81 aa, Pan paniscus
PLRFSTLFQEQQKMNISQASVSFKDVTIEFTQEEWQQMAPVQKNLYRDVMLENYSNLVSVGYCRFKPEVIFKLEQGEEPWF

SEQ ID NO: 3827 - protein, 81 aa, Pan paniscus
EFTQEEWQQMAPVQKNLYRDVMLENYSNLVSVGYCRFKPEVIFKLEQGEEPWFSEEEFSNQSHPSELLSSSRHNSAGVVRL

SEQ ID NO: 3828 - protein, 81 aa, Pan paniscus
MDTFQASVSFQDVTVEFSQEEWQHMGPVERTLYRDVMLENYSHLVSVGYCFTKPELIFTLEQGEDPWLLEKEKGFLSRNSP

SEQ ID NO: 3829 - protein, 81 aa, Pan paniscus
MASPSPPPESKEEWDYLDPAQRSLYKDVMMENYGNLVSLDVLNRDKDEEPTVKQEIEEIEEEVEPQGVIVTRIKSEIDQDP

SEQ ID NO: 3830 - protein, 81 aa, Pan paniscus
MMENYGNLVSLDVLNRDKDEEPTVKQEIEEIEEEVEPQGVIVTRIKSEIDQDPMGRETFELVGRLDKQRGIFLWEIPRESL

SEQ ID NO: 3831 - protein, 81 aa, Pan paniscus
MASPSPPPESKGLLTFEDVAVFFTQEEWDYLDPAQRSLYKDVMMENYGNLVSLDVLNRDKDEEPTVKQEIEEIEEEVEPQG

SEQ ID NO: 3832 - protein, 81 aa, Pan paniscus
MASPSPPPESKEEWDYLDPAQRSLYKDVMMENYGNLVSLGLTLLPGLVCSDANTACGSLNLLGLSDQSSHLSYLSSWDYRC

SEQ ID NO: 3833 - protein, 81 aa, Pan paniscus
ENSKEDKMVTVCPNTESCESITLKDVAVTFSRGEWKKLEPFQKELYKEVLLENLRNLEFLDFPVSKLELISQLKWVELPWL

SEQ ID NO: 3834 - protein, 81 aa, Pan paniscus
DRRRSAGTTKEAGRPLEMAVSEPEASAAEWKQLDPAPRNLYNDVMLENYSNQASMGCQAPKPDMISKLEKGEAPWLGKGKR

SEQ ID NO: 3835 - protein, 81 aa, Pan paniscus
RRRSAGTTKEAGRPLEMAVSEPEASAAKEWKQLDPAPRNLYNDVMLENYSNQASMGCQAPKPDMISKLEKGEAPWLGKGKR

SEQ ID NO: 3836 - protein, 81 aa, Pan paniscus
EAGRPLEMAVSEPEASAAVSVTFKHVTMAFTQKEWKQLDPAPRNLYNDVMLENYSNQASMGCQAPKPDMISKLEKGEAPWL

SEQ ID NO: 3837 - protein, 81 aa, Pan paniscus
MAAGLLTAGPRGSTFFSSVTVAFAQEGWRCLVSTPRERFKEGIPGKSRSLVLLGLPVSQPGMNSQLEQREGAWMLEGKDLR

SEQ ID NO: 3838 - protein, 81 aa, Pan paniscus
ENTGEEGMAAGLLTAGPRGSTFFSSVTVAFAQEGWRCLVSTPRERFKEGIPGKSRSLVLLGLPVSQPGMNSQLEQREGAWM

SEQ ID NO: 3839 - protein, 81 aa, Pan paniscus
MAMSQESLTFKDVFVDFTLEEWQQLDSAQKNLYRDVMLENYSHLVSVGYLVAKPDVIFRLGPGEESWMADGGTPVRTCAEV

SEQ ID NO: 3840 - protein, 81 aa, Pan paniscus
MAMSQESLTFKDVFVDFTLEEWQQLDSAQKNLYRDVMLENYSHLVSVGYLVAKPDVIFRLGPGEESWMADGGTPVRTCAGE

SEQ ID NO: 3841 - protein, 81 aa, Pan paniscus
VAKPDVIFRLGPGEESWMADGGTPVRTCAGEDRPGESGRGKETRLVGESLASGMCSGALLRASDLWTCLGSDERNCCHVQM

SEQ ID NO: 3842 - protein, 81 aa, Pan paniscus
MAMSQESLTFKDVFVDFTLEEWQQLDSAQKNLYRDVMLENYSHLVSVGYLVAKPDVIFRLGPGEESWMADGGTPVRTCAGT

SEQ ID NO: 3843 - protein, 81 aa, Pan paniscus
MSQESLTFKDVFVDFTLEEWQQLDSAQKNLYRDVMLENYSHLVSVGYLVAKPDVIFRLGPGEESWMADGGTPVRTCADVSI

SEQ ID NO: 3844 - protein, 81 aa, Pan paniscus
MAMSQKSLTFKDVFVDFTLEEWQQLDSAQKNLYRDVMLENYSHLVSVGHLVGKPDVIFRLGPGEESWMADGGTPVRTCAGE

SEQ ID NO: 3845 - protein, 81 aa, Pan paniscus
MAMSQKSLTFKDVFVDFTLEEWQQLDSAQKNLYRDVMLENYSHLVSVGHLVGKPDVIFRLGPGEESWMADGGTPVRTCAVW

SEQ ID NO: 3846 - protein, 81 aa, Pan paniscus
MAMSQKSLTFKDVFVDFTLEEWQQLDSAQKNLYRDVMLENYSHLVSVGHLVGKPDVIFRLGPGEESWMADGGTPVRTCAVE

SEQ ID NO: 3847 - protein, 81 aa, Pan paniscus
SPQRFPALIPGEPGRSFEGSVSFEDVAVDFTRQEWHRLDPAQRTMHKDVMLETYSNLASVGLCVAKPEMIFKLERGEELWI

SEQ ID NO: 3848 - protein, 81 aa, Pan paniscus
SPPWSPALAAEGRGSSCEASVSFEDVTVDFSREEWQHLDPAQRRLYWDVTLENYSHLLSVGYQVPKSEAAFKLEQGEGPWM

SEQ ID NO: 3849 - protein, 81 aa, Pan paniscus
RPWLQRDVAAHVSIVSLQASVSFEDVTVDFSREEWQHLDPAQRRLYWDVTLENYSHLLSVGYQVPKSEAAFKLEQGEGPWM

SEQ ID NO: 3850 - protein, 81 aa, Pan paniscus
AAHVSADHAALNSIVSLQASVSFEDVTVDFSREEWQHLDPAQRRLYWDVTLENYSHLLSVGYQVPKSEAAFKLEQGEGPWM

SEQ ID NO: 3851 - protein, 81 aa, Pan paniscus
LEGEAPHQSCSGEAIGKMQQQGIPGGIFFHCERFDQPIGEDSLCSILEELWQDNDQLEQRQENQNNLLSHVKVLIKERGYE

SEQ ID NO: 3852 - protein, 81 aa, Pan paniscus
MPANEDAPQPGEHGSACEVSVSFEDVTVDFSREEWQQLDSTQRRLYQDVMLENYSHLLSVGFEVPKPEVIFKLEQGEGPWT

SEQ ID NO: 3853 - protein, 81 aa, Pan paniscus
MAKPQGLVTFEDVAVDFTQEEWQYLNPPQRTLYRDVMLETYSNLVFVGQQVTKPNLILKLEVEECPAEGKIPFWNFPEVCQ

SEQ ID NO: 3854 - protein, 81 aa, Pan paniscus
SGEASGSFYSWQKAKREQGLVTFEDVAVDFTQEEWQYLNPPQRTLYRDVMLETYSNLVFVGQQVTKPNLILKLEVEECPAE

SEQ ID NO: 3855 - protein, 81 aa, Pan paniscus
MIESQEPVTFEDVAVDFTQEEWQQLNPTQKTLHRDVMVETYNHLVSMGCSGIKPDVIFKLEHGKDPWIIESELSRWIYPGI

SEQ ID NO: 3856 - protein, 81 aa, Pan paniscus
MIESQEPVTFEDVAVDFTQEEWQQLNPTQKTLHRDVMVETYNHLVSMGCSGIKPDVIFKLEHGKDPWIIESELSRWIYPDR

SEQ ID NO: 3857 - protein, 81 aa, Pan paniscus
MVEGEEEWQQLNPTQKTLHRDVMVETYNHLVSMGCSGIKPDVIFKLEHGKDPWIIESELSRWIYPDRVKGLESSQQIISGE

SEQ ID NO: 3858 - protein, 80 aa, Pan paniscus
MIESQEPVTFEDVAVDFTQEEWQQLNPTQKTLHRDVMVETYNHLVSMGCSGIKPDVIFKLEHGKDPWIIESELSRWIYPE

SEQ ID NO: 3859 - protein, 81 aa, Pan paniscus
MIESQEEWQQLNPTQKTLHRDVMVETYNHLVSMGCSGIKPDVIFKLEHGKDPWIIESELSRWIYPDRVKGLESSQQIISGE

SEQ ID NO: 3860 - protein, 81 aa, Pan paniscus
NGDDTFAKRPRDGAKTSKKRSKAFDDIATYFSKKEWKKMKYSEKISYVYMKRNYKAMTKLGFKVTLPPFMCNKQATDFQGN

SEQ ID NO: 3861 - protein, 81 aa, Pan paniscus
GDDAFARRPKAGAQIPEKIQKAFDDIAKYFSKKEWEKMKSSEKISYVYMKRKYEAMTKLGFKATLPPFMRNTGATDLQGND

SEQ ID NO: 3862 - protein, 81 aa, Pan paniscus
GDDTFARRPTVGAQIPEKIQKAFDDIAKYFSKEEWEKMKVSEKIVYVYMKRKYEAMTKLGFKAILPPFMRNKQAEDFQGND

SEQ ID NO: 3863 - protein, 81 aa, Pan paniscus
GDDAFARRPRDDAQISEKLRKAFDDIAKYFSKEEWEKMKSSEKIVYVYMKLNYEVMTKLGFKVTLPPFMCSKRAADFHGND

SEQ ID NO: 3864 - protein, 81 aa, Pan paniscus
GDDAFARRPTVGAQIPEKIQKAFDDIAKYFSKEEWEKMKASEKIFYVYMKRKYEAMTKLGFKATLPPFMCNKRAEDFQGND

SEQ ID NO: 3865 - protein, 81 aa, Pan paniscus
KRIKHWKMASKLILPESLSLLTFEDVAVYFSEEEWQLLNPLEKTLYNDVMQDIYETVISLGLKLKNDTGNDHPISVSTSEI

SEQ ID NO: 3866 - protein, 81 aa, Pan paniscus
ALVLVEFLQREPDGTKNESLLTFEDVAVYFSEEEWQLLNPLEKTLYNDVMQDIYETVISLGLKLKNDTGNDHPISVSTSEI

SEQ ID NO: 3867 - protein, 81 aa, Pan paniscus
MAAILLTTRPKVPVSFEDVSVYFTKTEWKLLDLRQKVLYKRVMLENYSHLVSLGFSFSKPHLISQLERGEGPWVADIPRTW

SEQ ID NO: 3868 - protein, 81 aa, Pan troglodytes
MHSLEKVTFEDVAIDFTQEEWAMMDTSKRKLYRDVMLENISHLVPLGYQISKSYIILQLEQGKELWREGREFLQDQNPDRE

SEQ ID NO: 3869 - protein, 81 aa, Pan troglodytes
GSVSFEDVAVDFTRQEWHRLDPAQRTMHKDVMLETYSNLASVGLCVAKPEMIFKLERGEELWILEEESSGHGYSGSLSLLC

SEQ ID NO: 3870 - protein, 81 aa, Pan troglodytes; identical to SEQ ID NO: 2416

SEQ ID NO: 3871 - protein, 81 aa, Pan troglodytes
EVTEHLTGWAPALVPSVEGLLTFRDVAIEFSREEWEHLDSDQKLLYGDVMLENYGNLVSLGLAVSKPDLITFLEQRKEPWN

SEQ ID NO: 3872 - protein, 81 aa, Pan troglodytes
MGLLAFMDVAVEFSPEEWECLDPAQRSLYRDVMLENYRNLISLGLAMSKPELIICLEARKEPWNVNTEKTAKHSALSSYLT

SEQ ID NO: 3873 - protein, 81 aa, Pan troglodytes
MGLLAFMDVAVEFSPEEWECLDPAQRSLYRDVMLENYRNLISLGLAMSKPELIICLEARKEPWNVNTEKTAKHSVETRFRH

SEQ ID NO: 3874 - protein, 81 aa, Pan troglodytes
MGLLAFMDVAVEFSPEEWECLDPAQRSLYRDVMLENYRNLISLGEDNFNMQFLFHSLAMSKPELIICLEARKEPWNVNTEK

SEQ ID NO: 3875 - protein, 81 aa, Pan troglodytes
MDSVAFEDVAVNFTQEEWALLDSSQKNLYREVMQETCRNLASVGSQWKDQNIEDHFEKPGKDIRNHIVQRLCESKEGGQYG

SEQ ID NO: 3876 - protein, 81 aa, Pan troglodytes
AEPLHPVCTCGRHFRRPEPCREPRASPIQDSVAFEDVAVNFTQEEWALLDSSQKNLYREVMQETCRNLASVEIISYRDCVK

SEQ ID NO: 3877 - protein, 81 aa, Pan troglodytes
MAGSQGLLIFRDVAIEFSPEEWSYLDPAQQNLYRDVMLENYRNLVSLGIAVSKPDLITCLEQRNEPWNVKKHETVARHPAV

SEQ ID NO: 3878 - protein, 81 aa, Pan troglodytes
SPLYSTEVSNIMVEQKSQESVSFKDVTVGFTQEEWQHLDPSQRALYRDVMLENYSNLVSVGYCVHKPEVIFRLQQGEEPWK

SEQ ID NO: 3879 - protein, 81 aa, Pan troglodytes
MNKVDQKFQGSVSFKDVTVGFTQEEWQHLDPSQRALYRDVMLENYSNLVSVGYCAHKPEVIFRLEQGEEPWRLEEEFPSQS

SEQ ID NO: 3880 - protein, 81 aa, Pan troglodytes
MTLLTFRDVAIEFSLEEWKCLDLAQQNLYRDVMLENYRNLFSVGLTVSKPGLITCLEQRKEPWNVKRQEAADGHPGWSAVV

SEQ ID NO: 3881 - protein, 81 aa, Pan troglodytes
PGLITCLEQRKEPWNVKRQEAADGHPEFHSITQAVVQWRHLSSLQPLPPGLEPSSHFSLLRTWNYRGTLPHPANFCVFNRD

SEQ ID NO: 3882 - protein, 81 aa, Pan troglodytes
SRKNLSMEKEQKLIVQHSYIPVEEALPQYVGVICQKDLLRDSMEEKYCGCNKCKEIYYWNSRCVFHKRNQPGENLYQCSIR

SEQ ID NO: 3883 - protein, 81 aa, Pan troglodytes
MHSLKKVTFEDVAIDFTQEEWAMMDTSKRKLYRDVMLENISHLVSLGYQISKSYIILQLEQGKELWREGREFLQDQNPDRE

SEQ ID NO: 3884 - protein, 81 aa, Pan troglodytes
MGLVTIKDVSLCFSQEEWRSLDPSQTDFYGEYVMQENCGIVVSLRFPIPKLDMLSQLEGGEEQWVPDPQDLEERDILRVTY

SEQ ID NO: 3885 - protein, 81 aa, Pan troglodytes
MIQSQISFEDVAVDFTLEEWQLLNPTQKNLYRDVMLENYSNLVFLEVWLDNPKMWLRDNQDNLKRPKCETGYLIMDPNRSD

SEQ ID NO: 3886 - protein, 81 aa, Pan troglodytes
MSQGSVTFRDVAIDFSQEEWKWLQPAQRDLYRCVMLENYGHLVSLGLSISKPDVVSLLEQGKEPWLGKREVKRDLFSGWSA

SEQ ID NO: 3887 - protein, 81 aa, Pan troglodytes
SFMDVFVDFTWEEWQLLDPAQKCLYRSVMLENYSNLVSLGYQHTKPDIIFKLEQGEELCMVQAQVPNQTCPILKAGKSKAK

SEQ ID NO: 3888 - protein, 81 aa, Pan troglodytes
VLQQYLDPAQRGVRVLEVASGSGQHAAHFARAFPLAEWQPSDVDQRCLDRNPEWGLRDTALLEDLGKASGLLLERMVDMPA

SEQ ID NO: 3889 - protein, 81 aa, Pan troglodytes
RGVRVLEVASGSGQHAAHFARAFPLAEWQPSDVDQRCLDRNPEWGLRDTALLEDLGKASGLLLERMVDMPANNKCLIFRKN

SEQ ID NO: 3890 - protein, 81 aa, Pan troglodytes
LQEGHPGETTDTCFVSGVHGPVALGDIPFYFSREEWGTLDPAQRDLFWGIKRENSRNTTLGFGLKGQSEKSLLQEMVPVVP

SEQ ID NO: 3891 - protein, 81 aa, Pan troglodytes
WPERGPPAPRHQEMASASPFLSAWSQVPVNLEDVAVYLSGEEPRCLDPAQRDAPLENEGPGIQLEDGGEGREDAPVKKRKR

SEQ ID NO: 3892 - protein, 81 aa, Pan troglodytes
QRGPLLWPERGPPAPRHQEMASASPFLSAWSQVPVNLEDVAVYLSGEEPRCLDPAQRDAPLENEGPGIQLEDGGEGREDAP

SEQ ID NO: 3893 - protein, 81 aa, Pan troglodytes
EPGSLHSGHQEQLNRKRERRPLPKNAQPSPWVPALADEWNTLDQEVTTTRLPAGSQEPVKDVHVARGFSYRKSVHQIPAQR

SEQ ID NO: 3894 - protein, 81 aa, Pan troglodytes
MPLKAQYQEMVTFEDVAVHFTKTEWTGLSPAQRALYRSVMLENFGNLTALGYPVPKPALISLLEGGDMAWGLEAQDDPPAE

SEQ ID NO: 3895 - protein, 81 aa, Pan troglodytes
MDVMLENYSNLLSVEVWKADDQMERDHRNPDEQARQFLILKNQTPIEERGDLFGKALNLNTDFVSLRQVPYKYDLYEKTLK

SEQ ID NO: 3896 - protein, 81 aa, Pan troglodytes
EQTQAAGMVAGWLINCYQDTVTFDDVAVDFTQEEWTLLDPSQRDLYRDVMLENYENLASVGHHLFKPSVIYWLEQEEELRA

SEQ ID NO: 3897 - protein, 81 aa, Pan troglodytes
MAAPDLAHGGHVSRDSVCLHEEQTQAAGMVAGWLINCYQDTVTFDDVAVDFTQEEWTLLDPSQRDLYRDVMLENYENLASV

SEQ ID NO: 3898 - protein, 81 aa, Pan troglodytes
EQTQAAGMVAGWLINCYQDTVTFDDVAVDFTQEEWTLLDPSQRDLYRDVMLENYENLASVEWRLKTKGPALRQDGSWFRAS

SEQ ID NO: 3899 - protein, 81 aa, Pan troglodytes
MLENYENLASVGHHLFKPSVIYWLEQEEELRAGRRAVLQEWRLKTKGPALRQDGSWFRASNETQMARSHNGGQLCDRTQCG

SEQ ID NO: 3900 - protein, 81 aa, Pan troglodytes
FQEKSTEEGEVAALRLTARSQETVTFKDVAMDFTPEEWGKLDPAQRDVMLENYRNLVSLWLPVSKPENYNLENGKEPLKLE

SEQ ID NO: 3901 - protein, 81 aa, Pan troglodytes
MDTVVFEDVVVDFTPEEWALLNPAQRKLYRDVMLETFKHLASVDNEAQLKASGSISQQDTSGEKLSLKQKIEKFTRKNIWA

SEQ ID NO: 3902 - protein, 81 aa, Pan troglodytes
GHTQGGELVNELLTSWLRGLVTFEDVAVEFTQEEWALLDPAQRTLYRDVMLENCRNLASLGCRVNKPSLISQLEQDKRVIT

SEQ ID NO: 3903 - protein, 81 aa, Pan troglodytes
SKFEEERMVAGWLTNYSQDSVTFEDVAVDFTQEEWTLLDQTQRNLYRDVMPENYKNLVAVDWESHINTKWSAPQQNFLQGK

SEQ ID NO: 3904 - protein, 81 aa, Pan troglodytes
MVAGWLTNYSQDSVTFEDVAVDFTQEEWTLLDQTQRNLYRDVMPENYKNLVAVDWESHINTKWSAPQQNFLQGKTSSVVEM

SEQ ID NO: 3905 - protein, 81 aa, Pan troglodytes
MDSSQHLVTFEDVAVDFTQEEWTLLDQAQRDLYRDVMLENYKNLIILAGSELFKRSLMSGLEQMEELRTGVTGVLQGEKQY

SEQ ID NO: 3906 - protein, 81 aa, Pan troglodytes
MDSSQHLVTFEDVAVDFTQEEWTLLDQAQRDLYRDVMLENYKNLIILAGSELFKRSLMSGLEQMEELRTGVTGVLQELDLQ

SEQ ID NO: 3907 - protein, 81 aa, Pan troglodytes
MDSSQHLVTFEDVAVDFTQEEWTLLDQAQRDLYRDVMLENYKNLIILGSELFKRSLMSGLEQMEELRTGVTGVLQELDLQL

SEQ ID NO: 3908 - protein, 81 aa, Pan troglodytes
MDPVAFKDVAVNFTQEEWALLDISQRRLYREVMLETFRNLTSVGKRWKDQNIEYEYQNPRRNFSSLIEEKVNEIKEDSHCG

SEQ ID NO: 3909 - protein, 81 aa, Pan troglodytes
MMFQDPVAFKDVAVNFTQEEWALLDISQRRLYREVMLETFRNLTSVGKRWKDQNIEYEYQNPRRNFSSLIEEKVNEIKEDS

SEQ ID NO: 3910 - protein, 81 aa, Pan troglodytes
MFQDPVAFKDVAVNFTQEEWALLDISQRRLYREVMLETFRNLTSVGKRWKDQNIEYEYQNPRRNFSSLIEEKVNEIKEDSH

SEQ ID NO: 3911 - protein, 81 aa, Pan troglodytes
MFQDPVAFKDVAVNFTQEEWALLDISQKNLYREVMLETFWNLTSIGKKWKDQNIEYEYQNPRRNFRSVIEEKVNEIKEDSH

SEQ ID NO: 3912 - protein, 81 aa, Pan troglodytes
MLSLSPILLYTCEMFQDPVAFKDVAVNFTQEEWALLDISQKNLYREVMLETFWNLTSIGKKWKDQNIEYEYQNPRRNFRSV

SEQ ID NO: 3913 - protein, 81 aa, Pan troglodytes
CSHRSCREDPGTSESREMDPVAFKDVAVNFTQEEWALLDISQRKLYREVMLETFRNLTSIGKKWKDQNIEFEYQNPRRNFR

SEQ ID NO: 3914 - protein, 81 aa, Pan troglodytes
MPCCSHRSCREDPGTSESREMRPESSDCKLRPVRNLQREVIESSHQAQWLTPVIPALWEAKADGASQMFQDPVAFKDVAVN

SEQ ID NO: 3915 - protein, 81 aa, Pan troglodytes
NLQREVIESSHQAQWLTPVIPALWEAKADGASQMFQDPVAFKDVAVNFTQEEWALLDISQRKLYREVMLETFRNLTSIGVS

SEQ ID NO: 3916 - protein, 81 aa, Pan troglodytes
DPVAFEDVAVNFTQEEWTLLDISQKNLFREVMLETFRNLTSIGKKWSDQNIEYEYQNPRRSFRSLIEEKVNEIKEDSHRGE

SEQ ID NO: 3917 - protein, 81 aa, Pan troglodytes
MDPVAFKDVAVNFTQEEWALLDISQRKLYREVMLETFRNLTSIGKKWKDQNIEFEYQNPRRNFRSLIEGNVNEIKEDSHCG

SEQ ID NO: 3918 - protein, 81 aa, Pan troglodytes
MMFQDPVAFKDVAVNFTQEEWALLDISQRKLYREVMLETFRNLTSIGKKWKDQNIEFEYQNPRRNFRSLIEGNVNEIKEDS

SEQ ID NO: 3919 - protein, 81 aa, Pan troglodytes
PPVLSLSPILLYTCEMFQDPVAFKDVAVNFTQEEWALLDISQRKLYREVMLETFRNLTSIGKKWKDQNIEFEYQNPRRNFR

SEQ ID NO: 3920 - protein, 81 aa, Pan troglodytes
DSVAFEDVAVNFTQEEWALLDPSQKNLYREVMQETLRNLTSIGKKWNNQYIEDEHQNPKRNLRRLIGERLSESKESHQHGE

SEQ ID NO: 3921 - protein, 81 aa, Pan troglodytes
SDQRRRSKEARTPGSRDTDSVVFEDVAVNFTQEEWALLGPSQKKLYRDVMQETFVNLASIGENWEEKNIEDHKNQGRKLRS

SEQ ID NO: 3922 - protein, 81 aa, Pan troglodytes
MDSVAFEDVSVSFSQEEWALLAPSQKKLYRDVMQETFKNLASIGEKWEEPNVEDQHKNQGRNLRSHTGERLCEGKEGSQCA

SEQ ID NO: 3923 - protein, 81 aa, Pan troglodytes
MGPLQFRDVAIEFSLEEWHCLDAAQRNLYRNVMLENYSNLVFLGIVVSKPNLITCLEQGKKPLTMKRHEMIAKPPVMYSHF

SEQ ID NO: 3924 - protein, 81 aa, Pan troglodytes
MGPLQFRDVAIEFSLEEWHCLDAAQRNLYRNVMLENYSNLVFLGIVVSKPNLITCLEQGKKPLTMKRHEMIAKPPGQARWL

SEQ ID NO: 3925 - protein, 81 aa, Pan troglodytes
MGPLQFRDVAIEFSLEEWHCLDAAQRNLYRNVMLENYSNLVFLGIVVSKPNLITCLEQGKKPLTMKRHEMIAKPPDGVSVF

SEQ ID NO: 3926 - protein, 81 aa, Pan troglodytes
MGPLQFRDVAIEFSLEEWHCLDAAQRNLYRNVMLENYSNLVFLVMYSHFAQDLWSEHSIKDSFQKVILRRYEKCRHDNLQL

SEQ ID NO: 3927 - protein, 81 aa, Pan troglodytes
MGPLQFRDVAIEFSLEEWHCLDAAQRNLYRNVMLENYSNLVFLGIVVSKPNLITCLEQGKKPLTMKRHEMIAKPPETGFHR

SEQ ID NO: 3928 - protein, 81 aa, Pan troglodytes
MGPLQFRDVAIEFSLEEWHCLDTAQRNLYRNVMLENYSNLVFLVICSHFAQDLWPEQNIKDSFQKVILRRYEKRGHGNLQL

SEQ ID NO: 3929 - protein, 81 aa, Pan troglodytes
MELLTFRDVTIEFSLEEWEFLNPAQQSLYRKVMLENYRNLVSLGLTVSKPELISCLEQRQEPWNVKRHETIAKPPGTYRVG

SEQ ID NO: 3930 - protein, 81 aa, Pan troglodytes
MLENYRNLVSLGLTVSKPELISCLEQRQEPWNVKRHETIAKPPAMSSHYTEDLLPEQGMQDSFQKVILRRYGSCGLEDLHL

SEQ ID NO: 3931 - protein, 81 aa, Pan troglodytes
MELLTFRDVTIEFSLEEWEFLNPAQQSLYRKVMLENYRNLVSLGLTVSKPELISCLEQRQEPWNVKRHETIAKPPAMSSHY

SEQ ID NO: 3932 - protein, 81 aa, Pan troglodytes
MFCFVFQELLTFRDVTIEFSLEEWEFLNPAQQSLYRKVMLENYRNLVSLGLTVSKPELISCLEQRQEPWNVKRHETIAKPP

SEQ ID NO: 3933 - protein, 81 aa, Pan troglodytes
MELLTFRDVTIEFSLEEWEFLNPAQQSLYRKVMLENYRNLVSLGLTVSKPELISCLEQRQEPWNVKRHETIAKPPDYSLTI

SEQ ID NO: 3934 - protein, 81 aa, Pan troglodytes
MGPLEFRDVAIEFSLEEWHCLDTAQRNLYRDVMLENYRHLVFLGIVVTKPDLITCLEQGKKPFTVKRHEMIAKPPDGVHFL

SEQ ID NO: 3935 - protein, 81 aa, Pan troglodytes
MGPLEFRDVAIEFSLEEWHCLDTAQRNLYRDVMLENYRHLVFLGIVVTKPDLITCLEQGKKPFTVKRHEMIAKPPVMCFHF

SEQ ID NO: 3936 - protein, 81 aa, Pan troglodytes
MESLQFRDVAVEFSLEEWHCLDTAQQNLYRDVMLENYRHLVFLGIIVSKPDLITCLEQGIKPLTMKRHEMIAKPPETEFCH

SEQ ID NO: 3937 - protein, 81 aa, Pan troglodytes; identical to SEQ ID NO: 2417

SEQ ID NO: 3938 - protein, 81 aa, Pan troglodytes
MGPLQFRDVAIEFSLEEWHCLDTAQRNLYRNVMLENYRNLVFLGIVVSKPDLITCLEQGKKPLTMKKHEMVANPSETGFHH

SEQ ID NO: 3939 - protein, 81 aa, Pan troglodytes
MGPLQFRDVAIEFSLEEWHCLDTAQRNLYKDVMLENYRNLIFLGITVSKPDLITCLEQGRKPLTMKRNEMIAKPSVSFLQV

SEQ ID NO: 3940 - protein, 81 aa, Pan troglodytes
MGPLQFRDVAIEFSLEEWHCLDTAQRNLYKDVMLENYRNLIFLGITVSKPDLITCLEQGRKPLTMKRNEMIAKPSVMCSHF

SEQ ID NO: 3941 - protein, 81 aa, Pan troglodytes
MNVMLENYKNLVFLGIAVSKQDPITSLEQEKEPWNMKICEIVDESPGQVWCLTPVIPALWEARAGGLLEPRSWRPAWSTWK

SEQ ID NO: 3942 - protein, 81 aa, Pan troglodytes
EKVQVILLPQPPELLGLQETLTFRDVAIEFSLEEWECLNPAQQNLYMNVMLENYKNLVFLGVAVSKQDPVTCLEQEKEPWN

SEQ ID NO: 3943 - protein, 81 aa, Pan troglodytes
EFSLEEWQCLDTAQQDLYRKVMLENYRNLVFLAGIAVSKPDLVTCLEQGKDPWNMKRHSTVVKPPGGDCSIFLMEHQGDVT

SEQ ID NO: 3944 - protein, 81 aa, Pan troglodytes
MGPLTFTDVAIEFSLEEWQCLDTAQQNLYRNVMLENYRNLVFLGIAVSKPDLITCLEKEKEPCKMKRHEMVDEPPDGVLLL

SEQ ID NO: 3945 - protein, 81 aa, Pan troglodytes
MGPLTIRDVTVEFSLEEWHCLDTAQQNLYRDVMLENYRNLVFLGIAVSKPDLITCLEQGKEPCNMKRREMVAKPPDSHSVS

SEQ ID NO: 3946 - protein, 81 aa, Pan troglodytes
MGPLTIRDVTVEFSLEEWHCLDTAQQNLYRDVMLENYRNLVFLGIAVSKPDLITCLEQGKEPCNMKRREMVAKPPDGVSLF

SEQ ID NO: 3947 - protein, 81 aa, Pan troglodytes
MGPLTIRDVTVEFSLEEWHCLDTAQQNLYRDVMLENYRNLVFLGIAVSKPDLITCLEQGKEPCNMKRREMVAKPPVMCSHI

SEQ ID NO: 3948 - protein, 81 aa, Pan troglodytes
MGPLTIRDVTVEFSLEEWHCLDTAQQNLYRDVMLENYRNLVFLGIAVSKPDLITCLEQGKEPCNMKRREMVAKPPAFYLMG

SEQ ID NO: 3949 - protein, 81 aa, Pan troglodytes
FLGMAVFKPDLITCLKQGKEPWNMKRHEMVTKPPVMRSHFTQDLWPDQSTKDSFQEVILRTYARCGHNNLRLRKDCKSANE

SEQ ID NO: 3950 - protein, 81 aa, Pan troglodytes
MPGPLGSLEMGVLTFRDVAIEFSLEEWQCLDTAQQNLYRNVMLENRNLVFMGIAASKPDLITCLEQGKERWNVKRHEMVAE

SEQ ID NO: 3951 - protein, 81 aa, Pan troglodytes
GSLEMGVLTFRDVAIEFSLEEWQCLDTAQQNLYRNVMLENRNLVFMGIAASKPDLITCLEQGKERWNVKRHEMVAEPPGLQ

SEQ ID NO: 3952 - protein, 81 aa, Pan troglodytes
GYSGQWAGVAVSAGSPPIPTSSMWSPMVRLGGFSPELQHLPQTLLHRCPLGQPRMGVLTFRDVAIEFSLEEWQCLDTAQQN

SEQ ID NO: 3953 - protein, 81 aa, Pan troglodytes
TPGTPGSLEMGLLTFRDVAIEFSPEEWQCLDTAQQNLYRNVMLENYRNLAFLGIALSKPDLITCLEQGKEPWNMKQHEMVD

SEQ ID NO: 3954 - protein, 81 aa, Pan troglodytes
MGLLTFRDVAIEFSPEEWQCLDTAQQNLYRNVMLENYRNLAFLGIALSKPDLITCLEQGKEPWNMKQHEMVDEPTGICPHF

SEQ ID NO: 3955 - protein, 81 aa, Pan troglodytes
MGLLTFRDVAIEFSLEEWQCLDTAQRNLYKNVILENYRNLVFLGIAVSKQDLITCLEQEKEPLAVKRHEMVNEPPGSVGQT

SEQ ID NO: 3956 - protein, 81 aa, Pan troglodytes
MGLLTFRDVAIEFSLEEWQCLDTAQRNLYKNVILENYRNLVFLGIAVSKQDLITCLEQEKEPLAVKRHEMVNEPPGLPLMP

SEQ ID NO: 3957 - protein, 81 aa, Pan troglodytes
MGLLTFRDVAIEFSLEEWQCLDTAQRNLYKNVILENYRNLVFLGIAVSKQDLITCLEQEKEPLAVKRHEMVNEPPVMCSHF

SEQ ID NO: 3958 - protein, 81 aa, Pan troglodytes
MGLLTFRDVAIEFSLEEWQCLDTAQRNLYKNVILENYRNLVFLGIAVSKQDLITCLEQEKEPLAVKRHEMVNEPPAVDKHP

SEQ ID NO: 3959 - protein, 81 aa, Pan troglodytes
MGLLTFRDVAIEFSLEEWQCLDTAQRNLYKNVILENYRNLVFLGIAVSKQDLITCLEQEKEPLAVKRHEMVNEPPESCPVV

SEQ ID NO: 3960 - protein, 81 aa, Pan troglodytes
MGLLTFRDVAIEFSLEEWQCLDTAQKNLYRNVMLENYRNLAFLGIAVSKPDLIICLEKEKEPWNVKRDEMVDEPPDGVSLC

SEQ ID NO: 3961 - protein, 81 aa, Pan troglodytes
MGLLTFRDVAIEFSLEEWQCLDTAQKNLYRNVMLENYRNLAFLGIAVSKPDLIICLEKEKEPWNVKRDEMVDEPPGLAVSN

SEQ ID NO: 3962 - protein, 81 aa, Pan troglodytes
MGLLTFRDVAIEFSLEEWQCLDTAQKNLYRNVMLENYRNLAFLGIAVSKPDLIICLEKEKEPWNVKRDEMVDEPPGICPHF

SEQ ID NO: 3963 - protein, 81 aa, Pan troglodytes
MLENYRNLAFLGIAVSKPDLITCLEQGKEPWNMKRHEMVDEPPDMCPHFAQDLWPEQGMEDSFQKATLRRYGKYGHENLQL

SEQ ID NO: 3964 - protein, 81 aa, Pan troglodytes
MSQVTFGDVAIDFSHEEWACLDSAQRDLYKDVMVQNYENLVSVAGLSVTKPYVIMLLEDGKEPWMMEKKLSKDWESRWENK

SEQ ID NO: 3965 - protein, 81 aa, Pan troglodytes
MSQVTFGDVAIDFSHEEWACLDSAQRDLYKDVMVQNYENLVSVAGLSVTKPYVIMLLEDGKEPWMMEKKLSKAYPFPLSHS

SEQ ID NO: 3966 - protein, 81 aa, Pan troglodytes
MSQVTFGDVAIDFSHEEWACLDSAQRDLYKDVMVQNYENLVSVGLSVTKPYVIMLLEDGKEPWMMEKKLSKAYPFPLSHSV

SEQ ID NO: 3967 - protein, 81 aa, Pan troglodytes
MSQVTFGDVAIDFSHEEWACLDSAQRDLYKDVMVQNYENLVSVGLSVTKPYVIMLLEDGKEPWMMEKKLSKDWESRWENKE

SEQ ID NO: 3968 - protein, 81 aa, Pan troglodytes
EELVGQNHGMEGEACTGGDVTFGDVAIDFSHEEWACLDSAQRDLYKDVMVQNYENLVSVGLSVTKPYVIMLLEDGKEPWMM

SEQ ID NO: 3969 - protein, 81 aa, Pan troglodytes
MSQVTFGDVAIDFSHEEWACLDSAQRDLYKDVMVQNYENLVSVGLSVTKPYVIMLLEDGKEPWMMEKKLSKGMIPDWESRW

SEQ ID NO: 3970 - protein, 81 aa, Pan troglodytes
SNEELVGQNHGMEGEACIGGDVTFNDVAIDFSHEEWGWLNSAQRDLYKDVMVQNYENLVSVAGLSITKPYVITLLEDGKEP

SEQ ID NO: 3971 - protein, 81 aa, Pan troglodytes
MPQVTFNDVAIDFSHEEWGWLNSAQRDLYKDVMVQNYENLVSVAGLSITKPYVITLLEDGKEPWMMEKKLSKGMIPHWESR

SEQ ID NO: 3972 - protein, 81 aa, Pan troglodytes
MPQVTFNDVAIDFSHEEWGWLNSAQRDLYKDVMVQNYENLVSVGLSITKPYVITLLEDGKEPWMMEKKLSKGMIPHWESRW

SEQ ID NO: 3973 - protein, 81 aa, Pan troglodytes
MPQVTFNDVAIDFSHEEWGWLNSAQRDLYKDVMVQNYENLVSVAGLSITKPYVITLLEDGKEPWMMEKKLSKDWESRWENK

SEQ ID NO: 3974 - protein, 81 aa, Pan troglodytes
MAQGLVTFRDVAIEFSLEEWKCLEPAQRDLYREVTLENFGHLASLGLSISKPDVVSLLEQGKEPWMIANDVTGPWCPDLES

SEQ ID NO: 3975 - protein, 81 aa, Pan troglodytes
EESREIRAGQIVLKAMAQGLVTFRDVAIEFSLEEWKCLEPAQRDLYREVTLENFGHLASLGLSISKPDVVSLLEQGKEPWM

SEQ ID NO: 3976 - protein, 81 aa, Pan troglodytes
MAEGSVMFSDVSIDFSQEEWDCLDPVQRDLYRDVMLENYSNLVSMGKGICTSDSQFSSGMSASSTVNFSAPFQDFTLLSLK

SEQ ID NO: 3977 - protein, 81 aa, Pan troglodytes
SPQKSSALAPEDHGSSYEGSVSFRDVAIDFSREEWRHLDLSQRNLYRDVMLETYSHLLSVGYQVPKPEVVMLEQGKEPWAL

SEQ ID NO: 3978 - protein, 81 aa, Pan troglodytes
MARKLVMFRDVAIDFSQEEWECLDSAQRDLYRDVMLENYSNLVSLDLPSRCASKDLSPEKNTYETELSQWEMSDRLENCDL

SEQ ID NO: 3979 - protein, 81 aa, Pan troglodytes
TELSQWEMSDRLENCDLEESNSRDYLEAKGKMEKQQENQKEYFRQGMIIYDKMSIFNQHTYLSQHSKCHSTEKPYKCKECG

SEQ ID NO: 3980 - protein, 81 aa, Pan troglodytes
FRDVAIDFSQEEWECLDSAQRDLYRDVMLENYSNLVSLDLPSRCASKDLSPEKNTYETELSQWEMSDRLENCDLEESNSRD

SEQ ID NO: 3981 - protein, 81 aa, Pan troglodytes
MKPAQRNLYRDVMLENYSNLVTVGCQVTKPDVIFKLEQEEEPWVMEEEMFGRHCPEPRRGENCCASEVMAEGLKFKDVVIY

SEQ ID NO: 3982 - protein, 81 aa, Pan troglodytes
HCPEPRRGENCCASEVMAEGLKFKDVVIYFSQKEWECLHSAQKDLYRDVMLENYGNLVLLGLSDTKPNVISLLEQKKEPWM

SEQ ID NO: 3983 - protein, 81 aa, Pan troglodytes
QEEWEQMKPAQRNLYRDVMLENYSNLVTVGCQVTKPDVIFKLEQEEEPWVMEEEMFGRHCPEPRRGENCCASEVMAEMEFC

SEQ ID NO: 3984 - protein, 81 aa, Pan troglodytes
MAHLMMFRDVAVDFSQEEWECLDLEQRDLYRDVMLENYSNMVSLGLCIYQPEAFSLLEKGKEPWKILRDETRGPCPDMQSR

SEQ ID NO: 3985 - protein, 81 aa, Pan troglodytes
MNMEGLVMFQDLSIDFSQEEWECLDAAQKDLYRDVMMENYSSLVSLGLSIPKPDVISLLEQGKEPWMVSRDVLGGWCRELE

SEQ ID NO: 3986 - protein, 81 aa, Pan troglodytes
MAQGSVSFNDVTVDFTQEEWQHLDHAQKTLYMDVMLENYCHLISVGCHMTKPDVILKLERGEEPWTSFAGHTCLGGEDGLT

SEQ ID NO: 3987 - protein, 81 aa, Pan troglodytes
FHMAKPDMIRKLEQGEELWTQRIFPSYSYLEEDGKTEDVLVKFKEYQDRHSRPLILINHKKLIKERSNIYGKTFTLGRNRI

SEQ ID NO: 3988 - protein, 81 aa, Pan troglodytes
GFHMAKPDMIRKLEQGEELWTQRIFPSYSYLEDGKTEDVLVKFKEYQDRHSRPLILINHKKLIKERSNIYGKTFTLGRNRI

SEQ ID NO: 3989 - protein, 81 aa, Pan troglodytes
MLETYNHLVSLEIPSSKPKLIAQLEQGEEPWREERKCPLDLCPESKPEIQLSPSCPLIFSNQQALSQHVWLSHLSQLFSSL

SEQ ID NO: 3990 - protein, 81 aa, Pan troglodytes
MATGLLRAKKEEEWRLLSPAQRTLHREVMLETYNHLVSLEIPSSKPKLIAQLEQGEEPWREERKCPLDLCPAESKPEIQLS

SEQ ID NO: 3991 - protein, 81 aa, Pan troglodytes
KLIAQLEQGEEPWREERKCPLDLCPAESKPEIQLSPSCPLIFSNQQALSQHVWLSHLSQLFSSLWAGNPLQLGKHYPEDPK

SEQ ID NO: 3992 - protein, 81 aa, Pan troglodytes
MATGLLRAKKEAFVAFRDVAVDFTQEEWRLLSPAQRTLHREVMLETYNHLVSLEIPSSKPKLIAQLEQGEEPWREERKCPL

SEQ ID NO: 3993 - protein, 81 aa, Pan troglodytes
TCMVHRQTMSCSGAGGITAFVAFRDVAVDFTQEEWRLLSPAQRTLHREVMLETYNHLVSLEIPSSKPKLIAQLEQGEEPWR

SEQ ID NO: 3994 - protein, 81 aa, Pan troglodytes
MAMGLCKAMSQGLVTFRDVALDFSQEEWEWLKPSQKDLYRDVMLENYRNLVWLGLSISKPNMISLLEQGKEPWMVERKMSQ

SEQ ID NO: 3995 - protein, 81 aa, Pan troglodytes
MAMGLCKAMSQGLVTFRDVALDFSQEEWEWLKPSQKDLYRDVMLENYRNLVWLDWESWCEIEELSPKWFIDEDEISQEMVM

SEQ ID NO: 3996 - protein, 81 aa, Pan troglodytes
MAMGLCKAMSQGLVTFRDVALDFSQEEWEWLKPSQKDLYRDVMLENYRNLVWLGDGCSCRSTLRTTVTAEASSSSSSIQAS

SEQ ID NO: 3997 - protein, 81 aa, Pan troglodytes
PICETEELTPKQDFYEEHQSQKIIETLTSYNLEYSSLREEWKCEGYFERQPGNQKACFKEEIITHEEPLFDEREQEYKSWG

SEQ ID NO: 3998 - protein, 81 aa, Pan troglodytes
QGKAPWMVKRELTKGLCSGWEPICETEELTPKQDFYEEHQSQKIIETLTSYNLEYSSLREEWKCEGYFERQPGNQKACFKE

SEQ ID NO: 3999 - protein, 81 aa, Pan troglodytes
MAHALVTFRDVAIDFSQKEWECLDTTQRKLYRDVMLENYNNLVSLGYSGSKPDVITLLEQGKEPCVAAKDVTGRQCPGLLS

SEQ ID NO: 4000 - protein, 81 aa, Pan troglodytes
MAHALVTFRDVAIDFSQKEWECLDTTQRKLYRDVMLENYNNLVSLGLLSRHKTKKLSSEKDIHEISLSKGSIIEKSKTLHL

SEQ ID NO: 4001 - protein, 81 aa, Pan troglodytes
MAHALVTFRDVAIDFSQKEWECLDTTQRKLYRDVMLENYNNLVSLAGYSGSKPDVITLLEQGKEPCVAAKDVTGRQCPGLL

SEQ ID NO: 4002 - protein, 81 aa, Pan troglodytes
CNWGRPLKFCPTKYMKFQELVTFRDVAIDFSRQEWEYLDPNQRDLYRDVMLENYRNLVSLGGHSISKPVVVDLLERGKEPW

SEQ ID NO: 4003 - protein, 81 aa, Pan troglodytes
MTCFQELVTFRDVAIDFSRQEWEYLDPNQRDLYRDVMLENYRNLVSLGGHSISKPVVVDLLERGKEPWMILREETQFTDLD

SEQ ID NO: 4004 - protein, 81 aa, Pan troglodytes
TCNWGRPLKFCPTKYMKFQELVTFRDVAIDFSRQEWEYLDPNQRDLYRDVMLENYRNLVSLGGHSISKPVVVDLLERGKEP

SEQ ID NO: 4005 - protein, 81 aa, Pan troglodytes
MLENYSHLISLGSSISKPDVITLLEQEKEPWMVVRKETSRWYPDLESKYGPEKVSPENDTSEVNLPKQVIKQISTTLGVEA

SEQ ID NO: 4006 - protein, 81 aa, Pan troglodytes
GRSLRKIDQFCNSSNMVHGSVTFRDVAIDFSQEEWECLQPDQRTLYRDVMLENYSHLISLGSSISKPDVITLLEQEKEPWM

SEQ ID NO: 4007 - protein, 81 aa, Pan troglodytes
MVHGSVTFRDVAIDFSQEEWECLQPDQRTLYRDVMLENYSHLISLGSSISKPDVITLLEQEKEPWMVVRKETSRWYPDLES

SEQ ID NO: 4008 - protein, 81 aa, Pan troglodytes
MVHGSVTFRDVAIDFSQEEWECLQPDQRTLYRDVMLENYSHLISLAGSSISKPDVITLLEQEKEPWMVVRKETSRWYPDLE

SEQ ID NO: 4009 - protein, 81 aa, Pan troglodytes
MAQVPLTFSDVAIDFSQEEWEYLNSDQRDLYRDVMLENYTNLVSLEFDFTTESDKLSSEKRNYEVNAYHQETWKRNKTFNL

SEQ ID NO: 4010 - protein, 81 aa, Pan troglodytes
FQVPLTFSDVAIDFSQEEWEYLNSDQRDLYRDVMLENYTNLVSLEFDFTTESDKLSSEKRNYEVNAYHQETWKRNKTFNLM

SEQ ID NO: 4011 - protein, 81 aa, Pan troglodytes
MTKSKEAVTFKDVAVVFSEEELQLLDLAQRKLYQDVMLENFRNVVSVGHQSTPDGLPQLEREEKLWVMKMATQRDNSSGAK

SEQ ID NO: 4012 - protein, 81 aa, Pan troglodytes
MLENFRNVVSVGHQSTPDGLPQLEREEKLWVMKMATQRDNSSGAKNLKEMETLQEVGLRYLPHEELFCSQIWQQITRELIK

SEQ ID NO: 4013 - protein, 81 aa, Pan troglodytes
HLGLCKFPEVEGKMTTFKEAVTFKDVAVVFTEEELGLLDPAQRKLYRDVMLENFRNLLLVGNQPFHQDTFHFLRKEEFWMM

SEQ ID NO: 4014 - protein, 81 aa, Pan troglodytes
HFLRKEEFWMMKTTSQREGNSGGKIQIEMETVPEAGPHEEWSCQQIREQIASDLTRSQNSIRNSSQFFKEGDVPCQTEAEL

SEQ ID NO: 4015 - protein, 81 aa, Pan troglodytes
EQCEKGYNSKFNLDMHQRVHRGERPYNCKECGKSFGWASCLLKHQRLHSGQKPLKSGVWEEIYSEFTASFTSVSLYGRKAI

SEQ ID NO: 4016 - protein, 81 aa, Pan troglodytes
AQRKLYRDVMLENFRNLLLVGNQPFHQDTFHFLRKEEFWMMKTTSQREGNSGGKIQIEMETVPEAGPHEEWSCQQIREQIA

SEQ ID NO: 4017 - protein, 81 aa, Pan troglodytes
LREEKFWMMGTATQREGNSGGKIQTELESVPEAGAHEEWSCQQIWEQIANDLTRSQDSIINNSQFFENAVILRREVYTCDE

SEQ ID NO: 4018 - protein, 81 aa, Pan troglodytes
LREEKFWMMGTATQREGNSGGKIQTELESVPEAGAHEEWSCQQIWEQIANDLTRSQDSIINNSQFFENGDVPSQVEAGLPT

SEQ ID NO: 4019 - protein, 81 aa, Pan troglodytes
DVMLENFRNLLSVGHQPFHQDTCHFLREEKFWMMGTATQREGNSGGKIQTELESVPEAGAHEEWSCQQIWEQIANDLTRSQ

SEQ ID NO: 4020 - protein, 81 aa, Pan troglodytes
HFLREEKFWMMGTATQREGNSGGKIQIEMETVPEAGPHEEWSCQQIREQIASDLTRSQNSIRNSSQFFKEGDVPCQTEAEL

SEQ ID NO: 4021 - protein, 81 aa, Pan troglodytes
MTTFKEAVTFKDVAVFFTEEELGLLDPAQRKLYQDVMLENFTNLLSVGHQPFHPFHFLREEKFWMMETATQREGNSGGKTV

SEQ ID NO: 4022 - protein, 81 aa, Pan troglodytes
MTTFKEAVTFKDVAVFFTEEELGLLDPAQRKLYQDVMLENFTNLLSVGHQPFHPFHFLREEKFWMMETATQREGNSGKKQA

SEQ ID NO: 4023 - protein, 81 aa, Pan troglodytes
QREEKFWIMETATQREGNSGGKIQTELESVPETGPQEEWSCQQIWEQTASELTRPQDSVSSSQFSTQGDVPSQVDAGLSII

SEQ ID NO: 4024 - protein, 81 aa, Pan troglodytes
MTMFKEAMTFKDVAVVFTEEELGLLDLAQRKLYRDVMLENFRNLLSVGHQAFHRDTFHFLREEKIWMMKTAIQREGNSGDK

SEQ ID NO: 4025 - protein, 81 aa, Pan troglodytes
LLSVGHQAFHRDTFHFLREEKIWMMKTAIQREGNSGDKIQTEMETVSEAGTHQEWSFQQIWEKIASDLTRSQDLVINSSQF

SEQ ID NO: 4026 - protein, 81 aa, Pan troglodytes
MTTFKEGLTFKDVAVVFTEEELGLLDPVQRNLYQDVMLENFRNLLSVGDLSLHISEFSVLTADKIQSEVETVPEAGRHEEL

SEQ ID NO: 4027 - protein, 81 aa, Pan troglodytes
MNMFKEAVTFKDVAVAFTEEELGLLGPAQRKLYRDVMVENFRNLLSVGHQPFKQDVSPIERNEQLWVMTTATRRQGNLGEK

SEQ ID NO: 4028 - protein, 81 aa, Pan troglodytes
VGHQPFKQDVSPIERNEQLWVMTTATRRQGNLGEKNQSKLITVQDRESEEELSCWQIWQQIANDLTRCQDSMINNSQCHRQ

SEQ ID NO: 4029 - protein, 81 aa, Pan troglodytes
MNMFKEAVTFKDVAVAFTEEELGLLGPAQRKLYRDVMVENFRNLLSVGHQPFKQDVSPIERNEQLWVMTTATRRQGNLGKN

SEQ ID NO: 4030 - protein, 81 aa, Pan troglodytes
MNMFKEAVTFKDVAVAFTEEELGLLGPAQRKLYRDVMVENFRNLLSVGHQPFKQDVSPIERNEQLWVMTTATRRQGNLDTL

SEQ ID NO: 4031 - protein, 81 aa, Pan troglodytes
MVENFRNLLSVGHQPFKQDVSPIERNEQLWVMTTATRRQGNLGEKNQSKLITVQDRESEEELSCWQIWQQIANDLTRCQDS

SEQ ID NO: 4032 - protein, 81 aa, Pan troglodytes
RNEQLWVMTTATRRQGNLGEKNQSKLITVQDRESEEELSCWQIWQQIANDLTRCQDSMINNSQCHRQGDFPYQVGTELSIQ

SEQ ID NO: 4033 - protein, 81 aa, Pan troglodytes
IERNEQLWVMTTATRRQGNLGEKNQSKLITVQDRESEEELSCWQIWQQIANDLTRCQDSMINNSQCHRQGDFPYQVGTELS

SEQ ID NO: 4034 - protein, 81 aa, Pan troglodytes
PGTLPFPRRRRGKMTKFQEAVTFKDVAVAFTEEELGLLDSAQRKLYRDVMLENFRNLVSVGHQSFKPDMISQLEREEKLWM

SEQ ID NO: 4035 - protein, 81 aa, Pan troglodytes
MTKFQEMVTFKDVAVVFTREELGLLDLAQRKLYQDVMLENFRNLLSVGYQPFKLDVILQLGKEDKLRMMETEIQGDGCSGE

SEQ ID NO: 4036 - protein, 81 aa, Pan troglodytes
MTKFQEMVTFKDVAVVFTREELGLLDLAQRKLYQDVMLENFRNLLSVGYQPFKLDVILQLGKEDKLRMMETEIQGDGCSGH

SEQ ID NO: 4037 - protein, 81 aa, Pan troglodytes
FWRYNLVLPSQDPALPQKEQEKMTKFQEMVTFKDVAVVFTREELGLLDLAQRKLYQDVMLENFRNLLSVGYQPFKLDVILQ

SEQ ID NO: 4038 - protein, 81 aa, Pan troglodytes
MTKFQEMVTFKDVAVVFTREELGLLDLAQRKLYQDVMLENFRNLLSVGYQPFKLDVILQLGKEDKLRMMETEIQGDGCSGL

SEQ ID NO: 4039 - protein, 81 aa, Pan troglodytes
MVTFKDVAVVFTEEELGLLDSVQRKLYRDVMLENFRNLLLVAHQPFKPDLISQLEREEKLLMVETETPRDGCSGRKNQQKM

SEQ ID NO: 4040 - protein, 81 aa, Pan troglodytes
MTKFQEMVTFKDVAVVFTEEELGLLDSVQRKLYRDVMLENFRNLLLVAHQPFKPDLISQLEREEKLLMVETETPRDGCSGR

SEQ ID NO: 4041 - protein, 81 aa, Pan troglodytes
MIKFQMVTFKDVAVVFTEEELGLLDSVQRKLYRDVMLENFRNLLLVAHQPFKPDLISQLEREEKLLMVETETPRDGCSGRK

SEQ ID NO: 4042 - protein, 81 aa, Pan troglodytes
MEALEADLKHRFTRQEWDLAKSLQKTIQAARSENYSLTDFWAYMVISKQTRELPESHLSNMKKPVEEGTLPYPIFAAIDND

SEQ ID NO: 4043 - protein, 81 aa, Pan troglodytes
SWPQAIVPPQPPKVLGLQDSVTFADVAVNFTKEEWTLLDPAQRNLYRDVMLENSRNLAFIDWATPCKTKDATPQPDILPKR

SEQ ID NO: 4044 - protein, 81 aa, Pan troglodytes
LSQKPQVLGPEKQDGSCEASVSFEDVTVDFSREEWQQLDPAQRCLYRDVMLELYSHLFSVGYHIPNPEVIFRMPKEKEPRV

SEQ ID NO: 4045 - protein, 81 aa, Pan troglodytes
NATIVMSVRREQGSSAGEGSLSFEDVAVGFTREEWQFLDQSQKVLYREVMLENYSNLVSIGYQGTKPDSLFKLEQGEPPGI

SEQ ID NO: 4046 - protein, 81 aa, Pan troglodytes
MTKAQESLTLEDVAVDFTWEEWQFLSPAQKDLYRDVMLENYSNLVSVGYQAGKPDALTKLEQGEPLWTLEDEIHSPAHPEI

SEQ ID NO: 4047 - protein, 81 aa, Pan troglodytes
MIKSQESLALEDVAVEFTWEEWQLLGPAQKDLYRDVMLENYSNLVSVGYQASKPDALFKLEQGEPWTVENEIHSQICPEIK

SEQ ID NO: 4048 - protein, 81 aa, Pan troglodytes
MIQAQESITLEDVAVDFTWEEWQFLSPAQKDLYRDVMLENYSNLVAVGYQASKPDALFKLEQGEQPWTIEDGIHSGACSDI

SEQ ID NO: 4049 - protein, 81 aa, Pan troglodytes
MLENYSNLVAVGYQASKPDALFKLEQGEQPWTIEDGIHSGACSDIWKVDHVLERLQSESLVNRRKPCHEHDAFENIVHCSK

SEQ ID NO: 4050 - protein, 81 aa, Pan troglodytes
MMQAQESLTLEDVAVDFTWEEWQLLSPAQKDLYRDVMLENYSNLVSVGYQASKPDAFSKLERGEETCTTEDEIYSRICSDS

SEQ ID NO: 4051 - protein, 81 aa, Pan troglodytes
MMQAQESLTLEDVAVDFTWEEWQLLSPAQKDLYRDVMLENYSNLVSVGYQASKPDAFSKLERGEETCTTEDEIYSRICSEI

SEQ ID NO: 4052 - protein, 81 aa, Pan troglodytes
MRPEPTKFWEESLTLEDVAVDFTWEEWQLLSPAQKDLYRDVMLENYSNLVSVGYQASKPDAFSKLERGEETCTTEDEIYSR

SEQ ID NO: 4053 - protein, 81 aa, Pan troglodytes
MESLTLEDVAVDFTWEEWQLLSPAQKDLYRDVMLENYSNLVSVGYQASKPDAFSKLERGEETCTTEDEIYSRICSDSGGAS

SEQ ID NO: 4054 - protein, 81 aa, Pan troglodytes
MIKTQESLTLEDVAVEFSWEEWQLLDTAQKNLYRDVMVENYNHLVSLGYQTSKPDVLSKLAHGQEPWITDAKIQNKNCPGI

SEQ ID NO: 4055 - protein, 80 aa, Pan troglodytes [sequence omitted]

SEQ ID NO: 4056 - protein, 81 aa, Pan troglodytes
MALPQGSLTFRDVAIEFSQEEWKCLDPVQKALYRDVMLENYRNLGFLGLCLPDLNIISVLEQGKEPWTVVSQVKIARNPNC

SEQ ID NO: 4057 - protein, 81 aa, Pan troglodytes
EAQERKKKEKEPGMALPQGSLTFRDVAIEFSQEEWKCLDPVQKALYRDVMLENYRNLGFLGLCLPDLNIISVLEQGKEPWT

SEQ ID NO: 4058 - protein, 81 aa, Pan troglodytes
MATQGHLTFKDVAIEFSQEEWKCLEPMQKALYKDVMLENYRNLVFLGISPKCVIKELPPTENSNTGERFQTVPLERHQSYD

SEQ ID NO: 4059 - protein, 81 aa, Pan troglodytes
MLENYRNLVSLGICLPDLSIISMMKQRTEPWAVENEMKVAKNPDRWEGIKDTNTGRSCAVRSKAGNKPITNQLGLTFHLPL

SEQ ID NO: 4060 - protein, 81 aa, Pan troglodytes
PWSGENEVKIAKNSDGRECIKGVNTGWSAMVQSRLTATSTSWVQAVLLPQPPEQLGLQGAAMHWEAMQKTNQLKNNLEYPF

SEQ ID NO: 4061 - protein, 81 aa, Pan troglodytes
DEEAQKRKAKESGMALPQGHLTFMDVAIEFSQEEWKSLDPGQRALYRDVMLENYRNLVFLGICLPDLSIISMLKQRREPLI

SEQ ID NO: 4062 - protein, 81 aa, Pan troglodytes
DEEAQKRKAKESGMALPQGHLTFMDVAIEFSQEEWKSLDPGQRALYRDVMLENYRNLVFLGRSCVLGSNAENKPIKNQLGL

SEQ ID NO: 4063 - protein, 81 aa, Pan troglodytes
VSWRPGSRLRGVTVMLRRGHLTFRDVAIEFSQEEWKCLDPAQRTLYREVMVENYRNLVFLETISSIIPSGLKITAFFRILP

SEQ ID NO: 4064 - protein, 81 aa, Pan troglodytes
LYRDVMLENYRNLVSLGICLPDLSVTSMLEQKRDPWTLQSEEKIANDPDGRECIKGVNTDSPLLQCITSVPCVFCTASMIY

SEQ ID NO: 4065 - protein, 81 aa, Pan troglodytes
MALTQGQLSFSDVAIEFSQEEWKCLDPGQKALYRDVMLENYRNLISLGICLPDLSVTSMLEQKRDPWTLQSEVKIVNNPDG

SEQ ID NO: 4066 - protein, 81 aa, Pan troglodytes
MALTQGQLSFSDVAIEFSQEEWKCLDPGQKALYRDVMLENYRNLISLGEDNVPPEACFCSGICLPDLSVTSMLEQKRDPWT

SEQ ID NO: 4067 - protein, 81 aa, Pan troglodytes
MALTQGQLSFSDVAIEFSQEEWKCLDPGQKALYRDVMLENYRNLISLGICLPDLSVTSIFFTSGLGRARLQGGSLARVSRV

SEQ ID NO: 4068 - protein, 81 aa, Pan troglodytes
EEAAQKRKGKEPGMALPQGRLTFRDVAIEFSLAEWKFLNPAQRALYREVMLENYRNLEAVDISSKRMMREVLSTGQGNTEV

SEQ ID NO: 4069 - protein, 81 aa, Pan troglodytes
REEAAQKRKGKEPGMALPQGRLTFRDVAIEFSLAEWKFLNPSQRALYREVMLENYRNLEAVDISSKRMMKEVLSTGQGNTE

SEQ ID NO: 4070 - protein, 81 aa, Pan troglodytes
MALPQGLLTFRDVAIEFSQEEWKCLDPAQRTLYRDVMLENYRNLVSLGIFSKCEIKELPPKKESNTGEIFQTVMLERHESH

SEQ ID NO: 4071 - protein, 81 aa, Pan troglodytes
DPAQRTLYRDVMLENYRNLVSLGIFSKCEIKELPPKKESNTGEIFQTVMLERHESHDIQDFCFRETQKNVHDSQCLWQHDE

SEQ ID NO: 4072 - protein, 81 aa, Pan troglodytes
AIEFSQEEWKCLDPAQRTLYRDVMLENYRNLVSLGIFSKCEIKELPPKKESNTGEIFQTVMLERHESHDIQDFCFRETQKN

SEQ ID NO: 4073 - protein, 81 aa, Pan troglodytes
MALPQGLLTFRDVAIEFSQEEWKCLDPAQRTLYRDVMLENYRNLVSLGHDLILFFLFLRWSFSCCPGWSAVAQSRLTTTSA

SEQ ID NO: 4074 - protein, 81 aa, Pan troglodytes
MALPQGLLTFRDVAIEFSQEEWKCLDPAQRTLYRDVMLENYRNLVSLGHDLILFFLFLRWSFALVAQAGVQWHNLGSPQPP

SEQ ID NO: 4075 - protein, 81 aa, Pan troglodytes
EEAAQKRKGKEPGMALPQGRLTFRDVAIEFSLAEWKFLNPAQRALYREVMLENYRNLEAVDISSKHMMKEVLSTGQGNTEV

SEQ ID NO: 4076 - protein, 81 aa, Pan troglodytes
EEAAQKRKGKEPGMALPQGRLTFRDVAIEFSLAEWKFLNPAQRALYREVMLENYRNLEAVESHFVTQAGVQWCDPGSLQPL

SEQ ID NO: 4077 - protein, 80 aa, Pan troglodytes
MLREEAAQKRKGKEPGMALPQGRLTFRDVAIEFSLAEWKFLNPAQRALYREVMLENYRNLEAVETGFHCVSQDGLNLLTS

SEQ ID NO: 4078 - protein, 81 aa, Pan troglodytes
MALPQGLLTFRDVAIEFSQEEWKCLDPAQRTLYRDVMLENYRNLVSLDISSKCMLKTLSSTGQGNTEVIHTGTLHRQASHH

SEQ ID NO: 4079 - protein, 81 aa, Pan troglodytes
LEFWSVTPAKVQWCHLRSLQPLLPRFKQFSCLSLPSTWDYRYLFQMHVEDVVINRARQYRSDPHRDIAQTSKSSHWRILFP

SEQ ID NO: 4080 - protein, 81 aa, Pan troglodytes
MALPQGLLTFRDVAIEFSQEEWKCLDPAQRTLYRDVMLENYRNLVSLVLRSEVCCTDIWAEVIVADISSKCMLKTLSSTGQ

SEQ ID NO: 4081 - protein, 81 aa, Pan troglodytes
MALPQSLLTFRDVAIEFSQEEWKCLDPAQRTLYRDVMLENYRNLVSLGLISRDLCYLRKTPRRQRKGARDGSSSGMLDFQR

SEQ ID NO: 4082 - protein, 81 aa, Pan troglodytes
MALPQGLLTFRDVAIEFSQEEWKCLDPAQRTLYRDVMLENYRNLVSLDISSKCMMKEFSSIGKGNTEVIHTGTLQRLASHH

SEQ ID NO: 4083 - protein, 81 aa, Pan troglodytes
EEATKKSKEKEPGMALPQGRLTFRDVAIEFSLEEWKCLNPAQRALYRAVMLENYRNLEFVDISSKCMMKVFSSTAQGNREV

SEQ ID NO: 4084 - protein, 81 aa, Pan troglodytes
LTGSTDQYDQRHAGNKLIKGQLGSSSHSHLPEHIFQPEWKIANQVEKSIINASLILTSQRISCSPKTHIFNNYGNNSLHSS

SEQ ID NO: 4085 - protein, 81 aa, Pan troglodytes
MLENYWNLVSLGLCHFDMNIISMLEEGKEPWTVKSCVKIARKPRMQECVKGVVTDIPPKCTIKDLLPKEKSSTEAVFHTVV

SEQ ID NO: 4086 - protein, 81 aa, Pan troglodytes
SMLEQGKEPFTVESQVQIARNPDGWEWIKAVITALSSEFVMKDLPHKGKSNTGEVFQTVMLERQESQDIEGCSFREVQKNT

SEQ ID NO: 4087 - protein, 81 aa, Pan troglodytes
MALPQGLLTFRDVAIEFSQEEWKCLDPAQRTLYRDVMLENYRNLVSLDISSKCMMKEFSSTAQGNTEVIHTGTLQRHERHH

SEQ ID NO: 4088 - protein, 81 aa, Pan troglodytes
MALPQGLLTFRDVAIEFSQEEWKCLDPAQRTLYRDVMLENYRNLVSLGISSKCTMKEFSSTAQGNREVIHTGTLQRHESHH

SEQ ID NO: 4089 - protein, 81 aa, Pan troglodytes
MLENYRNLVSLGISSKCTMKEFSSTAQGNREVIHTGTLQRHESHHIGDFSFQEIEKDIHNFEFQWQEDERNGHEAPMTKIK

SEQ ID NO: 4090 - protein, 81 aa, Pan troglodytes
MALPQGLLTFRDVAIEFSQEEWKCLDPAQRTLYRDVMLENYRNLVSLDISSKCMMKEVLSTAQGNREVIHTGTLQRHESHH

SEQ ID NO: 4091 - protein, 81 aa, Pan troglodytes
MALPQGLLTFRDVAIEFSQEEWKCLDPAQRTLYRDVMLENYRNLVSLDTGFLLFCLANLKLLPSGDPSTSASKTAAITDIS

SEQ ID NO: 4092 - protein, 81 aa, Pan troglodytes
MSQGSVTFQDVAIDFSKEEWGFLNPAQRDLYTTVMLENYQNLVWLGLSISKSVISLLEKRKLPWIMAKEEIRGPLPGYFKV

SEQ ID NO: 4093 - protein, 81 aa, Pan troglodytes
LEYSLLGEHWDYDALFETQPGLVTIKNLAVDFPQQLHPAQKNFCKNGIWENNSDLGSAGHCVAKPDLVSLLEQEKEPWMVK

SEQ ID NO: 4094 - protein, 81 aa, Pan troglodytes
SQEEVEVAGIKLCKAMSLGSVTFTDVAIDFSQDEWEWLNLAQRSLYKKVMLENYRNLVSVGLCISKPVVISLLEQEKDPWV

SEQ ID NO: 4095 - protein, 81 aa, Pan troglodytes
QRSLYKKVMLENYRNLVSVGLCISKPVVISLLEQEKDPWVIKGGMNRGLCPEEMLCKDTTRILPSASQEERPHQEPALPAP

SEQ ID NO: 4096 - protein, 81 aa, Pan troglodytes
MAAQLLTDEALESVTFRDVTVDFTQEEWQQLEPAQKDLYRDVMLENYRNLVSLDWETRPEMKELDPKNDISEDKLSVVGVA

SEQ ID NO: 4097 - protein, 81 aa, Pan troglodytes
RDSRAYESRSQDAESYQNVVDLAEDRKPHNTIQDNMENYRKLLSLGFLAQDSVPAEKRNTEMLDNLSSAGSQFLDFKHLGT

SEQ ID NO: 4098 - protein, 81 aa, Pan troglodytes
MNNSQGRVTFEDVTVNFTQGEWQRLNPEQRNLYRDVMLENYSNLVSVGQRETTKPDVILRLEQGKEPWSEEEEVLGSGRAE

SEQ ID NO: 4099 - protein, 81 aa, Pan troglodytes
MAAAVLTDRAQVSVTFDDVAVTFTKEEWGQLDLAQRTLYQEVMLENCGLLVSLAPSQTHPGSVRCILQSNQVDTLIKIPEH

SEQ ID NO: 4100 - protein, 81 aa, Pan troglodytes
MLMDAGQDYMVFEDVAIHFSQEEWGILNDVQRHLHSDVMLENFALLSSVGCWHGAKDEEAPSKQCVSVGVSEVTTLKPALS

SEQ ID NO: 4101 - protein, 81 aa, Pan troglodytes
MNLTEDYMVFEDVAIHFSQEEWGILNDVQRHLHSDVMLENFALLSSVGCWHGAKDEEAPSKQCVSVGVSEVTTLKPALSTQ

SEQ ID NO: 4102 - protein, 81 aa, Pan troglodytes
DPAQVPVAADLLTDHEEQGYVTFEDVAVYFSQEEWRLLDDAQRLLYRNVMLENFTLLASLGKVLIPHPSILSWARLFLLFL

SEQ ID NO: 4103 - protein, 81 aa, Pan troglodytes
MAAAALRDPAQGYVTFEDVAVYFSQEEWRLLDDAQRLLYRNVMLENFTLLASLGKVLIPHPSILSWARLFLLFLGRGLFFP

SEQ ID NO: 4104 - protein, 81 aa, Pan troglodytes
DPAQVPVAADLLTDHEEQGYVTFEDVAVYFSQEEWRLLDDAQRLLYRNVMLENFTLLASLGSWQGAEAEEAPEQSASVEVL

SEQ ID NO: 4105 - protein, 81 aa, Pan troglodytes
MAAAALRDPAQGYVTFEDVAVYFSQEEWRLLDDAQRLLYRNVMLENFTLLASLGSWQGAEAEEAPEQSASVEVLSSNVQQH

SEQ ID NO: 4106 - protein, 81 aa, Pan troglodytes
RDPAQVPVAADLLTDHEEGYVTFEDVAVYFSQEEWRLLDDAQRLLYRNVMLENFTLLASLGKVLIPHPSILSWARLFLLFL

SEQ ID NO: 4107 - protein, 81 aa, Pan troglodytes
MAAAALRDPAQQGYVTFEDVAVYFSQEEWRLLDDAQRLLYRNVMLENFTLLASLGSWQGAEAEEAPEQSASVEVLSSNVQQ

SEQ ID NO: 4108 - protein, 81 aa, Pan troglodytes
RDPAQVPVAADLLTDHEEGYVTFEDVAVYFSQEEWRLLDDAQRLLYRNVMLENFTLLASLGSWQGAEAEEAPEQSASVEVL

SEQ ID NO: 4109 - protein, 81 aa, Pan troglodytes
MAETKDAAQMLVTFKDVAVTFTREEWRQLDLAQRTLYREVMLETCGLLVSVGHRVPKPELVHLLEHGQELWIVKRGLSHAT

SEQ ID NO: 4110 - protein, 81 aa, Pan troglodytes
MLVTFKDVAVTFTREEWRQLDLAQRTLYREVMLETCGLLVSVGHRVPKPELVHLLEHGQELWIVKRGLSHATCAGDRAQVH

SEQ ID NO: 4111 - protein, 81 aa, Pan troglodytes
RDSTSVPVTAEAKLMGFTQGCVTFEDVAIYFSQEEWGLLDEAQRLLYRDVMLENFALITALVCWHGMEDEETPEQSVSVEG

SEQ ID NO: 4112 - protein, 81 aa, Pan troglodytes
DRGAQVPIATEVLFKLTQGSVTFEDVAVYFSWEEWDLLDEAQKHLYFDVMLENFALTSSLGLTLSWSHVVAQLGLGEVPSV

SEQ ID NO: 4113 - protein, 81 aa, Pan troglodytes
MNTVTNGNVKTTGINDTKGSVTFEDVAVYFSWEEWDLLDEAQKHLYFDVMLENFALTSSLGCWCGVEHEETPSEQRISGER

SEQ ID NO: 4114 - protein, 81 aa, Pan troglodytes
MAAVALRDSAQGTVTFEDVAVNFSQEEWSLLSEAQRCLYHDVMLENLTLISSLGCWYEAKDETPSKQTLSIQQESPLRTHW

SEQ ID NO: 4115 - protein, 81 aa, Pan troglodytes
MAAATLRTPTQGTVTFEDVAVHFSWEEWGLLDEAQRCLYHEVMLENLALLTSLDVHHQKQHLGEKHFRSNVGRALFVKTCT

SEQ ID NO: 4116 - protein, 81 aa, Pan troglodytes
PAAVRAHGPMAELTDSARGCVVFEDVFVYFSREEWELLDDAQRLLYHDVMLENFALLASLGIAFSRSRAVMKLQRGEEPWV

SEQ ID NO: 4117 - protein, 81 aa, Pan troglodytes
MAAAALRPPAQGTVTFEDVAVNFSQEEWSLLSEAQRCLYHDVMLENLTLISSLGCWYEAKDETPSKQTLSIQQESPLRTHW

SEQ ID NO: 4118 - protein, 81 aa, Pan troglodytes
MAAAAALRAPAQSSVTFEDVAVNFSLEEWSLLNEAQGCLYHDVMLETLTLISSLGGVPPHRLFPTGACGPQVPSSRIRPSP

SEQ ID NO: 4119 - protein, 81 aa, Pan troglodytes
MAAAALRFPVQGTVTFEDVAVKFTQEEWNLLSEAQRCLYRDVTLENLALMSSLGCWCGVEDEVAPSKQSIYIQRETQVRTP

SEQ ID NO: 4120 - protein, 81 aa, Pan troglodytes
MAAAAPRRPTQGTVTFEDVAVKFTQEEWNLLSEAQRCLYRDVTLENLALMSSLGCWCGVEDEAAPSKQSIYIQRETQVRTP

SEQ ID NO: 4121 - protein, 81 aa, Pan troglodytes
MAVAVTLRLSAQGTVTFEDVAVKFTQEEWNLLSEAQRCLYRDVTLENLALMSSLGCWCGVEDEAAPSKQSIYIQRETQVRT

SEQ ID NO: 4122 - protein, 81 aa, Pan troglodytes
MAAAATLRLSAQGTVTFEDVAVNFTWEEWNLLSEAQRCLYRDVTLENLALISSLDPALDGSADNTQTGNLGQSLLPSHPQQ

SEQ ID NO: 4123 - protein, 81 aa, Pan troglodytes
WRDHGSPQPPPTGDILIQGTVTFEDVAVNFTWEEWNLLSEAQRCLYRDVTLENLALISSLDPALDGSADNTQTGNLGQSLL

SEQ ID NO: 4124 - protein, 81 aa, Pan troglodytes
MAAAATLRLSAQGTVTFEDVAVNFTWEEWNLLSEAQRCLYRDVTLENLALISSLGMTFLHVCQALDSLRQVIHPPQPPKVL

SEQ ID NO: 4125 - protein, 81 aa, Pan troglodytes
LSAQGTVTFEDVAVNFTWEEWNLLSEAQRCLYRDVTLENLALISSLGMTFLHVCQALDSLRQVIPTSASQSAGITGSHSIP

SEQ ID NO: 4126 - protein, 81 aa, Pan troglodytes
MAAAATLRLSAQGTVTFEDVAVNFTWEEWNLLSEAQRCLYRDVTLENLALISSLGCWCGVEDEAAPSKQSIYIQRETQVRT

SEQ ID NO: 4127 - protein, 81 aa, Pan troglodytes
MAAAAPRHPTQQGTVTFEDVAVNFSQEEWCLLSEAQRCLYRDVMLENLALISSLGCWCGSKDEEAPCKQSISVQRESQSRT

SEQ ID NO: 4128 - protein, 81 aa, Pan troglodytes
MAAAAPRHPTQGTVTFEDVAVNFSQEEWCLLSEAQRCLYRDVMLENLALISSLGCWCGSKDEEAPCKQSISVQRESQSRTP

SEQ ID NO: 4129 - protein, 81 aa, Pan troglodytes
MAAAAPRRPTQGTVTFEDVAVNFSQEEWCLLSEAQRCLYRDVMLENLALISSLGCWCGSKDEEAPCKQRISIVICHLCQFL

SEQ ID NO: 4130 - protein, 81 aa, Pan troglodytes
HRMTWDCIAIGSHESSVQGTVAFEDVAVNFSQEEWSLLSEVQRCLYHDVMLENWVLISSLGCWCGSEDEEAPSKKSISIQR

SEQ ID NO: 4131 - protein, 81 aa, Pan troglodytes
MAAAEQTAPAQGIVTFEDVAVYFSWKEWGLLDEAQKCLYHDVMLENLTLTTSLGGSGAGDEEAPYEQSTSPQRVSQVRIPK

SEQ ID NO: 4132 - protein, 81 aa, Pan troglodytes
MTPGVRVSADPEQVTFEDVVVDFSQEEWGQLKPAQRTLYRDVMLDTFRLLVSVGHWLPKPNVISLLEQEAELWAVDSGLPQ

SEQ ID NO: 4133 - protein, 81 aa, Pan troglodytes
EDVAMAFTQEEWEHLDLAQRTLYREVTLETWEHIVSLGLFLSKSDVISQLEQEEDLCRAEQEAPRDGISLLLPRLECNGTI

SEQ ID NO: 4134 - protein, 81 aa, Pan troglodytes
EEWEHLDLAQRTLYREVTLETWEHIVSLGLFLSKSDVISQLEQEEDLCRAEQEAPRGTSGLSQVTGVVADGSFRFQVWDFT

SEQ ID NO: 4135 - protein, 81 aa, Pan troglodytes
QSEAAGPQDGGQEAAGPQGLVMFEDVTVYFSREEWGLLNVTQKGLYRDVMLENFALVSSLGLAPSRSPVFTQLEDDEQSWV

SEQ ID NO: 4136 - protein, 81 aa, Pan troglodytes
MAGEAEVSRGCLRGMRGGHQKGLYRDVMLENFALVSSLGLAPSRSPVFTQLEDDEQSWVPSWVDVTPVSRAEARRGFGLDG

SEQ ID NO: 4137 - protein, 81 aa, Pan troglodytes
GPAQHTSWPCGSAVPTLKSMVTFEDVAVYFSQEEWELLDAAQRHLYHSVMLENLELVTSLGCWRGVEGEEAHPEQNVSVEV

SEQ ID NO: 4138 - protein, 81 aa, Pan troglodytes
PTLKSMVTFEDVAVYFSQEEWELLDAAQRHLYHSVMLENLELVTSLGNALSQHDVFTCSVEADLPNCFPNWLHHFTSLSAV

SEQ ID NO: 4139 - protein, 81 aa, Pan troglodytes
PLAAQSPEGHHGHQEPASTSFHPPRIQEEWGLLDRSQKELYWDAMLEKYGTVVSLEEHPVTYQNRPHPSFKQTPRLTVPPT

SEQ ID NO: 4140 - protein, 81 aa, Pan troglodytes
PSNDTDCPQKKEGKAQIVVPVTFRDVTVIFTEAEWKRLSPEQRNLYKEVMLENYRNLLSLDGVSLLLPRLECNRAISAHHN

SEQ ID NO: 4141 - protein, 81 aa, Pan troglodytes
EEAAQKRKEKEPGMALPQGHLTFRDVAIEFSLEEWKCLDPTQRALYRAMMLENYRNLHSVDISSKCMMKKFSSTAQGNTEV

SEQ ID NO: 4142 - protein, 81 aa, Pan troglodytes
MLQTVWFQGLGRNLLFQEPVTFEDVAVYFTQNEWASLHPMQRALHREVMLENYANVTSLYPTAGGFPLDTERTEKVPGALS

SEQ ID NO: 4143 - protein, 81 aa, Pan troglodytes
MLQTVWFQGLGRNLLFQEPVTFEDVAVYFTQNEWASLHPMQRALHREVMLENYANVTSLSAFPFPKPDLIFQLEQGEAAWG

SEQ ID NO: 4144 - protein, 81 aa, Pan troglodytes
MLETYNNLVSLQELVSFEEVAVHFTWEEWQDLDDAQRTLYRDVMLETYSSLVSLGHCITKPEMIFKLEQGAEPWIVEETPN

SEQ ID NO: 4145 - protein, 81 aa, Pan troglodytes
MELLTFRDVAIEFSPEEWKCLDPAQQNLYRDVMLENYRNLVSLGVAISNPDLAIYLEQRKEPYKVKIHETVAKHPAVCSHF

SEQ ID NO: 4146 - protein, 81 aa, Pan troglodytes
MELLTFRDVAIEFSPEEWKCLDPAQQNLYRDVMLENYRNLVSLGVAISNPDLAIYLEQRKEPYKVKIHETVAKHPEFHSCC

SEQ ID NO: 4147 - protein, 81 aa, Pan troglodytes
ELLTFRDVAIEFSPEEWKCLDPAQQNLYRDVMLENYRNLVSLGVAISNPDLAIYLEQRKEPYKVKIHETVAKHPAVCSHFT

SEQ ID NO: 4148 - protein, 81 aa, Pan troglodytes
SQEESPEEDTERTERKPMVKDAFKDISIYFTKEEWAEMGDWEKTRYRNVKRNYNALITIGLRATRPAFMCHRRQAIKLQVD

SEQ ID NO: 4149 - protein, 81 aa, Pan troglodytes
RKPMVKDAFKDISIYFTKEEWAEMGDWEKTRYRNVKRNYNALITIGLRATRPAFMCHRRQAIKLQVDDTEDSDEEWTPRQQ

SEQ ID NO: 4150 - protein, 81 aa, Pan troglodytes
MLENYSHLVSMGYPVSKPDVISKLEQGEEPWIIKGDISNWIYPDEYQADGRQDRKSNLHNSQSCILGTVSFHHKILKGVTR

SEQ ID NO: 4151 - protein, 81 aa, Pan troglodytes
MLPIVQLYPQGLVSFKDVAVDFTQEEWQQLDPSQRTLYRDVMLENYSHLVSMGYPVSKPDVISKLEQGEEPWIIKGDISNW

SEQ ID NO: 4152 - protein, 81 aa, Pan troglodytes
MAAGQREARPQVSLTFEDVAVLFTRDEWRKLAPSQRNLYRDVMLENYRNLVSLGLPFTKPKVISLLQQGEDPWEVEKDSSG

SEQ ID NO: 4153 - protein, 81 aa, Pan troglodytes
MAVSHLPTMVQESVTFKDVAILFTQEEWGQLSPAQRALYRDVMLENYSNLVSLGLLGPKPDTFSQLEKREAWMPEDTPGGF

SEQ ID NO: 4154 - protein, 81 aa, Pan troglodytes
MARRLLPGHVQESVTFRDVAVFFSQDEWLHLDSAQRALYREVMLENYSILVSLGILFSKPKVISQLEQGEDPWMVESGVPQ

SEQ ID NO: 4155 - protein, 81 aa, Pan troglodytes
GSQGNLPQADITLMSQAQESVTFEDVAVNFTNREWQCLTYAQRHLYKDVMLENYGNMVSLGFPFPKPPLISHLEREVDPCV

SEQ ID NO: 4156 - protein, 81 aa, Pan troglodytes
ADITLMSQAQDSRSILFQESVTFEDVAVNFTNREWQCLTYAQRHLYKDVMLENYGNMVSLGFPFPKPPLISHLEREVDPCV

SEQ ID NO: 4157 - protein, 81 aa, Pan troglodytes
ATLQEAMKRDCWREARVKKKPVTFEDVAVNFTQEEWDCLDASQRVLYQDVMSETFKNLISVARIFLHKPELITKLEQEEEQ

SEQ ID NO: 4158 - protein, 81 aa, Pan troglodytes
EQLKPIEPRDCWREARVKKKPVTFEDVAVNFTQEEWDCLDASQRVLYQDVMSETFKNLISVARIFLHKPELITKLEQEEEQ

SEQ ID NO: 4159 - protein, 81 aa, Pan troglodytes
MAAGEPRSLLFFQKPVTFEDVAVNFTQEEWDCLDASQRVLYQDVMSETFKNLISVARIFLHKPELITKLEQEEEQWRETQV

SEQ ID NO: 4160 - protein, 81 aa, Pan troglodytes
MAERPGSPGSREMRLLTFRDIAIEFSLEEWQCLDCAQQNLYRDVMLENYRNLVSLGIADSKPDLITCLEQNKEAWNIKRNE

SEQ ID NO: 4161 - protein, 81 aa, Pan troglodytes
MRVLTFRDVAVEFSPEEWECLDSAQQHLYRDVMLENYGNLFSLGLAIFKPDLITYLEQRKEPWNARRQKTVAKHPAGSLHF

SEQ ID NO: 4162 - protein, 81 aa, Pan troglodytes
MAKRRGSPGSREMGLLTFRDVVIEFSLEEWQCLDHAQQNLYRDVMLENYRNLVSLGIAVSKPDLITCLEQNKEPWNIKRNE

SEQ ID NO: 4163 - protein, 81 aa, Pan troglodytes
MPGPPGSLEMGPLTFRDVAIEFSLEEWQCLNTAQRNLYRKVMFENYRNLVFLGIAVSKPHLITCLEQGKEPWNRKRQEMVA

SEQ ID NO: 4164 - protein, 81 aa, Pan troglodytes
MRAAAALPSLPGPVSFKDVAVDFTQEEWQQLDPDEKIAYGDVMLENYSHLVSVGYDYHQAKHHHGVEVKEVEQGEEPWIME

SEQ ID NO: 4165 - protein, 81 aa, Pan troglodytes
GEEAVAVVRALQRALDGTSSQGMVTFEDMAVSLTWEEWERLDPARRDFCRESAQKDSGSTVPPSLESRVENKELIPVQQIL

SEQ ID NO: 4166 - protein, 81 aa, Pan troglodytes
SEEHGNKCKQSFHMVTWHMLKPHKSDSGDSFHHSSLFETQRQLHEERPYKCGNCGKSFKQRSDLFRHQRIHTGEKPYGCQE

SEQ ID NO: 4167 - protein, 81 aa, Pan troglodytes
SQELTASLLSTGSQKLVKIEEVADVAVSFILEEWGHLDQSQKSLYRDDRKENYGSITSMGYESRDNMELIVKQISDDSESR

SEQ ID NO: 4168 - protein, 81 aa, Pan troglodytes
REGSPRDQAAALLTARYQEFVTFEDVAVHLTREEWGYLDPVQRDLYREVMLENYGNVVSLGILLRLPTTRIHSVNSCPALS

SEQ ID NO: 4169 - protein, 81 aa, Pan troglodytes
LTGAPPVPQVPALPREGSPRDQAAALLTARYQEFVTFEDVAVHLTREEWGYLDPVQRDLYREVMLENYGNVVSLGTVGSWD

SEQ ID NO: 4170 - protein, 81 aa, Pan troglodytes
QVPALPREGSPRDQAAALLTARYQSSQDVLFQEFVTFEDVAVHLTREEWGYLDPVQRDLYREVMLENYGNVVSLGTVGSWD

SEQ ID NO: 4171 - protein, 81 aa, Pan troglodytes
ETRAFQEQALPVLQAGPGLPAVNPRDQEMAAGFFTAGSQGLGPFKDMALAFPEEEWRHVTPAQIDCFGEYVEPQDCRVSPG

SEQ ID NO: 4172 - protein, 81 aa, Pan troglodytes
MAEPPRLPLTFEDVAIYFSEQEWQDLEAWQKELYKHVMRSNYETLVSLDDGLPKPELISWIEHGGEPFRKWRESQKSGNTI

SEQ ID NO: 4173 - protein, 81 aa, Pan troglodytes
RNFWILRLPPGSKGEAPKVSRSLENDGVCFTEQEWENLEDWQKELYRNVMESNYETLVSLKSCSIAQAGVQWHNLGSLQPL

SEQ ID NO: 4174 - protein, 81 aa, Pan troglodytes
RNFWILRLPPGSKGEAPKVPVTFDDVAVYFSELEWGKLEDWQKELYKHVMRGNYEMLVSLDYAISKPDILTRIERGEEPCL

SEQ ID NO: 4175 - protein, 81 aa, Pan troglodytes
RGDLLRNRNFWILRLPPGSKGESPKFSEQVWGKLEDWQKELCKHMMRGNCEMLVSLDYAISKSVVLSQIEQGKEPCNWCRP

SEQ ID NO: 4176 - protein, 81 aa, Pan troglodytes
MDMAQEPVTFRDVAIYFSREEWACLEPSQRTLYRDVMLDNFSSVAALAPDRTSSLAWNSGRSRGLKTGRDLSSRQCGGDPG

SEQ ID NO: 4177 - protein, 81 aa, Pan troglodytes
MLENYSHLVSVGYCITKPKVISKLEKGEEPWSLEDEFLNQRYPGYFKVDHIKGIQEQQEKPLWQEIFINDADKTLSKEGQK

SEQ ID NO: 4178 - protein, 81 aa, Pan troglodytes
MSVLSLPESVSFKDVTVDFSRDEWQQLDLAQKSLYREVMLENYFNLISVGCQVPKPEVIFSLEQEEPCMLDGEIPSQSRPD

SEQ ID NO: 4179 - protein, 81 aa, Pan troglodytes; identical to SEQ ID NO: 2418

SEQ ID NO: 4180 - protein, 81 aa, Pan troglodytes
MMENYGNLVSLDVLNRDKDEKPTVKQEIEEIEEEVEPQGVIVTRIKSEIDQDPMGRETFELVGRLDKQRGIFLWEIPRESL

SEQ ID NO: 4181 - protein, 81 aa, Pan troglodytes
MASPSPPPESKGLLTFEDVAVFFTQEEWDYLDPAQRSLYKDVMMENYGNLVSLDVLNRDKDEKPTVKQEIEEIEEEVEPQG

SEQ ID NO: 4182 - protein, 81 aa, Pan troglodytes
MASPSPPPESKEWDYLDPAQRSLYKDVMMENYGNLVSLDVLNRDKDEKPTVKQEIEEIEEEVEPQGVIVTRIKSEIDQDPM

SEQ ID NO: 4183 - protein, 81 aa, Pan troglodytes
GKGKRPSQGCPSKIARSKQKETDGKVQKDDDQLENIQKSQNKLLREVAVKKKTQAKKNGSVLPGLGTTSPDCALYFSVEQL

SEQ ID NO: 4184 - protein, 81 aa, Pan troglodytes
QKSQNKLLREVAVKKKTQAKKNGSVLPGLGTTSPDCALYFSVEQLCFLRSLLTYIRWHQEEGPDHWPLTTWSLEPVALEDV

SEQ ID NO: 4185 - protein, 81 aa, Pan troglodytes
MAMSQKSLTFKDVFVDFTLEEWQQLDSAQKNLYRDVMLENYGHLVSVGHLVGKPDVIFRLGPGEESWMADGGTPVRTCAGE

SEQ ID NO: 4186 - protein, 81 aa, Pan troglodytes
MAMSQKSLTFKDVFVDFTLEEWQQLDSAQKNLYRDVMLENYGHLVSVGHLVGKPDVIFRLGPGEESWMADGGTPVRTCAVW

SEQ ID NO: 4187 - protein, 81 aa, Pan troglodytes
MAMSQKSLTFKDVFVDFTLEEWQQLDSAQKNLYRDVMLENYGHLVSVGHLVGKPDVIFRLGPGEESWMADGGTPVRTCAVE

SEQ ID NO: 4188 - protein, 81 aa, Pan troglodytes
NGDDTFAKRPRDGAKTSKKRSKAFDDIATYFSKKEWKKMKYSERISYVYMKRNYKAMTKLGFKVTLPPFMCNKQATDFQGN

SEQ ID NO: 4189 - protein, 81 aa, Pan troglodytes
MNGDDAFARRPRDDAQSEKLRKAFDDIAKYFSKEEWEKMKSSEKIVYYMLNYVMTKLGFKVTLPLLCSKRAADFHDDFNDR

SEQ ID NO: 4190 - protein, 81 aa, Pan troglodytes
KRIKHWKMASKLILPEPLSLLTFEDVAVYFSEEEWQLLNPLEKTLYNDVMQDIYETVISLGLKLKNDTGNDHPISVSTSEI

SEQ ID NO: 4191 - protein, 80 aa, Gorilla gorilla
MIMEDWTCKSQNRVPPSEDPALSQKGYLKKKNMAALCRTAESQNPMQVFQGFTSFKDVAVNFTRKNGENWTLLRESCIGM

SEQ ID NO: 4192 - protein, 81 aa, Gorilla gorilla
FQEKSTEEGEVAALRFTARSQETVTFKDVAMDFTPEEWGKLDPAQRDVMLENYSNLVSLWLPVSKPENYNLENGKEALKLE

SEQ ID NO: 4193 - protein, 81 aa, Gorilla gorilla
PWREERKCPLDLCPESKPEIQLSPSCPLIFSNQQALSQHVWLSHLSQLFSSLWTGNPLQLGKHYPEDRKQQQDPFCLSGKA

SEQ ID NO: 4194 - protein, 81 aa, Gorilla gorilla
MGARPHPNLLGSCCQHPKAFVAFRDVAVDFTQEEWRLLSPAQRTLHREVMLETYNHLVSLEIPSSKPKLIAQLERGEEPWR

SEQ ID NO: 4195 - protein, 81 aa, Gorilla gorilla
MLETYNHLVSLEIPSSKPKLIAQLERGEEPWREERKCPLDLCPESKPEIQLSPSCPLIFSNQQALSQHVWLSHVSQLFSSL

SEQ ID NO: 4196 - protein, 81 aa, Gorilla gorilla
GEEPWREERKCPLDLCPESKPEIQLSPSCPLIFSNQQALSQHVWLSHVSQLFSSLWAGNPLQLGKHYPEDPKQQQDPFCLS

SEQ ID NO: 4197 - protein, 81 aa, Gorilla gorilla
MLETYNHLVSLEIPSSKPKLIAQLERGEEPWREERKCPLDLCPDGALLCRQAGIQWCYIGSLQPLPPGFKQFPCLSLLSSW

SEQ ID NO: 4198 - protein, 81 aa, Gorilla gorilla
KLIAQLERGEEPWREERKCPLDLCPAESKPEIQLSPSCPLIFSNQQALSQHVWLSHVSQLFSSLWAGNPLQLGKHYPEDPK

SEQ ID NO: 4199 - protein, 81 aa, Gorilla gorilla
PWREERKCPLDLCPESKPEIQLSPSCPLIFSNQQALSQHVWLSHVSQLFSSLWAGNPLQLGKHYPEDPKQQQDPFCLSGKA

SEQ ID NO: 4200 - protein, 81 aa, Gorilla gorilla
WREERKCPLDLCPAESKPEIQLSPSCPLIFSNQQALSQHVWLSHVSQLFSSLWAGNPLQLGKHYPEDPKQQQDPFCLSGKA

SEQ ID NO: 4201 - protein, 81 aa, Gorilla gorilla
MLETYNHLVSLEIPSSKPKLIAQLERGEEPWREERKCPLDLCPDVVSLCCLGLSALARSRLTATSTSWVQAVLCLSLPISW

SEQ ID NO: 4202 - protein, 81 aa, Gorilla gorilla
MAVGLCKAMSQGLVTFRDVALDFSQEEWEWLKPSQKDLYRDVMLENYRNLVWLDWESWYEIEELSPKWFIDEDEISQEMVM

SEQ ID NO: 4203 - protein, 81 aa, Gorilla gorilla
MAVGLCKAMSQGLVTFRDVALDFSQEEWEWLKPSQKDLYRDVMLENYRNLVWLGDGCSCRSTLRTTVTAEASSSSSSIQAS

SEQ ID NO: 4204 - protein, 81 aa, Gorilla gorilla
MESVTFEDVAVEFIQEWALLDSARRSLCKYRMLDQCRTLASRGAGAVPEDAAGALHRREGDTMDSRGPASSPGAALVSGMH

SEQ ID NO: 4205 - protein, 81 aa, Gorilla gorilla
ASVSFQDVTVEFTQEEWQHLGPVERTLYRDVMLENYSLLVSVGYCITKPKVICTLEKGEEPWSLEDEFLNQRYPGYFKVDH

SEQ ID NO: 4206 - protein, 81 aa, Gorilla gorilla
MLENYSLLVSVGYCITKPKVICTLEKGEEPWSLEDEFLNQRYPGYFKVDHIKGIRKKQEKPLWQEIFINDADKTLSKEGQK

SEQ ID NO: 4207 - protein, 81 aa, Gorilla gorilla
APLPPRDPNGAGPEWREPGAVSFADVAVYFCREEWGCLRPAQRTLYRDVMRETYGHLSALGIGGKKPALISWVEEEAELWG

SEQ ID NO: 4208 - protein, 81 aa, Gorilla gorilla
APLPPRDPNGAGPEWRKPGAVSFADVAVYFSREEWGCLRPAQRALYRDVMRETYGHLGALGESPTCLPGPCASTGPAAPLG

SEQ ID NO: 4209 - protein, 81 aa, Gorilla gorilla
APLPPRDPNGAGPEWRKPGAVSFADVAVYFSREEWGCLRPAQRALYRDVMRETYGHLGALGVGGSKPALISWVEEKAELWD

SEQ ID NO: 4210 - protein, 81 aa, Gorilla gorilla
MAEEFVTLKDVGMDFTLGDWEQLGLEQGDTFWDTALDNCQDLFLLDPPRPNLTSHPDGGEDLEPLAGGSPEAPGPDVTETK

SEQ ID NO: 4211 - protein, 81 aa, Gorilla gorilla
MDFTLGDWEQLGLEQGDTFWDTALDNCQDLFLLDPPRPNLTSHPDGGEDLEPLAGGSPEAPGPDVTETKNSPLMEDFFEEG

SEQ ID NO: 4212 - protein, 81 aa, Gorilla gorilla
CFSQEERMAAGYLPRWSQELVTFEDVSVDFSQEEWELLEPAQKNLYREVMLENYRNVVSLEALKNQCTDVGIKEGPLSPAQ

SEQ ID NO: 4213 - protein, 81 aa, Gorilla gorilla
MLETFRNLASVDDETQFKASGSVSQQDIYGEKIPKESKIAAFTRNVSWASVLGKIWDSLSIEDQTTNQGRNLSRNHVLERL

SEQ ID NO: 4214 - protein, 81 aa, Gorilla gorilla
EKIPKESKIAAFTRNVSWASVLGKIWDSLSIEDQTTNQGRNLSRNHVLERLCESNDQCGEALSQIPHLNLYKKIPPGVKQY

SEQ ID NO: 4215 - protein, 81 aa, Gorilla gorilla
MDSVVFEDVAVDFTLEEWALLDSAQRDLYRDVMLETFRNLASVDDETQFKASGSVSQQDIYGEKIPKESKIAAFTRNVSWA

SEQ ID NO: 4216 - protein, 81 aa, Gorilla gorilla
MDTVVFEDVVVDFTLEEWPLLNPAQRKLYRDVMLETFKHLASVDNEAQLKASGSISQQATSGEKLSLKQKIEKFTRKNIWA

SEQ ID NO: 4217 - protein, 81 aa, Gorilla gorilla; identical to SEQ ID NO: 2419

SEQ ID NO: 4218 - protein, 81 aa, Gorilla gorilla
GHTQGGELVNELLTSWLRGLVTFEDVAVEFTQEEWALLDPAQRTLYRDVMLENCRNLASLGCRVNKPSLISQLEQDKKVMT

SEQ ID NO: 4219 - protein, 81 aa, Gorilla gorilla
MGSIKEKMKAGSGTGKPQEPVTFKDVVVEFSKEEWGQLDSAVKNLYRNVMLENFRNLNSLRKAHLLSKPFESLKLESKKKR

SEQ ID NO: 4220 - protein, 81 aa, Gorilla gorilla
MAVTFEDVTIIFTWEEWKFLNSSQKRLYREVMWENYTNVMSVENWNESYKSQEEKFRYLEYENFSCWQGWWNAGAQMYENQ

SEQ ID NO: 4221 - protein, 81 aa, Gorilla gorilla
SRKNLSMEKEQKLIVQHSYIPVEEALPQYVGVIGQKDLLRDSMEEKYCGCNKCKEIYYWNSRCVFHKRNQPGENLYRCSIR

SEQ ID NO: 4222 - protein, 81 aa, Gorilla gorilla
MAATLLMAGSQAPVTFEDMAMYLTREEWRPLDAAQRDLYRDVMQENYGNVVSLDFEIRSENEVNPKQEISEDVQFGTTSER

SEQ ID NO: 4223 - protein, 81 aa, Gorilla gorilla
EEPWMAEKEGPGDPSSDLKSKIETIESTAKSAISQERLYHGIMMESFMRDDIIYSTLRKVSTYDDVLERHQETCVRDVRQA

SEQ ID NO: 4224 - protein, 81 aa, Gorilla gorilla
MISFQESVTFQDVAVDFTAEEWQLLDCAERTLYWDVMLENYRNLISVGCPITKTKVILKVEQGQEPWMVEGVNPHESSPES

SEQ ID NO: 4225 - protein, 81 aa, Gorilla gorilla
MISFQESVTFQDVAVDFTAEEWQLLDCAERTLYWDVMLENYRNLISVGCPITKTKVILKVEQGQEPWMVEGVNPHESSPGW

SEQ ID NO: 4226 - protein, 81 aa, Gorilla gorilla
FQFASDAHFSLKINVLLQESVTFQDVAVDFTAEEWQLLDCAERTLYWDVMLENYRNLISVGCPITKTKVILKVEQGQEPWM

SEQ ID NO: 4227 - protein, 81 aa, Gorilla gorilla
EDGPANMQKVRICSEGGWVPALFDEVAIYFSDEEWEVLTEQQKALYREVMRMNYETVLSLEFPFPKPDMITRLEGEEESQN

SEQ ID NO: 4228 - protein, 81 aa, Gorilla gorilla
MGLLAFRDVALEFSPEEWECLDPAQQSLYRDVMLENYRNLISLGLAMSKPELIICLEARKEPWNMNTEKTAKHSASSSYLT

SEQ ID NO: 4229 - protein, 81 aa, Gorilla gorilla
EARKEPWNMNTEKTAKHSASSSYLTEDILPEQGLQVSFQKVMLRRYERCCLEKLRLRNDWEIVVETGFHRVSQDGLDLLTS

SEQ ID NO: 4230 - protein, 81 aa, Gorilla gorilla
MGLLAFRDVALEFSPEEWECLDPAQQSLYRDVMLENYRNLISLGLAMSKPELIICLEARKEPWNMNTEKTAKHSVETRFRH

SEQ ID NO: 4231 - protein, 81 aa, Gorilla gorilla
ISLGLAMSKPELIICLEARKEPWNMNTEKTAKHSASSSYLTEDILPEQGLQVSFQKVMLRRYERCCLEKLRLRNDWEIVAM

SEQ ID NO: 4232 - protein, 81 aa, Gorilla gorilla
MGLLAFRDVALEFSPEEWECLDPAQQSLYRDVMLENYRNLISLGEDNFNMQFLFHSLAMSKPELIICLEARKEPWNMNTEK

SEQ ID NO: 4233 - protein, 81 aa, Gorilla gorilla
LFHSLAMSKPELIICLEARKEPWNMNTEKTAKHSASSSYLTEDILPEQGLQVSFQKVMLRRYERCCLEKLRLRNDWEIVAM

SEQ ID NO: 4234 - protein, 81 aa, Gorilla gorilla
RKEPWNMNTEKTAKHSASSSYLTEDILPEQGLQVSFQKVMLRRYERCCLEKLRLRNDWEIPCEDVLASPLPSAMIVSFLRP

SEQ ID NO: 4235 - protein, 81 aa, Gorilla gorilla
MDSVSFEDVAVAFTQEEWALLDPSQKNLYRDVMQEIFRNLASVGNKSEDQNILDDFKNPGRNLSSHVVERLFEIKEGSQYG

SEQ ID NO: 4236 - protein, 81 aa, Gorilla gorilla
MDSVAFEDVAVNFTQEEWALLDSSQKNLYREVMQETCSNLASVGSKWKDQNIEDHFEKPGKDIRNHMVQRLCESKEGGQCG

SEQ ID NO: 4237 - protein, 81 aa, Gorilla gorilla
RHFRRPEPCREPRASPTQDSVAFEDVAVNFTQEEWALLDSSQKNLYREVMQETCSNLASVGSKWKDQNIEDHFEKPGKDIR

SEQ ID NO: 4238 - protein, 81 aa, Gorilla gorilla
AEPLHPVCTCGRHFRRPEPCREPRASPTQDSVAFEDVAVNFTQEEWALLDSSQKNLYREVMQETCSNLASVEIIWYRDCVK

SEQ ID NO: 4239 - protein, 81 aa, Gorilla gorilla
NSFPQVILLPNPPKVLRLQGLLAFSDVVIEFSPEEWACLDPAQRNLYRDVMFENYRNLVSLAILCYSIQDLLPEQDMKDLC

SEQ ID NO: 4240 - protein, 81 aa, Gorilla gorilla
AQRNLYRDVMFENYRNLVSLAILCYSIQDLLPEQDMKDLCQKVTLTRHRSWGLDNLHLVKDWRTVNEGKGQKEYCNRLTQC

SEQ ID NO: 4241 - protein, 81 aa, Gorilla gorilla
MGLLAFSDVVIEFSPEEWACLDPAQRNLYRDVMFENYRNLVSLAILCYSIQDLLPEQDMKDLCQKVTLTRHRSWGLDNLHL

SEQ ID NO: 4242 - protein, 81 aa, Gorilla gorilla
QRNLYRDVMFENYRNLVSLAILCYSIQDLLPEQDMKDLCQKVTLTRHRSWGLDNLHLVKDWRTVNEGKGQKEYCNRLTQCS

SEQ ID NO: 4243 - protein, 81 aa, Gorilla gorilla
MAPRAQIQGPLTFGDVAVAFTRIEWRHLDAAQRALYRDVMLENYGNLVSVGLLSSKPKLITQLEQGAEPWTEMREAPSGTH

SEQ ID NO: 4244 - protein, 81 aa, Gorilla gorilla
RDVMLENYGNLVSVGLLSSKPKLITQLEQGAEPWTEMREAPSGTHAAQDCWLETKMSALKQSTSEGSVLGERTKSVMMEKG

SEQ ID NO: 4245 - protein, 81 aa, Gorilla gorilla
VMLENYSLLLSVGYCITKPEVVCKLEHGEVLWILEEESPSQSHLDCCIDDDLMEKRQENQDQHLQKVDSVNNKTLTMDRND

SEQ ID NO: 4246 - protein, 81 aa, Gorilla gorilla
MNKVDQKFQGSVSFKDVTVGFTQEEWQHLDPSQRALYRDVMLENYSNLVSVGYCAHKPEVIFRLQQGEEPWKLEEEFPSQS

SEQ ID NO: 4247 - protein, 81 aa, Gorilla gorilla
MANATRRESEVDQKFQGSVSFKDVTVGFTQEEWQHLDPSQRALYRDVMLENYSNLVSVGYCAHKPEVIFRLQQGEEPWKLE

SEQ ID NO: 4248 - protein, 81 aa, Gorilla gorilla
MSAVDQKFQGSVSFKDVTVGFTQEEWQHLDPSQRALYRDVMLENYSNLVSVGYCAHKPEVIFRLQQGEEPWKLEEEFPSQS

SEQ ID NO: 4249 - protein, 81 aa, Gorilla gorilla
HLDPSQRALYRDVMLENYSNLVSVGYCAHKPEVIFRLQQGEEPWKLEEEFPSQSFPEVWTADHLKERSQENQSKHLWEVVF

SEQ ID NO: 4250 - protein, 81 aa, Gorilla gorilla
MNKVEQKSQGSVSFKDVTVGFTQEEWQHLDPSQRALYRDVMLENYSNLVSVGYCVHKPEVIFRLQQGEEPWKLEEEFPSQS

SEQ ID NO: 4251 - protein, 81 aa, Gorilla gorilla
SNWMSSPLYSTEVEQKSQGSVSFKDVTVGFTQEEWQHLDPSQRALYRDVMLENYSNLVSVGYCVHKPEVIFRLQQGEEPWK

SEQ ID NO: 4252 - protein, 81 aa, Gorilla gorilla
SPSFQEHNKMNKVEQKSQGSVSFKDVTVGFTQEEWQHLDPSQRALYRDVMLENYSNLVSVGYCVHKPEVIFRLQQGEEPWK

SEQ ID NO: 4253 - protein, 81 aa, Gorilla gorilla
MNKFRGPVTLKDVIVEFTKEEWKLLTPAQRTLYKDVMLENYSHLVSVGYHVNKPNAVFKLKQGKEPWILEVEFPHRGFPED

SEQ ID NO: 4254 - protein, 81 aa, Gorilla gorilla
SNLVSVGYCITKPEVIFKIEQGEEPWILEKGFPSQCHPERKWKVDDVLESSQENEDDHFWELLFHNNKTLRFQLLGRKQFL

SEQ ID NO: 4255 - protein, 81 aa, Gorilla gorilla
MTLLTFRDVAIEFSLEEWKCLDLAQQNLYRDVMLENYRNLFSVGLTVSKPGLITCLEQRKEPWNVKRQEAADGHPAMSSCF

SEQ ID NO: 4256 - protein, 81 aa, Gorilla gorilla
SCFTQDLLPEQGIQDAFPKTILRGYGNCGLDNLYLRKDWESLDECKLQKDYNGLNQCSSTTHSKIFQYNKYVKIFDNFSNL

SEQ ID NO: 4257 - protein, 81 aa, Gorilla gorilla
SSCFTQDLLPEQGIQDAFPKTILRGYGNCGLDNLYLRKDWESLDECKLQKDYNGLNQCSSTTHSKIFQYNKYVKIFDNFSN

SEQ ID NO: 4258 - protein, 81 aa, Gorilla gorilla
VSVDKFTAMSSCFTQDLLPEQGIQDAFPKTILRGYGNCGLDNLYLRKDWESLDECKLQKDYNGLNQCSSTTHSKIFQYNKY

SEQ ID NO: 4259 - protein, 81 aa, Gorilla gorilla
VSKPGLITCLEQRKEPWNVKRQEAADGHPAMSSCFTQDLLPEQGIQDAFPKTILRGYGNCGLDNLYLRKDWESLDECKLQK

SEQ ID NO: 4260 - protein, 81 aa, Gorilla gorilla
PGLITCLEQRKEPWNVKRQEAADGHPEFHSITQAVVQWRHLSSLQPLPPGLEPSSHFSLLRTWNYRGTPAHPANFCVFNRD

SEQ ID NO: 4261 - protein, 81 aa, Gorilla gorilla
MHSLKKVTFEDVAIDFTQEEWAMMDTSKRKLYRDVMLENISHLVSLGYQISKSYIILQLEQGKELWQEGREFLQDQNPDRE

SEQ ID NO: 4262 - protein, 81 aa, Gorilla gorilla
INAEEERMIAVFLTTWLQEPMTFKDVAVEFTQEEWMMLDSAQRSLYRDVMLENYRNLTSVEYQLYRLTVISPLDQEEIRNM

SEQ ID NO: 4263 - protein, 81 aa, Gorilla gorilla
MLWSQPCLLLTLSYFQGLLSFKDISMEFTWDEWQLLDSTQKYLYRDVILENYHNLISVGYHGTKPDLIFKLEQGEDPWIIN

SEQ ID NO: 4264 - protein, 81 aa, Gorilla gorilla
MIQSQISFEDVAVDFTVEEWQLLNPTQKNLYRDVMLENYSNLVFLEVWLDNPKMWLRDNQDNLKSMERGHKYDVFGKIFNS

SEQ ID NO: 4265 - protein, 81 aa, Gorilla gorilla
MIQSQISFEDVAVDFTVEEWQLLNPTQKNLYRDVMLENYSNLVFLGFQILKPDAIFKLEQQDPWIIDQEILNQNFSEVWLD

SEQ ID NO: 4266 - protein, 81 aa, Gorilla gorilla
MKPRTLAISFEDVAVDFTVEEWQLLNPTQKNLYRDVMLENYSNLVFLEVWLDNPKMWLRDNQDNLKSMERGHKYDVFGKIF

SEQ ID NO: 4267 - protein, 81 aa, Gorilla gorilla
MKPRTLAISFEDVAVDFTVEEWQLLNPTQKNLYRDVMLENYSNLVFLGFQILKPDAIFKLEQQDPWIIDQEILNQNFSEVW

SEQ ID NO: 4268 - protein, 81 aa, Gorilla gorilla
EGRTRDRQMAAALLTAWSQMPVTFEDVALYLSREEWGRLDHTQQNFYRDVLQKKNGLSLGFPFSRPFWAPQAHGKGEASGS

SEQ ID NO: 4269 - protein, 81 aa, Gorilla gorilla
EGRTRDRQMAAALLTAWSQMPVTFEDVALYLSREEWGRLDHTQQNFYRDVLQKKNGLSLGAVEVGQRVQTSSVAALGNVKP

SEQ ID NO: 4270 - protein, 81 aa, Gorilla gorilla
LKEGRTGETTDTCFVSGVHGPVALGDIPFYFSREEWGTLDPAQRDLFWDIKRENSRNTTLGFRLKGQSEKSLLQEVVPVVP

SEQ ID NO: 4271 - protein, 81 aa, Gorilla gorilla
SRNTTLGFRLKGQSEKSLLQEVVPVVPGQTSSDVTVSWSPEEADAWESENRPRAALGPVVGARRGRPPTRRRQFRDLAAEK

SEQ ID NO: 4272 - protein, 81 aa, Gorilla gorilla
RPLVKLLPKGVQKEQETVCLYLKANPELVVFEDLNVFHCQEECVSLDPTQQLTSEKEDDSSVGEMMLLAVNGSNPEGEDPE

SEQ ID NO: 4273 - protein, 81 aa, Gorilla gorilla
PLVKLLPKGVQKEQETVCLYLKANPEELVVFEDLNVFHCQEECVSLDPTQQLTSEKEDDSSVGEMMLLAVNGSNPEGEDPE

SEQ ID NO: 4274 - protein, 81 aa, Gorilla gorilla
PLVKLLPKGVQKEQETVCLYLKANPEELVVFEDLNVFHCQEECVSLDPTQQLTSEKEDDSSVGEMMLLVNGSNPEGEDPER

SEQ ID NO: 4275 - protein, 81 aa, Gorilla gorilla
LFPPEGNVEDKEMTGPQLPESLEDVAMYISQEEWGRQDPSKRALSRDTVQESYENVDSLESHIPSQEVPGTQVGQGGKLWD

SEQ ID NO: 4276 - protein, 81 aa, Gorilla gorilla
MYFSQEEWELLDPTQKALYNDVMQENYETVISLALFVLPKPKVISCLEQGEEPWVQVSPEFKDSAGKSPTGLKLKNNTENR

SEQ ID NO: 4277 - protein, 81 aa, Gorilla gorilla
AVPTQQILAFPEQTNTKDWTVTPEHVLPESQSLLTFEEVAMYFSQEEWELLDPTQKALYNDVMQENYETVISLGQCSPFLP

SEQ ID NO: 4278 - protein, 81 aa, Gorilla gorilla
TCDNRAVSLCQQEWMCPGPAQRTLYRGATQRKDRHVSLATGVPWGYEETKTLLAILSSSQFYGKLQTCQQNSQIYRAMAEG

SEQ ID NO: 4279 - protein, 81 aa, Gorilla gorilla
QNTGLHDQETGAVVWTAGSQGPATCDNRAVSLCQQEWMCPGPAQRTLYRGATQRKDRHVSLATGVPWGYEETKTLLAILSS

SEQ ID NO: 4280 - protein, 81 aa, Gorilla gorilla
MASMPPTPEAQGPILFEDLAVYFSQEECVTLHPAQRSLSKDGTKESLEDAALMGEEGKPEINQQLNLESMELDELALEKYP

SEQ ID NO: 4281 - protein, 81 aa, Gorilla gorilla
WPERGPPAPRHQEMTSASPFLSAWSQVPVNLADVAVYLSGEEPRCLDPAQRDAPLENEGPGIQLEDGGDGREDAPVRMEWY

SEQ ID NO: 4282 - protein, 81 aa, Gorilla gorilla
WPERGPPAPRHQEMTSASPFLSAWSQVPVNLADVAVYLSGEEPRCLDPAQRDAPLENEGPGIQLEDGGDGREDAPVRMERE

SEQ ID NO: 4283 - protein, 81 aa, Gorilla gorilla
EPGSLHSGHQEQLNRKRERRPLPKNARPSAWVPALADEWNTLDQEVTTTRLPAGSQEPVKDVHVARGFSYRKNVHQIPAQR

SEQ ID NO: 4284 - protein, 81 aa, Gorilla gorilla
NTLDQEVTTTRLPAGSQEPVKDVHVARGFSYRKNVHQIPAQRDLYRDFRKENVGNVVSLGSAVSTSNKITRLEQRKEPWTL

SEQ ID NO: 4285 - protein, 81 aa, Gorilla gorilla
MGLLTFRDVAIEFSREEWEHLDSDQKLLYGDVMLENYGNLVSLGLAVSKPDLITFLEQRKEPWNVKSAETVAIQPEVKANT

SEQ ID NO: 4286 - protein, 81 aa, Gorilla gorilla
MGLLTFRDVAIEFSREEWEHLDSDQKLLYGDVMLENYGNLVSLGLAVSKPDLITFLEQRKEPWNVKSAETVAIQPVARFFV

SEQ ID NO: 4287 - protein, 81 aa, Gorilla gorilla
PDLITFLEQRKEPWNVKSAETVAIQPDIFSHDTQGLLRKKLIEASFQKVILDGYGSCGRQNLNLRKEWESEEKNQYNKSDT

SEQ ID NO: 4288 - protein, 81 aa, Gorilla gorilla
SVTFKDVSVDFTQEEWYHVDPAQRSLYRDVMLENYSHLVSLGYQVSKPEVIFKLEQGEEPWISEGEIQRPFYPAVYFNRKE

SEQ ID NO: 4289 - protein, 81 aa, Gorilla gorilla
MLENYGNVASLGFPLLKPAVISQLEGGGELGGPSPLAAGTGLQGLQTDIQTDNDLTKEMYEGKENVSFELQRDFSQETDFS

SEQ ID NO: 4290 - protein, 81 aa, Gorilla gorilla
MAAMHLTAWPQKSVTFEDVAVYFTQAEWDGLSPAQRALYRDVMLENYGNVASLGFPLLKPAVISQLEGGGELGGPSPLAAG

SEQ ID NO: 4291 - protein, 81 aa, Gorilla gorilla
MLENYGNVASLGFPLLKPAVISQLEGGGELGGPSPLAAGTGLQGLQTDGVSLCRPNWSAVARTWLTATSVSRVAILLPHPP

SEQ ID NO: 4292 - protein, 81 aa, Gorilla gorilla
MHLTAWPQKSVTFEDVAVYFTQAEWDGLSPAQRALYRDVMLENYGNVASLGFPLLKPAVISQLEGGGELGGPSPLAAGTGL

SEQ ID NO: 4293 - protein, 81 aa, Gorilla gorilla
MLENYGNVASLGFPLLKPAVISQLEGGVDIQTDNDLTKEMYEGKENVSFELQRDFSQETDFSEASLLEKQQEVHSAGNIKK

SEQ ID NO: 4294 - protein, 81 aa, Gorilla gorilla
SQLEGGVDIQTDNDLTKEMYEGKENVSFELQRDFSQETDFSEASLLEKQQEVHSAGNIKKEKSNTIDGTVKDETSPVEECF

SEQ ID NO: 4295 - protein, 81 aa, Gorilla gorilla
MAAMPLKARYQEMVTFEDVAVHFTKTEWTGLSPAQRALYRSVMLENFGNLTALGYPVPKPALISLLEGGDMAWGLEAQDDP

SEQ ID NO: 4296 - protein, 81 aa, Gorilla gorilla
MPLKARYQEMVTFEDVAVHFTKTEWTGLSPAQRALYRSVMLENFGNLTALGYPVPKPALISLLEGGDMAWGLEAQDDPPAE

SEQ ID NO: 4297 - protein, 81 aa, Gorilla gorilla
EQTQAAGMVAGCLINCYQDSVTFDDVAVDFTQEEWTLLDPSQRDLYRDVMLENYENLASVGHHLFKPSVIYWLEEEEELRA

SEQ ID NO: 4298 - protein, 81 aa, Gorilla gorilla
MAAPDLAHGGHVSRDSVCLHEEQTQAAGMVAGCLINCYQDSVTFDDVAVDFTQEEWTLLDPSQRDLYRDVMLENYENLASV

SEQ ID NO: 4299 - protein, 81 aa, Gorilla gorilla
EQTQAAGMVAGCLINCYQDSVTFDDVAVDFTQEEWTLLDPSQRDLYRDVMLENYENLASVEWRLKTKGPALRQDRSWFRTS

SEQ ID NO: 4300 - protein, 81 aa, Gorilla gorilla
MLENYENLASVGHHLFKPSVIYWLEEEEELRAGRRGVLQEWRLKTKGPALRQDRSWFRTSNETQTARSHNGGQLCDHTQCG

SEQ ID NO: 4301 - protein, 81 aa, Gorilla gorilla
SQEESPEGDTERTERKPMVKDAFKDISIYFTKEEWAEMGDWEKTRYRNVKRNYNALITIGLRATRPVFMCHRRQAIKLQVD

SEQ ID NO: 4302 - protein, 81 aa, Gorilla gorilla
VKRNYNALITIGLRATRPVFMCHRRQAIKLQVDDTEDSDEEWTPRQQVKPPWMAFRGEQSKHQKIVRCVRTSSLTAVLLMG

SEQ ID NO: 4303 - protein, 81 aa, Gorilla gorilla
LQGKYGNVTKEVIVLYLTLCKQCHQKNPVPKRGLAPKPMTFKDIDSTCQVEILDMQSSADGEFKFILYYQDHSTKFIILRP

SEQ ID NO: 4304 - protein, 81 aa, Gorilla gorilla
FSPGPKTVWSLWQQPVLFQEATAFENMTKDWNYLEGSQKDCYRDTMLDSYENTVPQGSFLQFSMMPQRAGNDPPGVSNASE

SEQ ID NO: 4305 - protein, 81 aa, Gorilla gorilla
ASQPARLEERLIRDQDLGASLLPAAPQEQWRHLDSTQKEQYWDLMLETYGKMVSGGARQENDKENLNLENHRDQELLHASC

SEQ ID NO: 4306 - protein, 81 aa, Gorilla gorilla
AASQPARLEERLIRDQDLGASLLPAAPQWRHLDSTQKEQYWDLMLETYGKMVSGGISHPKSDLTNSIEFGEELAGLYLHVS

SEQ ID NO: 4307 - protein, 81 aa, Gorilla gorilla
MELLTFRDVAIEFSPEEWKCLDPAQQNLYRDVMLENYRNLVSLAVYSYYNQGILPEQGIEDLFKKATLGRYGSCGLENICL

SEQ ID NO: 4308 - protein, 80 aa, Gorilla gorilla
MELLTFRDVAIEFSPEEWKCLDPAQQNLYRDVMLENYRNLVSLELHAERHQRTDGYFISLGEGQVYHAVMAIPASIRVWV

SEQ ID NO: 4309 - protein, 81 aa, Gorilla gorilla
GHTEGGELVNELLRSWLKGLVTFEDVAVEFTQEEWALLDPAQRTLYRDVMLENCRNLASLGNQVDKPSLISQLEQEDKVMT

SEQ ID NO: 4310 - protein, 81 aa, Gorilla gorilla
DLFACSGLEPHTPSVGSQESVTFQDVAVDFTEKEWPLLDSSQRKLYKDVMLENYSNLTSLGYQVGKPSLISHLEQEEEPRT

SEQ ID NO: 4311 - protein, 81 aa, Gorilla gorilla
DLFACSGLEPHTPSVGSQESVTFQDVAVDFTEKEWPLLDSSQRKLYKDVMLENYSNLTSLDWETPSKTKWSLLMEDIFGKE

SEQ ID NO: 4312 - protein, 81 aa, Gorilla gorilla
SSKDRSCPQNLDLFACSGLEPHTPSVGSQESVTFQDVAVDFTEKEWPLLDSSQRKLYKDVMLENYSNLTSLEILAPPFCCS

SEQ ID NO: 4313 - protein, 81 aa, Gorilla gorilla
QEKTVERVVADCLTNCYQDSVTFDDLAVDFTPEEWTLLDPTQRNLYRDVMLENYKNLATVGYQLFKPSLISWLEQEESRTV

SEQ ID NO: 4314 - protein, 81 aa, Gorilla gorilla
SRTESLVEFPEGVEPVVLDSVTFDDLAVDFTPEEWTLLDPTQRNLYRDVMLENYKNLATVGYQLFKPSLISWLEQEESRTV

SEQ ID NO: 4315 - protein, 81 aa, Gorilla gorilla
MAYCLTSCYQDSVTFEDTAVDFTQEEWTLLDPVQRNLYRDVMLENYENVAKVGFQLLKPSVISWLEEEVLRTLQQGVLQDW

SEQ ID NO: 4316 - protein, 81 aa, Gorilla gorilla
EKTPAGRIVADCLTNCYQDSVTFDDVAVDFTQEEWTLLDSTQRSLYSDVMLENYKNLATVGGQIIKPSLISWLEQEESRTV

SEQ ID NO: 4317 - protein, 81 aa, Gorilla gorilla
MDSVTFDDVAVDFTQEEWTLLDSTQRSLYSDVMLENYKNLATVGGQIIKPSLISWLEQEESRTVQGGVLRGWEMRLETQWS

SEQ ID NO: 4318 - protein, 81 aa, Gorilla gorilla
EKTKVERMVEDYLANGYQDSVTFDDVAVDFTPEEWALLDTTEKYLYRDVMLENYMNLASVEWEIQPRTKRSSLQQGFLKNQ

SEQ ID NO: 4319 - protein, 81 aa, Gorilla gorilla
FFSREPICPFEEKTKVERMVEDYLANGYQDSVTFDDVAVDFTPEEWALLDTTEKYLYRDVMLENYMNLASVDKRLQWMETL

SEQ ID NO: 4320 - protein, 81 aa, Gorilla gorilla
MDSVTFDDVAVEFTPEEWALLDTTQKYLYRDVMLENYMNLASVDFFFCLTSEWEIQPRTKRSSLQQGFLKNQIFTGIQMQT

SEQ ID NO: 4321 - protein, 81 aa, Gorilla gorilla
MDSSQHLVTFEDVAVDFTQEEWTLLDQAQRDLYRDVMLENYKNLIILAGSELCKLSLMSGLEQMEELRTGVTGVLQGEKQY

SEQ ID NO: 4322 - protein, 81 aa, Gorilla gorilla
MDSSQHLVTFEDVAVDFTQEEWTLLDQAQRDLYRDVMLENYKNLIILAGSELCKLSLMSGLEQMEELRTGVTGVLQELDLQ

SEQ ID NO: 4323 - protein, 81 aa, Gorilla gorilla
MDSSQHLVTFEDVAVDFTQEEWTLLDQAQRDLYRDVMLENYKNLIILGSELCKLSLMSGLEQMEELRTGVTGVLQELDLQL

SEQ ID NO: 4324 - protein, 81 aa, Gorilla gorilla
MDSVAFEDVAVNFTQEEWALLGPSQKSLYRNVMQETIRNLDCVEMKWEDQNIGDQCQNAKRNLRSHTCEIKDDSQCGETFG

SEQ ID NO: 4325 - protein, 81 aa, Gorilla gorilla
MDSVAFEDVAINFTCEEWALLGPSQKSLYRDVMQETIRNLDCIGMIWQNQDIEEDEYKDLRRNLRCHMVERSCEIKDDSQC

SEQ ID NO: 4326 - protein, 81 aa, Gorilla gorilla
MDPVAFKDVAVNFTQEEWALLDISQRKLYREVMLETFRNLTSIGKSWKDQNIEYEYQNPRRNFRSLIEEKVNEIKDDSHCG

SEQ ID NO: 4327 - protein, 81 aa, Gorilla gorilla
MMFQDPVAFKDVAVNFTQEEWALLDISQRKLYREVMLETFRNLTSIGKSWKDQNIEYEYQNPRRNFRSLIEEKVNEIKDDS

SEQ ID NO: 4328 - protein, 81 aa, Gorilla gorilla
MFQDPVAFKDVAVNFTQEEWALLDISQRKLYREVMLETFRNLTSIGKSWKDQNIEYEYQNPRRNFRSLIEEKVNEIKDDSH

SEQ ID NO: 4329 - protein, 81 aa, Gorilla gorilla
MFQDPVAFKDVAVNFTQEEWALLDISQKNLYREVMLETFWNLTSIGKKWKDQNIEYEYQNPRRNFRSVIEEKVNEIKQDSH

SEQ ID NO: 4330 - protein, 81 aa, Gorilla gorilla
MPCCSHRRCREDPGTSESQEMEEWALLDISQRKLYREVMLETFRNLTSIGKSWKDQNIEYEYQNPRRNFRSLIEEKVNEIK

SEQ ID NO: 4331 - protein, 81 aa, Gorilla gorilla
RSCREDPGTSESREMMFQDPVAFEDVAVNFTQEEWTLLDISQKNLFREVMLETFRNLTSIGKKWNDQNIEYEYQDPRRSFR

SEQ ID NO: 4332 - protein, 81 aa, Gorilla gorilla
CSHRSCREDPGTSESREMDPVAFEDVAVNFTQEEWTLLDISQKNLFREVMLETFRNLTSIGKKWNDQNIEYEYQDPRRSFR

SEQ ID NO: 4333 - protein, 81 aa, Gorilla gorilla
PNYFPEMSTSNTILGMFQDPVAFEDVAVNFTQEEWTLLDISQKNLFREVMLETFRNLTSIGKKWNDQNIEYEYQDPRRSFR

SEQ ID NO: 4334 - protein, 81 aa, Gorilla gorilla
SSNPNYFPEMSTSNTILGDPVAFEDVAVNFTQEEWTLLDISQKNLFREVMLETFRNLTSIGKKWNDQNIEYEYQDPRRSFR

SEQ ID NO: 4335 - protein, 81 aa, Gorilla gorilla
MFQDPVAFEDVAVNFTQEEWTLLDISQKNLFREVMLETFRNLTSIGKKWNDQNIEYEYQDPRRSFRSLIEEKVNEIKEDSH

SEQ ID NO: 4336 - protein, 81 aa, Gorilla gorilla
CSHRSCREDPGTSESREMDPVAFEDVAVNFTQEEWALLDISQRKLYREVMLETFRNLTSEGKKWKDQNIEYEYQNPRRNFR

SEQ ID NO: 4337 - protein, 81 aa, Gorilla gorilla
MPCCSHRSCREDPGTSESREMRPESSDCKLRPMRNLQREVIESSHQAQWLTPVIPALWEAKADGASQMFQDPVAFEDVAVN

SEQ ID NO: 4338 - protein, 81 aa, Gorilla gorilla
NLQREVIESSHQAQWLTPVIPALWEAKADGASQMFQDPVAFEDVAVNFTQEEWALLDISQRKLYREVMLETFRNLTSEGVS

SEQ ID NO: 4339 - protein, 81 aa, Gorilla gorilla
MDPVAFEDVAVNFTQEEWALLDISQRKLYREVMLETFRNLTSEGKKWKDQNIEYEYQNPRRNFRSLIEEKVNEIKEDSHCG

SEQ ID NO: 4340 - protein, 81 aa, Gorilla gorilla
PPVLSLSPILLYACEMFQDPVAFEDVAVNFTQEEWALLDISQRKLYREVMLETFRNLTSEGKKWKDQNIEYEYQNPRRNFR

SEQ ID NO: 4341 - protein, 81 aa, Gorilla gorilla
MMFQDSVAFKDVAVTFTQEEWALLDPSQKNLYRDVMQETFRNLASIGKKWKHQNIYVEYENLRRNLRIVGERLFESKEGHQ

SEQ ID NO: 4342 - protein, 81 aa, Gorilla gorilla
MDSVAFKDVAVTFTQEEWALLDPSQKNLYRDVMQETFRNLASIGKKWKHQNIYVEYENLRRNLRIVGERLFESKEGHQHGE

SEQ ID NO: 4343 - protein, 81 aa, Gorilla gorilla
MLVLSILLYTCEMFQDSVAFKDVAVTFTQEEWALLDPSQKNLYRDVMQETFRNLASIGKKWKHQNIYVEYENLRRNLRIVG

SEQ ID NO: 4344 - protein, 81 aa, Gorilla gorilla
MDSVAFEDVAVNPQEEWSLLDPSQKNLYREVMQETLRNLASIGEKLKDQNIEDQYKNPRNNLRSLLGKRVDENTEENHCGE

SEQ ID NO: 4345 - protein, 81 aa, Gorilla gorilla
MDSVAFEDVAVSFTQEEWALLDPSQKNLYRDVMQETFKNLTSVGKTWKVQNIEDEYKNPRRNLRRSFTLVAQAGVQRRDLG

SEQ ID NO: 4346 - protein, 81 aa, Gorilla gorilla
MDSVVFEDVDVNFTQEEWALLDPSQKNLYRDVMQETFRNLASVGKKWKDQKIEDEYKNPRRNLSLRKWSWSLYPRQTLGLD

SEQ ID NO: 4347 - protein, 81 aa, Gorilla gorilla
DSVVFEDVDVNFTQEEWALLDPSQKNLYRDVMQETFRNLASVGKKWKDQKIEDEYKNPRRNLSLRKWSWSLYPRQTLGLDS

SEQ ID NO: 4348 - protein, 81 aa, Gorilla gorilla
MDSVVFEDVDVNFTQEEWALLDPSQKNLYRDVMQETFRNLASVGKKWKDQKIEDEYKNPRRNLRGLTGERLLESKKDHQHG

SEQ ID NO: 4349 - protein, 81 aa, Gorilla gorilla
MDSVAFEDVDVNFTQEEWALLDPSQKNLYRDVMWETMRNLASVGKKWKDQNIKDHYKHRGRNLRSHMLERLYQTKDGSQRG

SEQ ID NO: 4350 - protein, 81 aa, Gorilla gorilla
MDSAAFEDVAVNFTQEEWALLDPWQKKLYRDVMLETYRNLASVGKKCEEHNIEDQSKNQERSLRHIRSHTGHKPYECQDYE

SEQ ID NO: 4351 - protein, 81 aa, Gorilla gorilla
TLPRGQPEVLEWGLPKDQDSVAFEDVAVNFTHEEWALLGPSQKNLYRDVMRETIRNLNCIGMKWENQNIDDQYQNLRRNPR

SEQ ID NO: 4352 - protein, 81 aa, Gorilla gorilla
KNLYRDVMRETIRNLNCIGMKWENQNIDDQYQNLRRNPRLSETWLQNFILIHYGHLVALSDGGLLQFSTGQGLPVTQAGVQ

SEQ ID NO: 4353 - protein, 81 aa, Gorilla gorilla
MDSVAFEDVAVNFTHEEWALLGPSQKNLYRDVMRETIRNLNCIGMKWENQNIDDQYQNLRRNPRCDVVERFGKSKDGSQCG

SEQ ID NO: 4354 - protein, 81 aa, Gorilla gorilla
MDAVAFEDVAVNFTQEEWALLGPSQKNLYRYVMQETIRNLDCIRMIWEEQNTEDQYKNPRRNLRCHMVERFSESKDSSQCG

SEQ ID NO: 4355 - protein, 81 aa, Gorilla gorilla
HTHKQRGKAFSYHHSFQSRGRPHTGKKRYECKECGKTFSSRRNLRRHMVVQGGNRPYKFPIEDMRECTLGRNRMNVSSVLK

SEQ ID NO: 4356 - protein, 81 aa, Gorilla gorilla
RNDFFLPDSQTNEERKQYDSVAFEDVAVNFTQEEWALLGPSQKSLYRDVMWETIRNLDCIGMKWEDTNIEDQHKNPRRSLR

SEQ ID NO: 4357 - protein, 81 aa, Gorilla gorilla
MASVALEDVAVNFTREEWALLGPCQKNLYKDVMQETIRNLDCVGMKWKDQNIEDQYRYPRKNLRCRVLERFVESKGGSQCG

SEQ ID NO: 4358 - protein, 81 aa, Gorilla gorilla
ASVALEDVAVNFTREEWALLGPCQKNLYKDVMQETIRNLDCVGMKWKDQNIEDQYRYPRKNLRCRVLERFVESKGGSQCGE

SEQ ID NO: 4359 - protein, 81 aa, Gorilla gorilla
SDQRRRSKEARTPGSRDADSVVFEDVAVNFTQEEWALLGPSQKKLYRDVMQETFVNLASIGENWEEKNIEDHKNQGRKLRS

SEQ ID NO: 4360 - protein, 81 aa, Gorilla gorilla
VLQMQNSEHHGQSIKTQTDSISLEDVAVNFTLEEWALLDPGQRNIYRDVMRATFKNLACIGEKWKDQDIEDEHKNQGRNIR

SEQ ID NO: 4361 - protein, 81 aa, Gorilla gorilla
MDSISLEDVAVNFTLEEWALLDPGQRNIYRDVMRATFKNLACIGEKWKDQDIEDEHKNQGRNIRSPMVEALCENKEDCPCG

SEQ ID NO: 4362 - protein, 81 aa, Gorilla gorilla
MDSVAFEDVAVNFTQEEWALLSPSQKNLYRDVTLETFRNLASVGIQWKDQDIENLYQNLGIKLRSLVERLCGRKEGSEHRE

SEQ ID NO: 4363 - protein, 81 aa, Gorilla gorilla
MDSVSFEDVAVNFTLEEWALLDSSQKKLYEDVMQETFKNLVCLGKKWEDQDIEDDHRNQGRNRRCHMVERLCESRKGSKCG

SEQ ID NO: 4364 - protein, 81 aa, Gorilla gorilla
MGPLQFRDVAIEFSLEEWHCLDAAQRNLYRDVMLENYRNLIFLGIVVSKPNLITCLEQGKKPLTMKRHEMIAKPPVMCSHF

SEQ ID NO: 4365 - protein, 81 aa, Gorilla gorilla
LRRYEKCRHDNLQLKKGCESVDECPVHKRGYNGLKQCLTTTQRKIFQCDEYVKFLHKFSNSNKHKIRDTGKKPFKCIEYGK

SEQ ID NO: 4366 - protein, 81 aa, Gorilla gorilla
MGPLQFRDVAIEFSLEEWHCLDAAQRNLYRDVMLENYRNLIFLGIVVSKPNLITCLEQGKKPLTMKRHEMIAKPPGQARWL

SEQ ID NO: 4367 - protein, 81 aa, Gorilla gorilla
MGPLQFRDVAIEFSLEEWHCLDAAQRNLYRDVMLENYRNLIFLGIVVSKPNLITCLEQGKKPLTMKRHEMIAKPPDGVLVF

SEQ ID NO: 4368 - protein, 81 aa, Gorilla gorilla
MGPLQFRDVAIEFSLEEWHCLDAAQRNLYRDVMLENYRNLIFLVMCSHFAQDLWSEQSIKDSFQKVILRRYEKCRHDNLQL

SEQ ID NO: 4369 - protein, 81 aa, Gorilla gorilla
MGPLQFRDVAIEFSLEEWHCLDAAQRNLYRDVMLENYRNLIFLGIVVSKPNLITCLEQGKKPLTMKRHEMIAKPPETGFHR

SEQ ID NO: 4370 - protein, 81 aa, Gorilla gorilla
LRRYEKCRHDNLQLKKGCKSMGEHKVHKGGYNGLNQCLTTTQKEIFQCDKYGKVFHKFSNSNTYKTRHTGINLFKCIECGK

SEQ ID NO: 4371 - protein, 81 aa, Gorilla gorilla
MGPLQFKDVAIEFSLEEWHCLDTAQRNLYRDVMLENYRNLVFLGIVVSKPDLIARLEQGKKPLTMKRHEMVANPSGPGVVV

SEQ ID NO: 4372 - protein, 81 aa, Gorilla gorilla
MGPLQFKDVAIEFSLEEWHCLDTAQRNLYRDVMLENYRNLVFLGIVVSKPDLIARLEQGKKPLTMKRHEMVANPSVICSHF

SEQ ID NO: 4373 - protein, 81 aa, Gorilla gorilla
MGPLQFKDVAIEFSLEEWHCLDTAQRNLYRDVMLENYRNLVFLGIVVSKPDLIARLEQGKKPLTMKRHEMVANPSDEVNLC

SEQ ID NO: 4374 - protein, 81 aa, Gorilla gorilla
MGPLQFKDVAIEFSLEEWHCLDTAQRNLYRDVMLENYRNLVFLGIVVSKPDLIARLEQGKKPLTMKRHEMVANPSGARLLF

SEQ ID NO: 4375 - protein, 81 aa, Gorilla gorilla
MAGSQELLTFRDVTIEFSLEEWEFLNPAQQSLYRKVMLENYRNLVSLGLTVSKPELISCLEQRQEPWNVKRHETIAKPPAM

SEQ ID NO: 4376 - protein, 81 aa, Gorilla gorilla
EQGMQDSFQKVILRRYGSCGLEDLHLRKDGENVGECKDQKEIYNGLNQCLSTLPSKIFPYNKCVKVFSKSSNLNRENRRHT

SEQ ID NO: 4377 - protein, 81 aa, Gorilla gorilla
MGPLEFRDVAIEFSLEEWHCLDTAQRNLYRDVMLENYRNLIFLGIVVTKPDLITCLEQGKKPFTVKRHEMIAKPPDGVHFL

SEQ ID NO: 4378 - protein, 81 aa, Gorilla gorilla
MGPLEFRDVAIEFSLEEWHCLDTAQRNLYRDVMLENYRNLIFLGIVVTKPDLITCLEQGKKPFTVKRHEMIAKPPVMCFHF

SEQ ID NO: 4379 - protein, 81 aa, Gorilla gorilla
MAESGPLEFRDVAIEFSLEEWHCLDTAQRNLYRDVMLENYRNLIFLGIVVTKPDLITCLEQGKKPFTVKRHEMIAKPPVMC

SEQ ID NO: 4380 - protein, 81 aa, Gorilla gorilla
MPGPLRSLEMESLQFRDVAVEFSLEEWHCLDTAQRNLYRDVMLENYRHLVFLGIIVSKPDLITCLEQGIKPLTMKRHEMIA

SEQ ID NO: 4381 - protein, 81 aa, Gorilla gorilla
MGPLQFRDVAIEFSLEEWHCLDTAQQNLYRDVMLENYRNLVFLGIVVSKPDFITCLEQGKKPLTMKKHEMVANPSVTCSHF

SEQ ID NO: 4382 - protein, 81 aa, Gorilla gorilla
MGPLQFRDVAIEFSLEEWHCLDTAQQNLYRDVMLENYRNLVFLGIVVSKPDFITCLEQGKKPLTMKKHEMVANPSETGFHH

SEQ ID NO: 4383 - protein, 81 aa, Gorilla gorilla
MGPLQFRDVAIEFSLEEWHCLDTAQRNLYRDVMLENYRNLIFLGITVSKPDLITCLEQGKKPLTMKRNEMMAKPSVMCSHF

SEQ ID NO: 4384 - protein, 81 aa, Gorilla gorilla
MGPLQFRDVAIEFSLEEWHCLDTAQRNLYRDVMLENYRNLIFLGITVSKPDLITCLEQGKKPLTMKRNEMMAKPSVSFLQV

SEQ ID NO: 4385 - protein, 81 aa, Gorilla gorilla
MGPLTFRDVAIEFSLKEWQCLDTAQRNLYRNVMLENYRNLVFLGIAVSKPDLITCLEQGKEAWSMKRHEIMVAKPTVMCSH

SEQ ID NO: 4386 - protein, 81 aa, Gorilla gorilla
MGPLTFRDVAIEFSLKEWQCLDTAQRNLYRNVMLENYRNLVFLDLITCLEQGKEAWSMKRHEIMVAKPTVMCSHFDQDLWP

SEQ ID NO: 4387 - protein, 81 aa, Gorilla gorilla
MGPLTFRDVAIEFSLKEWQCLDTAQRNLYRNVMLENYRNLVFLGIAVSKPDLITCLEQGKEAWSMKRHEIMVAKPTESYSV

SEQ ID NO: 4388 - protein, 81 aa, Gorilla gorilla
MGPLTFRDVAIEFSLKEWQCLDTAQRNLYRNVMLENYRNLVFLGIAVSKPDLITCLEQGKEAWSMKRHEIMVAKPTGEVSR

SEQ ID NO: 4389 - protein, 81 aa, Gorilla gorilla
MGPLTFRDVAIEFSLKEWQCLDTAQRNLYRNVMLENYRNLVFLGIAVSKPDLITCLEQGKEAWSMKRHEIMVAKPTGCLSK

SEQ ID NO: 4390 - protein, 81 aa, Gorilla gorilla
ASGCPGADRNLLVYSFYEKGPLTFRDVAIEFSLEEWQCLDTAQQDLYRKVMLENYRNLVFLAGIAVSKPDLITCLEQGKEP

SEQ ID NO: 4391 - protein, 81 aa, Gorilla gorilla
SGCPGADRNLLVYSFYEKGPLTFRDVAIEFSLEEWQCLDTAQQDLYRKVMLENYRNLVFLGIAVSKPDLITCLEQGKEPWS

SEQ ID NO: 4392 - protein, 81 aa, Gorilla gorilla
MNVMLENYKNLVFLGIAVSKQDQITSLEQEKEPWNMKICEMVDESPGQVWWLTPVIPALWEARAGGLLEPRSLRPAWSTWK

SEQ ID NO: 4393 - protein, 81 aa, Gorilla gorilla
MNVMLENYKNLVFLAGIAVSKQDQITSLEQEKEPWNMKICEMVDESPAMCSYFTRDLWPEQDIKDSFQQVILRRHGKCEHE

SEQ ID NO: 4394 - protein, 81 aa, Gorilla gorilla
MNVMLENYKNLVFLGIAVSKQDQITSLEQEKEPWNMKICEMVDESPGYMCRMSYVFLFYQRPLARARHKRFFSTSDTEKTW

SEQ ID NO: 4395 - protein, 81 aa, Gorilla gorilla
MNVMLENYKNLVFLGIAVSKQDQITSLEQEKEPWNMKICEMVDESPAMCSYFTRDLWPEQDIKDSFQQVILRRHGKCEHEN

SEQ ID NO: 4396 - protein, 81 aa, Gorilla gorilla
SRCPGAERNLLVYSYFEKETLTFRDVAIEFSLEEWECLNPAQQNLYMNVMLENYKNLVFLGVAVSKQDPVTCLEQEKEPWN

SEQ ID NO: 4397 - protein, 81 aa, Gorilla gorilla
ILRRYGKCEHENLQLRKGSTSVDEYKVHKEGYNELNQCLTTTQRKIFPCDKYVKVFHKFLNANRHKTRHTGKKPFKCKKCG

SEQ ID NO: 4398 - protein, 81 aa, Gorilla gorilla
LRRYGKCEHENLQLRKGSTSVDEYKVHKEGYNELNQCLTTTQRKIFPCDKYVKVFHKFLNANRHKTRHTGKKPFKCKKCGK

SEQ ID NO: 4399 - protein, 81 aa, Gorilla gorilla
ASRCPGAERNLLVYSYFEKETLTFRDVAIEFSLEEWECLNPAQQNLYMNVMLENYKNLVFLAGVAVSKQDPVTCLEQEKEP

SEQ ID NO: 4400 - protein, 81 aa, Gorilla gorilla
MGPLTFMDVAIEFSLEEWQCLDTAQQNLYRNVMLENYRNLVFLGIAVSNLDLITCLEQGKEPWNMKRHEMVAKPPAMCSHF

SEQ ID NO: 4401 - protein, 81 aa, Gorilla gorilla
SGYPGAERNLLEYSYFEKGPLTFRDVVIEFSQEEWQFLDTAQQDLYRKVMLENFRNLVFLGIDVSKPDLITCLEQGKDPWN

SEQ ID NO: 4402 - protein, 81 aa, Gorilla gorilla
TPGPPESLEMGPLTFRDVAIEFSLEEWQCLDTAQQDLYRKVMLENYRNLAFLAGIAVSMPDLVTCLQQGKDPWNVKRQSTV

SEQ ID NO: 4403 - protein, 81 aa, Gorilla gorilla
TPGPPESLEMGPLTFRDVAIEFSLEEWQCLDTAQQDLYRKVMLENYRNLAFLGIAVSMPDLVTCLQQGKDPWNVKRQSTVV

SEQ ID NO: 4404 - protein, 81 aa, Gorilla gorilla
EFSLEEWQCLDTAQQDLYRKVMLENYRNLAFLAGIAVSMPDLVTCLQQGKDPWNVKRQSTVVKPPGGDCSIFLMEHQGDVT

SEQ ID NO: 4405 - protein, 81 aa, Gorilla gorilla
MGPLTFTDVAIEFSLEEWQCLDTAQQNLYRNVMLENYRNLVFLGIAVSKPDLITCLEKEKEPCNMKRHEMVDEPPVVCSHF

SEQ ID NO: 4406 - protein, 81 aa, Gorilla gorilla
MGPLTFTDVAIEFSLEEWQCLDTAQQNLYRNVMLENYRNLVFLGIAVSKPDLITCLEKEKEPCNMKRHEMVDEPPDGVSLL

SEQ ID NO: 4407 - protein, 81 aa, Gorilla gorilla
RRYDKRGHENLQLRKGYKTVGDCKLYKGGYNGLNQCLTLTQSKMYHCDIYVKVFYAFSNADRYKTRHTGKEPFQCKKCGKS

SEQ ID NO: 4408 - protein, 81 aa, Gorilla gorilla
ASGRPGAERSLLVQSYFEKGPLTFRDVAIEFSLEEWQCLDSAQQGLYRKVMLENYRNLVFLAGIALTKPDLITCLEQGKEP

SEQ ID NO: 4409 - protein, 81 aa, Gorilla gorilla; identical to SEQ ID NO: 2420

SEQ ID NO: 4410 - protein, 81 aa, Gorilla gorilla
SGRPGAERSLLVQSYFEKGPLTFRDVAIEFSLEEWQCLDSAQQGLYRKVMLENYRNLVFLGIALTKPDLITCLEQGKEPWN

SEQ ID NO: 4411 - protein, 81 aa, Gorilla gorilla
MPGHPGSWEMGPLTFMDVAIEFCLEEWQCLDTAQQNLYRNVMLENYRNLVFLGIAVSKPDLITCLEQEKEPWEPMRRHEMV

SEQ ID NO: 4412 - protein, 81 aa, Gorilla gorilla
MDVAIEFCLEEWQCLDTAQQNLYRNVMLENYRNLVFLGIAVSKPDLITCLEQEKEPWEPMRRHEMVAKPPVMCSHFTQDFW

SEQ ID NO: 4413 - protein, 81 aa, Gorilla gorilla
MGPLTFMDVAIEFCLEEWQCLDTAQQNLYRNVMLENYRNLVFLGIAVSKPDLITCLEQEKEPWEPMRRHEMVAKPPVMCSH

SEQ ID NO: 4414 - protein, 81 aa, Gorilla gorilla
MDVAIEFCLEEWQCLDTAQQNLYRNVMLENYRNLVFLGIAVSKPDLITCLEQEKEPWEPMRRHEMVAKPPVSFLRPSPETD

SEQ ID NO: 4415 - protein, 81 aa, Gorilla gorilla
MDVAIEFCLEEWQCLDTAQQNLYRNVMLENYRNLVFLGIAVSKPDLITCLEQEKEPWEPMRRHEMVAKPPGGIVSLLNVFF

SEQ ID NO: 4416 - protein, 81 aa, Gorilla gorilla
MGSLTFRDVAIEFSLEEWQCLDSTQQNLYRNVMLENYRNLVFLGIAAFKPDLIIFLEEGKEPWNMKRHERVEESPVICSHF

SEQ ID NO: 4417 - protein, 81 aa, Gorilla gorilla
MGSLTFRDVAIEFSLEEWQCLDSTQQNLYRNVMLENYRNLVFLGIAAFKPDLIIFLEEGKEPWNMKRHERVEESPGMVGSS

SEQ ID NO: 4418 - protein, 81 aa, Gorilla gorilla
MPGTQLILYDGSLTFRDVAIEFSLEEWQCLDSTQQNLYRNVMLENYRNLVFLGIAAFKPDLIIFLEEGKEPWNMKRHERVE

SEQ ID NO: 4419 - protein, 81 aa, Gorilla gorilla
MGPLTIRDVTVEFSLEEWHCLDTAQQNLYRDVMLENYRNLVFLGIAVSKPDLITCLEQGKEPCNMKRHEMVAKPPDGVLLF

SEQ ID NO: 4420 - protein, 81 aa, Gorilla gorilla
MGPLTIRDVTVEFSLEEWHCLDTAQQNLYRDVMLENYRNLVFLGIAVSKPDLITCLEQGKEPCNMKRHEMVAKPPVICSHI

SEQ ID NO: 4421 - protein, 81 aa, Gorilla gorilla
MLENYRNLVFLGIAAFKPDLIIFLEQGKEPWNMKRHEMVEEPPVICSHFSQEFWPEQDIEDSFQKMILRRYDKCGHENLHL

SEQ ID NO: 4422 - protein, 81 aa, Gorilla gorilla; identical to SEQ ID NO: 2421

SEQ ID NO: 4423 - protein, 81 aa, Gorilla gorilla
MGVLTFRDVAIEFSLEEWHCLDTAPQNLYRNVTLENYRNLVFLGIAASKPDLITCLEQGKEPWNVKRHEMVAEPPVVYSYF

SEQ ID NO: 4424 - protein, 81 aa, Gorilla gorilla
MGSLTFRDVTIEFSLEEWQCLDTAQQNLYRNVMLENYRNMVFLGIAVSKLDLITCLKQGKEPWNMKRHEMVTKPPVISSHF

SEQ ID NO: 4425 - protein, 81 aa, Gorilla gorilla
SEKCTRLILYDLKIALKNGSLTFRDVTIEFSLEEWQCLDTAQQNLYRNVMLENYRNMVFLGIAVSKLDLITCLKQGKEPWN

SEQ ID NO: 4426 - protein, 81 aa, Gorilla gorilla; identical to SEQ ID NO: 2422

SEQ ID NO: 4427 - protein, 81 aa, Gorilla gorilla; identical to SEQ ID NO: 2423

SEQ ID NO: 4428 - protein, 81 aa, Gorilla gorilla; identical to SEQ ID NO: 2424

SEQ ID NO: 4429 - protein, 81 aa, Gorilla gorilla
MGPLTFMDVAIEFSVEEWQCLDTAQQNLYRNVMLENYRNLVFLGIAVSKPDLITCLEQGKEPWNMERHEMVAKHPGMCCYF

SEQ ID NO: 4430 - protein, 81 aa, Gorilla gorilla
MDVAIEFSVEEWQCLDTAQQNLYRNVMLENYRNLVFLGIAVSKPDLITCLEQGKEPWNMERHEMVAKHPGMCCYFAQDLWP

SEQ ID NO: 4431 - protein, 81 aa, Gorilla gorilla
MGLLTFRDVAIEFSLEEWQCLDTAQRNLYKNVILENYRNLVFLGIAVSKQDLITCLEQEKEPLTVKRHEMVNEPPESHPVI

SEQ ID NO: 4432 - protein, 81 aa, Gorilla gorilla
MGLLTFRDVAIEFSLEEWQHLDIAQQNLYRNVMLENYRNLAFLGIAVSKPDLITCLEQGKEPWNMKRHEMVDEPPGMCPHF

SEQ ID NO: 4433 - protein, 81 aa, Gorilla gorilla
MSQVTFSDVAIDFSHEEWACLDTAQRDLYKDVMVQNYENLVSVAGLSVTKPYVIMLLEDGKEPWMMEKKLSKDWESRWENK

SEQ ID NO: 4434 - protein, 81 aa, Gorilla gorilla
MSQVTFSDVAIDFSHEEWACLDTAQRDLYKDVMVQNYENLVSVAGLSVTKPYVIMLLEDGKEPWMMEKKLSKAYPFPLSHS

SEQ ID NO: 4435 - protein, 81 aa, Gorilla gorilla
MSQVTFSDVAIDFSHEEWACLDTAQRDLYKDVMVQNYENLVSVGLSVTKPYVIMLLEDGKEPWMMEKKLSKAYPFPLSHSV

SEQ ID NO: 4436 - protein, 81 aa, Gorilla gorilla
MSQVTFSDVAIDFSHEEWACLDTAQRDLYKDVMVQNYENLVSVGLSVTKPYVIMLLEDGKEPWMMEKKLSKDWESRWENKE

SEQ ID NO: 4437 - protein, 81 aa, Gorilla gorilla
EELVGQNHGMEGEACTGGDVTFSDVAIDFSHEEWACLDTAQRDLYKDVMVQNYENLVSVGLSVTKPYVIMLLEDGKEPWMM

SEQ ID NO: 4438 - protein, 81 aa, Gorilla gorilla
SNEELVGQNHGMEGEACTGEDVTFNDVAIDFTHEEWGWLNSAQRDLYKDVMVQNYENLVSVAGLSVTKPYVITLLEDGKEP

SEQ ID NO: 4439 - protein, 81 aa, Gorilla gorilla
MPQVTFNDVAIDFTHEEWGWLNSAQRDLYKDVMVQNYENLVSVAGLSVTKPYVITLLEDGKEPWMMEKKLSKGMIPDWESR

SEQ ID NO: 4440 - protein, 81 aa, Gorilla gorilla
MPQVTFNDVAIDFTHEEWGWLNSAQRDLYKDVMVQNYENLVSVGLSVTKPYVITLLEDGKEPWMMEKKLSKGMIPDWESRW

SEQ ID NO: 4441 - protein, 81 aa, Gorilla gorilla
MPQVTFNDVAIDFTHEEWGWLNSAQRDLYKDVMVQNYENLVSVAGLSVTKPYVITLLEDGKEPWMMEKKLSKDWESRWENK

SEQ ID NO: 4442 - protein, 81 aa, Gorilla gorilla
NEELVGQNHGMEGEACTGEDVTFNDVAIDFTHEEWGWLNSAQRDLYKDVMVQNYENLVSVGLSVTKPYVITLLEDGKEPWM

SEQ ID NO: 4443 - protein, 81 aa, Gorilla gorilla
MTESQGTVTFKDVAIDFTQEEWKRLDPAQRKLYRNVMLENYNNLITVGHPFTKPDVIFKLEQEEEPWVMEEEVLRRHWQGE

SEQ ID NO: 4444 - protein, 81 aa, Gorilla gorilla
TSAGPIPSQKEEEMTESQGTVTFKDVAIDFTQEEWKRLDPAQRKLYRNVMLENYNNLITVGHPFTKPDVIFKLEQEEEPWV

SEQ ID NO: 4445 - protein, 81 aa, Gorilla gorilla
EMTESQGTVTFKDVAIDFTQEEWKRLDPAQRKLYRNVMLENYNNLITVGHPFTKPDVIFKLEQEEEPWVMEEEVLRRHWQG

SEQ ID NO: 4446 - protein, 81 aa, Gorilla gorilla
LVSLGLCFSKPSVILLLEQGKAPWMVKRELTKGLCSGWEPICETEELTPKQDFYEEHQSQKIIETLTSYNLEYSSLREEWK

SEQ ID NO: 4447 - protein, 81 aa, Gorilla gorilla
PICETEELTPKQDFYEEHQSQKIIETLTSYNLEYSSLREEWKCEGCFERQPGNQKACFKEEIITHEEPLVDEREQEYKSWG

SEQ ID NO: 4448 - protein, 81 aa, Gorilla gorilla
EPICETEELTPKQDFYEEHQSQKIIETLTSYNLEYSSLREEWKCEGCFERQPGNQKACFKEEIITHEEPLVDEREQEYKSW

SEQ ID NO: 4449 - protein, 81 aa, Gorilla gorilla
QGKAPWMVKRELTKGLCSGWEPICETEELTPKQDFYEEHQSQKIIETLTSYNLEYSSLREEWKCEGCFERQPGNQKACFKE

SEQ ID NO: 4450 - protein, 81 aa, Gorilla gorilla
MIEYQIPVSFKDVVVGFTQEEWHRLSPAQRALYRDVMLETYSNLVSVGYEGTKPDVILRLEQEEAPWIGEAACPGCHCWED

SEQ ID NO: 4451 - protein, 81 aa, Gorilla gorilla
MIEYQIPVSFKDVVVGFTQEEWHRLSPAQRALYRDVMLETYSNLVSVGYEGTKPDVILRLEQEEAPWIGEAACPGCHCWGI

SEQ ID NO: 4452 - protein, 81 aa, Gorilla gorilla
VVVGFTQEEWHRLSPAQRALYRDVMLETYSNLVSVGYEGTKPDVILRLEQEEAPWIGEAACPGCHCWGISKLWSTNWSPAL

SEQ ID NO: 4453 - protein, 81 aa, Gorilla gorilla
MIEYQIPVSFKDVVVGFTQEEWHRLSPAQRALYRDVMLETYSNLVSVGYEGTKPDVILRLEQEEAPWIGEAACPGCHCWGK

SEQ ID NO: 4454 - protein, 81 aa, Gorilla gorilla
EWHRLSPAQRALYRDVMLETYSNLVSVGYEGTKPDVILRLEQEEAPWIGEAACPGCHCWGKCDKSSKRGTEGGWHLWNFVQ

SEQ ID NO: 4455 - protein, 81 aa, Gorilla gorilla
EWHRLSPAQRALYRDVMLETYSNLVSVGYEGTKPDVILRLEQEEAPWIGEAACPGCHCWEDIWRVNIQRKRRQDMLLRQGA

SEQ ID NO: 4456 - protein, 81 aa, Gorilla gorilla
IPVSFKDVVVGFTQEEWHRLSPAQRALYRDVMLETYSNLVSVGYEGTKPDVILRLEQEEAPWIGEAACPGCHCWGKCDKSS

SEQ ID NO: 4457 - protein, 81 aa, Gorilla gorilla
WHRLSPAQRALYRDVMLETYSNLVSVGYEGTKPDVILRLEQEEAPWIGEAACPGCHCWGKCDKSSKRGTEGGWHLWNFVQH

SEQ ID NO: 4458 - protein, 81 aa, Gorilla gorilla
MAHALVTFRDVAIDFSQKEWECLDTTQRKLYRDVMLENYNNLVSLGLLSRHKTKKLSSEKDIHEISLSKGSIIEKSKTLRL

SEQ ID NO: 4459 - protein, 81 aa, Gorilla gorilla
MPHLLVTFRDVAIDFSQEEWECLDPAQRDLYRDVMLENYSNLISLEPARTHKEQHNLPVPKAGSVNLAAGFGHSRSQTGCG

SEQ ID NO: 4460 - protein, 81 aa, Gorilla gorilla
MAYGSITFGDVAIDFSHQEWEYLNLVQKTLYQEVMMENYDNLVSLAGHSVSKPDLITLLEQGKEPWTIVREETRGECTDLD

SEQ ID NO: 4461 - protein, 81 aa, Gorilla gorilla
MAYGSITFGDVAIDFSHQEWEYLNLVQKTLYQEVMMENYDNLVSLGHSVSKPDLITLLEQGKEPWTIVREETRGECTDLDS

SEQ ID NO: 4462 - protein, 81 aa, Gorilla gorilla
MAYGSITFGDVAIDFSHQEWEYLNLVQKTLYQEVMMENYDNLVSLGHSVSKPDLITLLEQGKEPWTIVREETRGECTAELQ

SEQ ID NO: 4463 - protein, 81 aa, Gorilla gorilla
CNWERPLKFCPTKYMKFQELVTFRDVAIDFSRQEWEYLDPNQRDLYRDVMLENYRNLVSLGGRSISKPVVVDLLERGKEPW

SEQ ID NO: 4464 - protein, 81 aa, Gorilla gorilla
HQVGLIRSYNSKTMTCFQELVTFRDVAIDFSRQEWEYLDPNQRDLYRDVMLENYRNLVSLGGRSISKPVVVDLLERGKEPW

SEQ ID NO: 4465 - protein, 81 aa, Gorilla gorilla
HQVGLIRSYNSKTMTCFQELVTFRDVAIDFSRQEWEYLDPNQRDLYRDVMLENYRNLVSLEMRSRCVARAGLKLLVSSDPP

SEQ ID NO: 4466 - protein, 81 aa, Gorilla gorilla
EPHQVGLIRSYNSKTMTCELVTFRDVAIDFSRQEWEYLDPNQRDLYRDVMLENYRNLVSLGGRSISKPVVVDLLERGKEPW

SEQ ID NO: 4467 - protein, 81 aa, Gorilla gorilla
TCNWERPLKFCPTKYMKFQELVTFRDVAIDFSRQEWEYLDPNQRDLYRDVMLENYRNLVSLGGRSISKPVVVDLLERGKEP

SEQ ID NO: 4468 - protein, 81 aa, Gorilla gorilla
MAHGLVTFRDVAIDFSQEEWEFLDPAQRDLYRDVMWENYSNFISLGPSISKPDVITLLDEERKEPGMVVREGTRRYCPDLE

SEQ ID NO: 4469 - protein, 81 aa, Gorilla gorilla
MAHGLVTFRDVAIDFSQEEWEFLDPAQRDLYRDVMWENYSNFISLAGPSISKPDVITLLDEERKEPGMVVREGTRRYCPGE

SEQ ID NO: 4470 - protein, 81 aa, Gorilla gorilla
MPEVEFPDQFFTVLTMDHELVTLRDVVINFSQEEWEYLDSAQRNLYWDVMMENYSNLLSLDLESRNETKQLSVGKDIIQNT

SEQ ID NO: 4471 - protein, 81 aa, Gorilla gorilla
MMENYSNLLSLDLESRNETKQLSVGKDIIQNTGSQWEVMESSKLCGLEGSIFRNDWQSKSKIEVQGPEVGYFSQMKIISEN

SEQ ID NO: 4472 - protein, 81 aa, Gorilla gorilla
TVLTMDHELVTLRDVVINFSQEEWEYLDSAQRNLYWDVMMENYSNLLSLDLESRNETKQLSVGKDIIQNTGSQWEVMESSK

SEQ ID NO: 4473 - protein, 81 aa, Gorilla gorilla
FHMAKPDMIRKLEQGEELWTQRIFPSYSYLEEDGKTEDVLVKFKEYQDRHSRPLIFINHKKLIKERSNIYGKTFTLGKNRI

SEQ ID NO: 4474 - protein, 81 aa, Gorilla gorilla
GFHMAKPDMIRKLEQGEELWTQRIFPSYSYLEDGKTEDVLVKFKEYQDRHSRPLIFINHKKLIKERSNIYGKTFTLGKNRI

SEQ ID NO: 4475 - protein, 81 aa, Gorilla gorilla
MNMEGLVMFQDLSIDFSQEEWECLDAAQKDLYRDVMMENYSSLVSLGLSIPKPDVISLLEQGKEPWMVSRDVLGGWCRGLE

SEQ ID NO: 4476 - protein, 81 aa, Gorilla gorilla
MNMEGLVMFQDLSIDFSQEEWECLDAAQKDLYRDVMMENYSSLVSLDSEFRCKTKDSCLPKEIYEVTSPQWVRMEKCHSLV

SEQ ID NO: 4477 - protein, 81 aa, Gorilla gorilla
MAHLLMFRDVAVDFSQEEWECLDLEQRDLYRDVMLENYSNMVSLGLCIYQPEAFSLLEKGKEPWKILRDETRGPCPDMQSR

SEQ ID NO: 4478 - protein, 81 aa, Gorilla gorilla
TELSQWEMSDRLENCDLEESNSRDYLEAKGKMEKQQENQKEYFRQGMIIYDKMSIFNQHTYLSQHSRCHSTEKPYKCKECG

SEQ ID NO: 4479 - protein, 81 aa, Gorilla gorilla
LAPEDHGSSYEGSVSFRDVAIDFSREEWRHLDPSQRNLYRDVMLETYSHLLSVGYQVPEAEVVMLEQGKEPWALQGERPRQ

SEQ ID NO: 4480 - protein, 81 aa, Gorilla gorilla
REEWRHLDPSQRNLYRDVMLETYSHLLSVGYQVPEAEVVMLEQGKEPWALQGERPRQSCPVTHRLTLPSTMTKSFLDLTRS

SEQ ID NO: 4481 - protein, 81 aa, Gorilla gorilla
SPQKSSALAPEDHGSSYEGSVSFRDVAIDFSREEWQHLDLSQRNLYRDVMLETYSHLLSVGFVSLGSPWARSSSRLQPISS

SEQ ID NO: 4482 - protein, 81 aa, Gorilla gorilla
SPQKSSALAPEDHGSSYEGSVSFRDVAIDFSREEWRHLDPSQRNLYRDVMLETYSHLLSVGYQVPEAEVVMLEQGKEPWAL

SEQ ID NO: 4483 - protein, 81 aa, Gorilla gorilla
SPQKSSALAPEDHGSSYEGSVSFRDVAIDFSREEWQHLDLSQRNLYRDVMLETYSHLLSVGEKLWDHNQHRKIIGYKPASS

SEQ ID NO: 4484 - protein, 81 aa, Gorilla gorilla
MQLNEEINKGSVSFRDVAIDFSREEWQHLDLSQRNLYRDVMLETYSHLLSVGEKLWDHNQHRKIIGYKPASSQDQKIYSGE

SEQ ID NO: 4485 - protein, 81 aa, Gorilla gorilla
EETQGELTSSCGSKTMANVSLAFRDVSIDLSQEEWECLDAVQRDLYKDVMLENYSNLVSLGYTIPKPDVITLLEQEKEPWI

SEQ ID NO: 4486 - protein, 81 aa, Gorilla gorilla
MQVDPPLHGPPNDFLIFQIIPLHSLSIMPRFLWILCFSMEETQGELTSSCGSKTMANVSLAFRDVSIDLSQEEWECLDAVQ

SEQ ID NO: 4487 - protein, 81 aa, Gorilla gorilla
MVHGSVTFRDVAIDFSQEEWECLQPDQRTLYRDVMLENYSHLISLGSCISKPDVVTLLEQEKEPWIVVSKETSRWYPDLES

SEQ ID NO: 4488 - protein, 81 aa, Gorilla gorilla
MVHGSVTFRDVAIDFSQEEWECLQPDQRTLYRDVMLENYSHLISLAGSCISKPDVVTLLEQEKEPWIVIWSQNMDLRKYLQ

SEQ ID NO: 4489 - protein, 81 aa, Gorilla gorilla
MLENYSHLISLGSSISKPGVITLLEQEKEPWMVVRKETSRWYPDLESKYGPEKVSPENDTSEVNLPKHVIKQISTTLGVEA

SEQ ID NO: 4490 - protein, 81 aa, Gorilla gorilla
GRSPRKIDQFCNSSNMVHGSVTFRDVAIDFSQEEWECLQPDQRTLYRDVMLENYSHLISLGSSISKPGVITLLEQEKEPWM

SEQ ID NO: 4491 - protein, 81 aa, Gorilla gorilla
MVHGSVTFRDVAIDFSQEEWECLQPDQRTLYRDVMLENYSHLISLGSSISKPGVITLLEQEKEPWMVVRKETSRWYPDLES

SEQ ID NO: 4492 - protein, 81 aa, Gorilla gorilla
MVHGSVTFRDVAIDFSQEEWECLQPDQRTLYRDVMLENYSHLISLAGSSISKPGVITLLEQEKEPWMVVRKETSRWYPDLE

SEQ ID NO: 4493 - protein, 81 aa, Gorilla gorilla
EESHGALISSCNSRTMTDGLVTFRDVAIDFSQEEWECLDPAQRDLYVDVMLENYSNLVSLDLESTTYETKKIFSENDIFEI

SEQ ID NO: 4494 - protein, 81 aa, Gorilla gorilla
ESCSGFSGFFASPIEESHGALISSCNSRTMTDGLVTFRDVAIDFSQEEWECLDPAQRDLYVDVMLENYSNLVSLGKVICLK

SEQ ID NO: 4495 - protein, 81 aa, Gorilla gorilla
TAQVPLTFSDVAIDFSQEEWEYLNSDQRDLYRDVMLENYTNLVSLDDFTTESDKLSSEKRNYEVNAYHQETWKINKTFNLM

SEQ ID NO: 4496 - protein, 81 aa, Gorilla gorilla
FQVPLTFSDVAIDFSQEEWEYLNSDQRDLYRDVMLENYTNLVSLDDFTTESDKLSSEKRNYEVNAYHQETWKINKTFNLMR

SEQ ID NO: 4497 - protein, 81 aa, Gorilla gorilla
MTKSKEAVTFKDVAVVFSEEELQLLDLAQRKLYRDVMLENFRNVVSVGHQSTPDGLPQLEREEKLWMMKMATQRENSSGAK

SEQ ID NO: 4498 - protein, 81 aa, Gorilla gorilla
MLENFRNVVSVGHQSTPDGLPQLEREEKLWMMKMATQRENSSGAKNLKEMETLQEVGLRYLPHEELFCSQIWQQITRELIK

SEQ ID NO: 4499 - protein, 81 aa, Gorilla gorilla
HSGLCKFPEVEGKMTTFKEAVTFKDVAVVFTEEELGLLDPAQRKLYRDVMLENFRNLLSVGNQPFHQDTFHFLRKEKFWMM

SEQ ID NO: 4500 - protein, 81 aa, Gorilla gorilla
LRKEKFWMMKTTSQREGNSGGKIQIEMETVPEAGPHEEWSCQQIWEQIASDLTRSQNSIRNSSQFFKEGDVPCQIEAGLSI

SEQ ID NO: 4501 - protein, 81 aa, Gorilla gorilla
AQRKLYRDVMLENFRNLLSVGNQPFHQDTFHFLRKEKFWMMKTTSQREGNSGGKIQIEMETVPEAGPHEEWSCQQIWEQIA

SEQ ID NO: 4502 - protein, 81 aa, Gorilla gorilla
MTTFKEAVTFKDVAVVFTEGELGLLDPAQRKLYRDVMLENFRNLLSVGHQPFHQDTCHFLREEKFWMMGTATQREGNSGGK

SEQ ID NO: 4503 - protein, 81 aa, Gorilla gorilla
FKDVAVVFTEGELGLLDPAQRKLYRDVMLENFRNLLSVGHQPFHQDTCHFLREEKFWMMGTATQREGNSGGKIQTELESVP

SEQ ID NO: 4504 - protein, 81 aa, Gorilla gorilla
LREEKFWMMGTATQREGNSGGKIQTELESVPEAGAHEEWSCQQIWEQIAKDLTRSQDSIINNSQFFENGDVPSQVEAGLPT

SEQ ID NO: 4505 - protein, 81 aa, Gorilla gorilla
MIKRSKVLVFCSKIMEEAVTFKDVAVVFTEGELGLLDPAQRKLYRDVMLENFRNLLSVGHQPFHQDTCHFLREEKFWMMGT

SEQ ID NO: 4506 - protein, 81 aa, Gorilla gorilla
VTTFKEAVTFKDVAVFFTEEELGLLDPAQRKLYQDVMLENFTNLLSVGHQPFHPFHFLREEKFWMMETATQREGNSGSKTV

SEQ ID NO: 4507 - protein, 81 aa, Gorilla gorilla
VTTFKEAVTFKDVAVFFTEEELGLLDPAQRKLYQDVMLENFTNLLSVGHQPFHPFHFLREEKFWMMETATQREGNSGKKQA

SEQ ID NO: 4508 - protein, 81 aa, Gorilla gorilla
MIDSGEKKPGRRAEEAVTFKDVAVIFTEEELGLLDPAQRKLYRDVMLENFRNLLSVGHQPFHGDTFHFLREEKFWVMGKTN

SEQ ID NO: 4509 - protein, 81 aa, Gorilla gorilla
GRRAEEAVTFKDVAVIFTEEELGLLDPAQRKLYRDVMLENFRNLLSVGHQPFHGDTFHFLREEKFWVMGKTNQREGNSGPL

SEQ ID NO: 4510 - protein, 81 aa, Gorilla gorilla
HSGLCKFPKVGGKMTMSKEAVTFKDVAVIFTEEELGLLDLAQRKLYRDVMLENFRNLLSVGHQPFHQDTFHFLREEKFWMM

SEQ ID NO: 4511 - protein, 81 aa, Gorilla gorilla
MTMSKEAVTFKDVAVIFTEEELGLLDLAQRKLYRDVMLENFRNLLSVGHQPFHQDTFHFLREEKFWMMDIATQREGNSGGK

SEQ ID NO: 4512 - protein, 81 aa, Gorilla gorilla
MTMSKEAVTFKDVAVIFTEEELGLLDLAQRKLYRDVMLENFRNLLSVGHQPFHQDTFHFLREEKFWMMDIATQREGNSGKK

SEQ ID NO: 4513 - protein, 81 aa, Gorilla gorilla
TFKDVAVIFTEEELGLLDLAQRKLYRDVMLENFRNLLSVGHQPFHQDTFHFLREEKFWMMDIATQREGNSGKKHATVCPCL

SEQ ID NO: 4514 - protein, 81 aa, Gorilla gorilla
MTMSKEAVTFKDVAVIFTEEELGLLDLAQRKLYRDVMLENFRNLLSVGHQPFHQDTFHFLREEKFWMMDIATQREGNSGGS

SEQ ID NO: 4515 - protein, 81 aa, Gorilla gorilla
DVAVIFTEEELGLLDLAQRKLYRDVMLENFRNLLSVGHQPFHQDTFHFLREEKFWMMDIATQREGNSGGSVQASECRNRSK

SEQ ID NO: 4516 - protein, 81 aa, Gorilla gorilla
MLENFRNLLSVGHQPFHQDTFHFLREEKFWMMDIATQREGNSGGKIQPEMKTFPEAGPHEGWSCQQIWEEIASDLTRPQDS

SEQ ID NO: 4517 - protein, 81 aa, Gorilla gorilla
MTMFKEAVTFKDVAVVFTEEELGLLDVSQRKLYRDVMLENFRNLLSVGHQPSHRDTFHFQREEKFWIMETATQREGNSGGK

SEQ ID NO: 4518 - protein, 81 aa, Gorilla gorilla
REEKFWIMETATQREGNSGGKIQTELESVPETGPHEEWSCQQIWEQTASELTRPQDSISSSQFSTQGVVPSQVDAELSIIH

SEQ ID NO: 4519 - protein, 81 aa, Gorilla gorilla
RSNLNRHSMVHMQEKSFRCDTCSNSFGQRSALNSHCMDHTKEKLYKCEECGRSFTCRQDLCKHQMDHTGDKPYNCNVCGKG

SEQ ID NO: 4520 - protein, 80 aa, Gorilla gorilla
MTTFKEAMTFKDVAVVFTEEELGLLDLAQRKLYRDVMLENFRNLLSVGHQAFHRDTFHFLREEKIWMMKTAIQREGNSET

SEQ ID NO: 4521 - protein, 81 aa, Gorilla gorilla
MTMLKEAVTFKDVAVVFTEEELRLLDLAQRKLYREVMLENFRNLLSVGHQSLHRDTFYFLKEEKFWMMETATQREGNLGGK

SEQ ID NO: 4522 - protein, 81 aa, Gorilla gorilla
DLAQRKLYREVMLENFRNLLSVGHQSLHRDTFYFLKEEKFWMMETATQREGNLGGKIQTEMETVSESGTHEGLFSHQTWEQ

SEQ ID NO: 4523 - protein, 81 aa, Gorilla gorilla
RNLLSVGHQSLHRDTFYFLKEEKFWMMETATQREGNLGGKIQTEMETVSESGTHEGLFSHQTWEQISSDLTRFQDSMVNSF

SEQ ID NO: 4524 - protein, 81 aa, Gorilla gorilla
MTMLKEAVTFKDVAVVFTEEELRLLDLAQRKLYREVMLENFRNLLSVGHQSLHRDTFYFLKEEKFWMMETATQREGNLGPA

SEQ ID NO: 4525 - protein, 81 aa, Gorilla gorilla
KDVAVVFTEEELRLLDLAQRKLYREVMLENFRNLLSVGHQSLHRDTFYFLKEEKFWMMETATQREGNLGPAFQIPIKTEGF

SEQ ID NO: 4526 - protein, 81 aa, Gorilla gorilla
MTTFKEGLTFKDVAVVFTEEELGLLDPVQRNLYQDVMLENFRNLLSVGHHPFKHDVFLLEKEKKLDMMKTATQRKGKSADK

SEQ ID NO: 4527 - protein, 81 aa, Gorilla gorilla
MTTFKEGLTFKDVAVVFTEEELGLLDPVQRNLYQDVMLENFRNLLSVGHHPFKHDVFLLEKEKKLDMMKTATQRKGKSDKI

SEQ ID NO: 4528 - protein, 81 aa, Gorilla gorilla
MNMFKEAVTFKDVAVAFTEEELGLLGPAQRKLYRDVMVENFRNLLSVGHQPFKQDTSPIERNEQLWIMTTATRRQGNLGEK

SEQ ID NO: 4529 - protein, 81 aa, Gorilla gorilla
VGHQPFKQDTSPIERNEQLWIMTTATRRQGNLGEKNQSKLITVQDRESEEELSCWQIWQQIANDLTRCQDSMINNSQCHKQ

SEQ ID NO: 4530 - protein, 81 aa, Gorilla gorilla
MNMFKEAVTFKDVAVAFTEEELGLLGPAQRKLYRDVMVENFRNLLSVGHQPFKQDTSPIERNEQLWIMTTATRRQGNLGKN

SEQ ID NO: 4531 - protein, 81 aa, Gorilla gorilla
MNMFKEAVTFKDVAVAFTEEELGLLGPAQRKLYRDVMVENFRNLLSVGHQPFKQDTSPIERNEQLWIMTTATRRQGNLDTL

SEQ ID NO: 4532 - protein, 81 aa, Gorilla gorilla
MVENFRNLLSVGHQPFKQDTSPIERNEQLWIMTTATRRQGNLGEKNQSKLITVQDRESEEELSCWQIWQQIANDLTRCQDS

SEQ ID NO: 4533 - protein, 81 aa, Gorilla gorilla
RNEQLWIMTTATRRQGNLGEKNQSKLITVQDRESEEELSCWQIWQQIANDLTRCQDSMINNSQCHKQGDFPCQVGAELSIQ

SEQ ID NO: 4534 - protein, 81 aa, Gorilla gorilla
IERNEQLWIMTTATRRQGNLGEKNQSKLITVQDRESEEELSCWQIWQQIANDLTRCQDSMINNSQCHKQGDFPCQVGAELS

SEQ ID NO: 4535 - protein, 81 aa, Gorilla gorilla
MTKFQEAVTFKDVAVAFTEEELGLLDSAQRKLYRDVMLENFRNLVSVGHQSFKPDVISQLEREEKLWMKELQTQRGKHSET

SEQ ID NO: 4536 - protein, 81 aa, Gorilla gorilla
MTKFQEAVTFKDVAVAFTEEELGLLDSAQRKLYRDVMLENFRNLVSVGHQSFKPDVISQLEREEKLWMKELQTQRGKHSVW

SEQ ID NO: 4537 - protein, 81 aa, Gorilla gorilla
KFQEAVTFKDVAVAFTEEELGLLDSAQRKLYRDVMLENFRNLVSVGHQSFKPDVISQLEREEKLWMKELQTQRGKHSVWTL

SEQ ID NO: 4538 - protein, 81 aa, Gorilla gorilla
MTKFQEAVTFKDVAVAFTEEELGLLDSAQRKLYRDVMLENFRNLVSVGHQSFKPDVISQLEREEKLWMKELQTQRGKHSGF

SEQ ID NO: 4539 - protein, 81 aa, Gorilla gorilla
AVTFKDVAVAFTEEELGLLDSAQRKLYRDVMLENFRNLVSVGHQSFKPDVISQLEREEKLWMKELQTQRGKHSGFLCCVFS

SEQ ID NO: 4540 - protein, 81 aa, Gorilla gorilla
MTKFQEAVTFKDVAVAFTEEELGLLDSAQRKLYRDVMLENFRNLVSVGHQSFKPDVISQLEREEKLWMKELQTQRGKHSGD

SEQ ID NO: 4541 - protein, 81 aa, Gorilla gorilla
MTKFQEAVTFKDVAVAFTEEELGLLDSAQRKLYRDVMLENFRNLVSVGHQSFKPDVISQLEREEKLWMKELQTQRGDRNQN

SEQ ID NO: 4542 - protein, 81 aa, Gorilla gorilla
RTLPFPRRRRGKMTKFQEAVTFKDVAVAFTEEELGLLDSAQRKLYRDVMLENFRNLVSVGHQSFKPDVISQLEREEKLWMK

SEQ ID NO: 4543 - protein, 81 aa, Gorilla gorilla
GPRSLPFSRKRKRKMTKFQEMVTFKDVAVVFTEEELGLLDSVQRKLYRDVMLENFRNLLLVAHQPFKPDLISQLEREEKLL

SEQ ID NO: 4544 - protein, 81 aa, Gorilla gorilla
MIKFQIQGLHVQERVTFKDVAVVFTKEELALLDKAQINLYQDVMLENFRNLMSVRDGIKNNILNLQAKGLSYLSQEVLHCW

SEQ ID NO: 4545 - protein, 81 aa, Gorilla gorilla
IIIKVEGEDTGSLTIPCQEGVNFKIVTVDFTQEEQGTWNPAQRTLDRDVILENHRDLVSWDLATAVEKKDSASKQRIFDEE

SEQ ID NO: 4546 - protein, 81 aa, Gorilla gorilla
SMEEQDEKPPEPLKACAQEGVNFKIVTVDFTQEEQGTWNPAQRTLDRDVILENHRDLVSWDLATAVEKKDSASKQRIFDEE

SEQ ID NO: 4547 - protein, 81 aa, Gorilla gorilla
MSQDLVTFADVAVNFTKEEWTLLDPAQRNLYRDVMLENSRNLAFIDWATPCKTKDATPQPDILPKRTFPEANRVCLTSISS

SEQ ID NO: 4548 - protein, 81 aa, Gorilla gorilla
PSSASQVAETTGTRPHSRDLVTFADVAVNFTKEEWTLLDPAQRNLYRDVMLENSRNLAFIDWATPCKTKDATPQPDILPKR

SEQ ID NO: 4549 - protein, 81 aa, Gorilla gorilla
LSQKPQVLGPEEQDGSCEASVSFEDVTVDFSREEWQQLDPAQRCLYRDVMLELYSHLFSVGYHIPNPEVIFRMLKEKEPRV

SEQ ID NO: 4550 - protein, 81 aa, Gorilla gorilla
NATIVMSVRREQGSSSGEGSLSFEDVAVGFTREEWQFLDQSQKVLYKEVMLENYSNLVSIGYQGTKPDSLFKLEQGEPPGI

SEQ ID NO: 4551 - protein, 81 aa, Gorilla gorilla
MTKAQESLTLKDVAVDFTWEEWQLLGPAQKHLYRDVMLENYSNLVSVGYQAGKPDALTKLEQGEPLWTLEDEIHSPAHPEI

SEQ ID NO: 4552 - protein, 81 aa, Gorilla gorilla
MLENYSNLVSVGYQASKPDALFKLEQGEPWTVENEIHSQICPEIKKVDNHLQMHSQKQRCLKRVEQCHKRNAFGNIIRQKK

SEQ ID NO: 4553 - protein, 81 aa, Gorilla gorilla
YSNLVSVGYQASKPDALFKLEQGEPWTVENEIHSQICPEIKKVDNHLQMHSQKQRCLKRVEQCHKRNAFGNIIRQKKSDFP

SEQ ID NO: 4554 - protein, 81 aa, Gorilla gorilla
MIQAQESITLEDVAVDFTWEEWQLLGAAQKDLYRDVMLENYSNLVAVGYQASKPDALFKLEQGEQPWTIEDGIHSGACSDI

SEQ ID NO: 4555 - protein, 81 aa, Gorilla gorilla
FAYMSCLVKHKRIHTREKEEAAKVENPPAERHSSLHTSDVMQEKNSANGVTTQVPSVAPQTSLNISGLLANRNVVLVGQPV

SEQ ID NO: 4556 - protein, 81 aa, Gorilla gorilla
MMQAQESLTLEDVAVDFTWEEWQFLSPAQKDLYRDVMLENYRNLVAVGYQASKPDALSKLEREEETCTTEDEIYSRICSDS

SEQ ID NO: 4557 - protein, 81 aa, Gorilla gorilla
MMQAQESLTLEDVAVDFTWEEWQFLSPAQKDLYRDVMLENYRNLVAVGYQASKPDALSKLEREEETCTTEDEIYSRICSEI

SEQ ID NO: 4558 - protein, 81 aa, Gorilla gorilla
MRPEPTKFWEESLTLEDVAVDFTWEEWQFLSPAQKDLYRDVMLENYRNLVAVGYQASKPDALSKLEREEETCTTEDEIYSR

SEQ ID NO: 4559 - protein, 81 aa, Gorilla gorilla
MESLTLEDVAVDFTWEEWQFLSPAQKDLYRDVMLENYRNLVAVGYQASKPDALSKLEREEETCTTEDEIYSRICSDSGGAS

SEQ ID NO: 4560 - protein, 81 aa, Gorilla gorilla
MIKTQESLTLEDVAVEFSWEEWQLLDTAQKNLYRDVMVENYNHLVSLGYQTSKPDVLSKLEHGQEPWITDAKIQNKNCPGI

SEQ ID NO: 4561 - protein, 80 aa, Gorilla gorilla
MIKTQESLTLEDVAVEFSWEEWQLLDTAQKNLYRDVMVENYNHLVSLGYQTSKPDVLSKLEHGQEPWITDAKIQNKNCPD

SEQ ID NO: 4562 - protein, 81 aa, Gorilla gorilla
MINAQELLTLEDVTVEFTWEEWQLLGPFQKNLYRDVMLEIYSNLLSMGYQVSKPDALSKLERGEEPWTMEDERHSRICPEN

SEQ ID NO: 4563 - protein, 81 aa, Gorilla gorilla
MINAQELLTLEDVTVEFTWEEWQLLGPFQKNLYRDVMLEIYSNLLSMGYQVSKPDALSKLERGEEPWTMEDERHSRICPGT

SEQ ID NO: 4564 - protein, 81 aa, Gorilla gorilla
MALPQGSLTFRDVAVEFSQEEWKCLDPVQKALYRDVMLENYRNLGFLGLCLPDLNIISMLEQGKEPWTVVSQVKIARNPNC

SEQ ID NO: 4565 - protein, 81 aa, Gorilla gorilla
EAQERKKKEKEPGMALPQGSLTFRDVAVEFSQEEWKCLDPVQKALYRDVMLENYRNLGFLGLCLPDLNIISMLEQGKEPWT

SEQ ID NO: 4566 - protein, 81 aa, Gorilla gorilla
MALPQGSLTFRDVAVEFSQEEWKCLDPVQKALYRDVMLENYRNLGFLAGLCLPDLNIISMLEQGKEPWTVVSQVKIARNPN

SEQ ID NO: 4567 - protein, 81 aa, Gorilla gorilla
MATQGHLTFKDVAIEFSQEEWKCLEPVQKALYKDVMLENYRNLVFLGISPKCVIKELPPTENSNTGERFQTVALERHQSYD

SEQ ID NO: 4568 - protein, 81 aa, Gorilla gorilla
AQKRKKRKEKESGMALTQGPLTFRDVAIEFSQEEWKSLDPVQKALYWDVMLENYRNLVFLGILPKCMTKELPPIGNTTQEA

SEQ ID NO: 4569 - protein, 81 aa, Gorilla gorilla
AQKRKKRKEKESGMALTQGPLTFRDVAIEFSQEEWKSLDPVQKALYWDVMLENYRNLVFLGILPKCMTKELPPIGNSNTGE

SEQ ID NO: 4570 - protein, 81 aa, Gorilla gorilla
MAQLRRGHLTFRDVAIEFSQEEWKCLDPVQKALYRDVMLENYRNLVSLGICLPDLSIISMMKQRTEPWTVENEMKVAKNPD

SEQ ID NO: 4571 - protein, 81 aa, Gorilla gorilla
EGEAQKRNAEESGIPLTQGHLTFRDVAIEFSQEEWKCLDPVQKALYRDVMLENYRNLVSLGICLPDLSIISMMKQRTEPWT

SEQ ID NO: 4572 - protein, 81 aa, Gorilla gorilla
MLENYRNLVSLGICLPDLSIISMMKQRTEPWTVENEMKVAKNPDRWEDIKDINTGRSCAVRSKAGNKPITNQLGLTFQLPL

SEQ ID NO: 4573 - protein, 81 aa, Gorilla gorilla
MGHLTFRDVAIEFSQEEWKCLDPVQKALYRDVMLENYRNLVSLGICLPDLSIISMMKQRTEPWTVENEMKVAKNPDRWEDI

SEQ ID NO: 4574 - protein, 81 aa, Gorilla gorilla
PWSGESEVKIAKNSDGRECIKGVNTGWGAMAQSWLTAASTSWVQAILLTQPPEQLGLQGAAMHWEAMQKTNQLKNNLEYPF

SEQ ID NO: 4575 - protein, 81 aa, Gorilla gorilla
DEEAQKRKAKESGMALPQGHLTFMDVAIEFSQEEWKSLHPGQRALYRDVMLENYRNLVFLGICLPDLSIISMLKQRREPLT

SEQ ID NO: 4576 - protein, 81 aa, Gorilla gorilla
DEEAQKRKAKESGMALPQGHLTFMDVAIEFSQEEWKSLHPGQRALYRDVMLENYRNLVFLGRSCVLGSNAENKPIKNQLGL

SEQ ID NO: 4577 - protein, 81 aa, Gorilla gorilla
MLRRGHLTFRDVAIEFSQEEWKCLDPAQRTLYREVMLENYRNLVFLGICLPDLSVISMLEQRRDPRNLQSEVKIANNPGGR

SEQ ID NO: 4578 - protein, 81 aa, Gorilla gorilla
MLRRGHLTFRDVAIEFSQEEWKCLDPAQRTLYREVMLENYRNLVFLGICLPDLSVISMLEQRRDPRNLQSEVKIANNPGSC

SEQ ID NO: 4579 - protein, 81 aa, Gorilla gorilla
KEATPKRKEKKSGMALTQGPLKFMDVAIEFSQEEWKCLDPAQRTLYRDVMLENYRNLVSLGICLPDLSVTSMLEQKRDPWT

SEQ ID NO: 4580 - protein, 81 aa, Gorilla gorilla
LYRDVMLENYRNLVSLGICLPDLSVTSMLEQKRDPWTLQSEEKIANDPDGRECIKGVNTDSPLLQCITSVPCVFCTTSMIY

SEQ ID NO: 4581 - protein, 81 aa, Gorilla gorilla
MALTQGQLSFSDVAIEFSQEEWKCLDPGQKALYRDVMLENYRNLISLDFSLLAWDARVFRVEAWRASGGAEEPTGPNFVGN

SEQ ID NO: 4582 - protein, 81 aa, Gorilla gorilla
EEAAQKRKGKEPGMALPQGRLTFRDVAIEFSLAEWKFLNPAQRALYREVMLENYRNLEAVDISSKCTMKEVLSTGQGNREV

SEQ ID NO: 4583 - protein, 81 aa, Gorilla gorilla
EEAAQKRKGKEPGMALPQGRLTFRDVAIEFSLAEWKFLNPAQRALYREVMLENYRNLEAVDISSKRMMKEVLSTGQGNREV

SEQ ID NO: 4584 - protein, 81 aa, Gorilla gorilla
HEEAAQKRKGKEPGMALPQGRLTFRDVAIEFSLAEWKFLNPAQRALYREVMLENYRNLEAVDISSKRMMKEVLSTGQGNRE

SEQ ID NO: 4585 - protein, 81 aa, Gorilla gorilla
MALPQGLLTFRDVTIEFSQEEWKCLDPAQRALYRDVMLENYRNLVSLDTSSKCMMKMFSSTGQGNTEVFHTRTLQIHASHH

SEQ ID NO: 4586 - protein, 81 aa, Gorilla gorilla
KTRKRKRKAKESGMALPQGLLTFRDVTIEFSQEEWKCLDPAQRALYRDVMLENYRNLVSLDTSSKCMMKMFSSTGQGNTEV

SEQ ID NO: 4587 - protein, 81 aa, Gorilla gorilla
MVLPQGLLTFRDVAIEFSQEEWKCLDPAQRTLYRDVMLENYRNLVSLGIFSKCEIKELPPKKESNTGEIFQTVMLERHESR

SEQ ID NO: 4588 - protein, 81 aa, Gorilla gorilla
DPAQRTLYRDVMLENYRNLVSLGIFSKCEIKELPPKKESNTGEIFQTVMLERHESRDIQDFCFRETQKNVHDSQCLWKHDE

SEQ ID NO: 4589 - protein, 81 aa, Gorilla gorilla
AIEFSQEEWKCLDPAQRTLYRDVMLENYRNLVSLGIFSKCEIKELPPKKESNTGEIFQTVMLERHESRDIQDFCFRETQKN

SEQ ID NO: 4590 - protein, 81 aa, Gorilla gorilla
EEAAQKRKGKEPGMALPQGRLTFRDVAIEFSLAEWKFLNPAQRALYREVMLENYRNLESVDISSKRLMKEVLSTGQGNREV

SEQ ID NO: 4591 - protein, 81 aa, Gorilla gorilla
EEAAQKRKGKEPGMALPQGRLTFRDVAIEFSLAEWKFLNPAQRALYREVMLENYRNLESVESHFVTQAGVQWCDPGSLQPL

SEQ ID NO: 4592 - protein, 80 aa, Gorilla gorilla
MLHEEAAQKRKGKEPGMALPQGRLTFRDVAIEFSLAEWKFLNPAQRALYREVMLENYRNLESVEMGFHCVSQDGLNLMTS

SEQ ID NO: 4593 - protein, 81 aa, Gorilla gorilla
EEATQKRKGKEPGMALPQGRLTFRDVAIEFSLAEWKCLNPAQRALYREVMLENYRNLEAVDISSKRMMKEVLSTGQGNTEV

SEQ ID NO: 4594 - protein, 81 aa, Gorilla gorilla
MALPQGRLTFRDVAIEFSLAEWKCLNPAQRALYREVMLENYRNLEAVDISSKRMMKEVLSTGQGNTEVIHTGTLQRHQSYH

SEQ ID NO: 4595 - protein, 81 aa, Gorilla gorilla
MALPQGLLTFSDVAIEFSQEEWKCLDPAQRTLYRDVMLENYRNLVSLDISSKCMMKTFFSTGQGNTEVFHTGTLQRQASHH

SEQ ID NO: 4596 - protein, 81 aa, Gorilla gorilla
MALPQGLLTFSDVAIEFSQEEWKCLDPAQRTLYRDVMLENYRNLVSLEFRSVTQAKVQWCHLSSLQPPLPRFKQFSCLSLP

SEQ ID NO: 4597 - protein, 81 aa, Gorilla gorilla
WKCLDPAQRTLYRDVMLENYRNLVSLEFRSVTQAKVQWCHLSSLQPPLPRFKQFSCLSLPSSWDYRYLFQMHDEDILLNRA

SEQ ID NO: 4598 - protein, 81 aa, Gorilla gorilla
MALPQGLLTFRDVAIEFSQEEWKCLDPAQRTLYRDVMLENYRNLISLDISSKCMLKTLSSTGQDNTEVFHTGTLHRQASHH

SEQ ID NO: 4599 - protein, 81 aa, Gorilla gorilla
MALPQGLLTFRDVAIEFSQEEWKCLDPAQRTLYRDVMLENYRNLISLEFWSVTPAKVQWCHLGSLQPLLPRFKQFSCLSLP

SEQ ID NO: 4600 - protein, 81 aa, Gorilla gorilla
KCLDPAQRTLYRDVMLENYRNLISLEFWSVTPAKVQWCHLGSLQPLLPRFKQFSCLSLPSTCDYRYLFQMHVEDVVINRAR

SEQ ID NO: 4601 - protein, 81 aa, Gorilla gorilla
LEFWSVTPAKVQWCHLGSLQPLLPRFKQFSCLSLPSTCDYRYLFQMHVEDVVINRARQYRSVPHRDIAQTSKSSHWRILFP

SEQ ID NO: 4602 - protein, 81 aa, Gorilla gorilla
MALPQGLLTFRDVAIEFSQEEWKCLDPAQRTLYRDVMLENYRNLISLVRRSEVCCTDIWAEVIVADISSKCMLKTLSSTGQ

SEQ ID NO: 4603 - protein, 81 aa, Gorilla gorilla
MALSQGLLTFRDVAIEFSQEEWKCLGPAQRTLYRDVMLENYRNLVSLGLISRDLCYLRKTPRRQRKGARDGSSSGMLDFQR

SEQ ID NO: 4604 - protein, 81 aa, Gorilla gorilla
MALSQGLLTFRDVAIEFSQEEWKCLGPAQRTLYRDVMLENYRNLVSLDISSKCMMRTLSSTGQGNTEVIHTGTLQRQASYH

SEQ ID NO: 4605 - protein, 81 aa, Gorilla gorilla
MALSQGLLTFRDVAIEFSQEEWKCLGPAQRTLYRDVMLENYRNLVSLGQGNTEVIHTGTLQRQASYHIGAFCSQEIEKDIH

SEQ ID NO: 4606 - protein, 81 aa, Gorilla gorilla
MALPQGLLTFRDVAIEFSQEEWKCLDPAQRTLYRDVMLENYRNLVSLDISSKCIMKEFSSIGKGNTEVIHTGTLQRLASHH

SEQ ID NO: 4607 - protein, 81 aa, Gorilla gorilla
EEATKKSKEKEPGMALPQGRLTFRDVAIEFSLEEWKCLNPVQRALYRAVMLENYRNLEFVDISSKCMMKVFSSTAQGNREV

SEQ ID NO: 4608 - protein, 81 aa, Gorilla gorilla
TGSTDRHDQRHAGNKPIKGQLGSSFHSHLPEHIFQPEWEIGNQVEKSIINASLILTSQRISCSPKTHISNNYGNNSLHSSL

SEQ ID NO: 4609 - protein, 81 aa, Gorilla gorilla
EEATKKSKEKEPGMALPQGRLTFRDVAIEFSLEEWKCLNPVQRALYRAVMLENYRNLEFVDSSLKSMMEFSSTGHGNTGEV

SEQ ID NO: 4610 - protein, 81 aa, Gorilla gorilla
EEATKKSKEKEPGMALPQGRLTFRDVAIEFSLEEWKCLNPVQRALYRAVMLENYRNLEFVGEENVPPGMRNLHLSIFALSG

SEQ ID NO: 4611 - protein, 81 aa, Gorilla gorilla
MALTQVRLTFRDVAIEFSQEEWKCLDPAQRILYRDVMLENYWNLVSLGLCHFDMNIISMLEEGKEPWTVKSCVKIARKPRM

SEQ ID NO: 4612 - protein, 81 aa, Gorilla gorilla
LTFRDVAIEFSQDEWKCLNSTQRTLYRDVMLENYRNLVSLDLSRNCVIKELAPQQEGNPGEVFHTVTLEQHEKHDIEEFCF

SEQ ID NO: 4613 - protein, 81 aa, Gorilla gorilla
LTFRDVAIEFSQDEWKCLNSTQRTLYRDVMLENYRNLVSLEYYPMWEHRKEPWTIESQVQIARKPKGWEWIKGVKTGWSAM

SEQ ID NO: 4614 - protein, 81 aa, Gorilla gorilla
MLVRLVSTSQPQLTFRDVAIEFSQDEWKCLNSTQRTLYRDVMLENYRNLVSLDLSRNCVIKELAPQQEGNPGEVFHTVTLE

SEQ ID NO: 4615 - protein, 81 aa, Gorilla gorilla
MALPQGQLTFKDVAIEFSQEEWTCLDPAQKTLYRDVMLENYRNLVSLDISCKCVNTDLPPKGKNDMGEAFYTVKLERLESC

SEQ ID NO: 4616 - protein, 81 aa, Gorilla gorilla
MALSQGRLTFRDVAIEFSQEEWKCLDSAQRALYRDVMLENYRNLVSLGISPSEMSITSMLGQGKEPWTVESEVKITKTSNS

SEQ ID NO: 4617 - protein, 81 aa, Gorilla gorilla
RALYRDVMLENYRNLLSLDEDNIPPENDISVGFTSKGLSPKENNKEELYHLVISERKESHGINNFDLKEVWENMPKFDSLW

SEQ ID NO: 4618 - protein, 80 aa, Gorilla gorilla
MALSQGLFTFKDVAIEFSQEEWECLDPAQRALYRDVMLENYRNLLSLDEDNIPPENAFYSVRELRETLVFLIPYSSKICL

SEQ ID NO: 4619 - protein, 81 aa, Gorilla gorilla
MALSQGLLTFRDVAIEFSQEEWKCLDPAQRTLYRDVMLENYRNLVSLDISSKCMMKEVSSTAQGNTEVIHTGTLQRHEHHH

SEQ ID NO: 4620 - protein, 81 aa, Gorilla gorilla
MALPQGLLTFRDVAIEFSQEEWKCLDPAQRTLYRDVMLENYRNLVSLGSCCVVEVGLDLLVSRHPPWPPKKLGLQAPTPVP

SEQ ID NO: 4621 - protein, 81 aa, Gorilla gorilla
MALPQGLLTFRDVAIEFSQEEWKCLDPAQRTLYRDVMLENYRNLVSLDISSKCTMKEFLSTAQGNREVFHAGTSQRHESHH

SEQ ID NO: 4622 - protein, 81 aa, Gorilla gorilla
MALPQGLLTFRDVAIEFSQEEWKCLDPAQRTLYRDVMLENYRNLVSLDISSKCMMKEVSSTAQGNREVIHTGTLQRHESHH

SEQ ID NO: 4623 - protein, 81 aa, Gorilla gorilla
MALPQGLLTFRDVAIEFSQEEWKCLDPAQRTLYRDVMLENYRNLVSLDTGFLLFCLADLKLLPSGDPSTSASETAAITDIS

SEQ ID NO: 4624 - protein, 81 aa, Gorilla gorilla
MAQGLVTFADVAIDFSQEEWACLNSAQRDLYWDVMLENYSNLVSLDLESAYENKSLPTEKNIHEIRASKRNSDRRSKSLGR

SEQ ID NO: 4625 - protein, 81 aa, Gorilla gorilla
DTKELFPKQHVYEVESPQWEIMESLTSYGLECSSFQDDWECRNQFDRQQGNPDRHFHQMIIRHEEMPTFDQHASLTFYQKI

SEQ ID NO: 4626 - protein, 81 aa, Gorilla gorilla
MSKDLVTFGDVAVNFSQEEWEWLNPAQRNLYRKVMLENYRSLVSLGVSVSKPDVISLLEQGKEPWMVKKEGTRGPCPGWEY

SEQ ID NO: 4627 - protein, 81 aa, Gorilla gorilla
ITHKEILPEVQNKAYNKSWQTFHQDTIFDIQQSFPTKEKAHKHEPQKKSYRKKSVEMKHRKVYVEKKLLKCNDCEKVFNQS

SEQ ID NO: 4628 - protein, 81 aa, Gorilla gorilla
ILTGEERMPSARGKSKSKAPITFGDLAIYFSQEEWEWLSPIQKDLYEDVMLENYRNLVSLGLSFRRPNVITLLEKGKAPWM

SEQ ID NO: 4629 - protein, 81 aa, Gorilla gorilla
RPEEKAKMNVEVVKVMPQDLVTFKDVAIDFSQEEWQWMNPAQKRLYRSMMLENYQSLVSLGLCISKPYVISLLEQGREPWE

SEQ ID NO: 4630 - protein, 81 aa, Gorilla gorilla
NKKLEAVGTGIGPKTMSQGLVTFGDVAVDFSQEEWEWLNPIQRNLYRKVMLENYRNLASLGLCVSKPDVISSLEQGKEPWT

SEQ ID NO: 4631 - protein, 81 aa, Gorilla gorilla
MAAQLLTDDALESVTFRDVTVDFTQEEWQQLEPAQKDLYRDVMLENYRNLVSLDWETRPEMKELDPKNDILEDKLSVVGVA

SEQ ID NO: 4632 - protein, 81 aa, Gorilla gorilla
AGSQFLDFKHLGTFLVFEELVTFEDVFVDFSPEELSSLSAAQRNLYREVMLENYRNLVSLGHQFSKPDIISRLEEEESHAM

SEQ ID NO: 4633 - protein, 81 aa, Gorilla gorilla
MNNSQGRVTFEDVTVNFTQGEWQWLNPEQRNLYRDVMLENYSNLVSVGQEETTKPDVILRLEQGKEPWLVEEEVLGSGRAE

SEQ ID NO: 4634 - protein, 81 aa, Gorilla gorilla
MAMALTDPAQVSVTFDDVAVTFTQEEWGQLDLAQRTLYQEVMLENCGLLVSLGCPVPRAELIYHLEHEQEPWTRKEDLSQG

SEQ ID NO: 4635 - protein, 81 aa, Gorilla gorilla
MAASAQVSVTFEDVAVTFTQEEWGQLDAAQRTLYQEVMLETWGLLMSLGCPLFKPELIYQLDHRQELWMVTKDLSQSSYPG

SEQ ID NO: 4636 - protein, 81 aa, Gorilla gorilla
MAAAVLMDRVQSCVTFEDVFVYFSREEWELLEEAQRFLYRDVMLENFALVATLGFWCEAEHEAPSEQSVFVEGVSQVRTAE

SEQ ID NO: 4637 - protein, 81 aa, Gorilla gorilla
MLMDAGQDYMVFEDVAIHFSQEEWGILNDVQRHLHSDVMLENFALLSSVGCWHGAKDEEAPSKQCVSVGVSLVTTLKPALS

SEQ ID NO: 4638 - protein, 81 aa, Gorilla gorilla
MNLTEDYMVFEDVAIHFSQEEWGILNDVQRHLHSDVMLENFALLSSVGCWHGAKDEEAPSKQCVSVGVSLVTTLKPALSTQ

SEQ ID NO: 4639 - protein, 81 aa, Gorilla gorilla
MNLTQDCMVFEDVAIYFSQEEWGILNDAQRHLHSNVMLENFTLLSSVGCWHGAKDEEVPSKQCVSVRVLQVTTALSTLKAQ

SEQ ID NO: 4640 - protein, 81 aa, Gorilla gorilla
MGPAQVPMNSEVIVDPIQGQVNFEDVFVYFSQEEWVLLDEAQRLLYRDVMLENFALMASLGCWHGMEDEEIPFEQSFSIGM

SEQ ID NO: 4641 - protein, 81 aa, Gorilla gorilla
MAAAALRDPAQQGYVTFEDVAVYFSQEEWRLLDDAQRLLYCNVMLENFTLLASLGLASSKTHEITQLESWEEPFMPAWEVV

SEQ ID NO: 4642 - protein, 81 aa, Gorilla gorilla
MAAAALRDPAQGYVTFEDVAVYFSQEEWRLLDDAQRLLYCNVMLENFTLLASLGLASSKTHEITQLESWEEPFMPAWEVVT

SEQ ID NO: 4643 - protein, 81 aa, Gorilla gorilla
DPAQVPVAAELLTDHEEQGYVTFEDVAVYFSQEEWRLLDDAQRLLYCNVMLENFTLLASLGKVLTPHPSILSWAWLFLLFL

SEQ ID NO: 4644 - protein, 81 aa, Gorilla gorilla
MAAAALRDPAQGYVTFEDVAVYFSQEEWRLLDDAQRLLYCNVMLENFTLLASLGKVLTPHPSILSWAWLFLLFLGRGVFFP

SEQ ID NO: 4645 - protein, 81 aa, Gorilla gorilla
DPAQVPVAAELLTDHEEQGYVTFEDVAVYFSQEEWRLLDDAQRLLYCNVMLENFTLLASLGLASSKTHEITQLESWEEPFM

SEQ ID NO: 4646 - protein, 81 aa, Gorilla gorilla
RDPAQVPVAAELLTDHEEGYVTFEDVAVYFSQEEWRLLDDAQRLLYCNVMLENFTLLASLGLASSKTHEITQLESWEEPFM

SEQ ID NO: 4647 - protein, 81 aa, Gorilla gorilla
DPAQVPVAAELLTDHEEQGYVTFEDVAVYFSQEEWRLLDDAQRLLYCNVMLENFTLLASLGCWHGAEAEEAPEQIASVGLL

SEQ ID NO: 4648 - protein, 81 aa, Gorilla gorilla
RDPAQVPVAAELLTDHEEGYVTFEDVAVYFSQEEWRLLDDAQRLLYCNVMLENFTLLASLGKVLTPHPSILSWAWLFLLFL

SEQ ID NO: 4649 - protein, 81 aa, Gorilla gorilla
MAAAALRDPAQQGYVTFEDVAVYFSQEEWRLLDDAQRLLYCNVMLENFTLLASLGCWHGAEAEEAPEQIASVGLLSSNVQQ

SEQ ID NO: 4650 - protein, 81 aa, Gorilla gorilla
MAAAALRDPAQGYVTFEDVAVYFSQEEWRLLDDTQRLLYRNVMLENFTLLASLGLASSKTHEITQLESWEEPFMPAWEVVT

SEQ ID NO: 4651 - protein, 81 aa, Gorilla gorilla
MAAAALRDPAQQGYVTFEDVAVYFSQEEWRLLDDTQRLLYRNVMLENFTLLASLGLASSKTHEITQLESWEEPFMPAWEVV

SEQ ID NO: 4652 - protein, 81 aa, Gorilla gorilla
MAEAALVNMPQGHVTFEDIAVYFSQEEWGLLDESQRCLYHDVMLENFSLMASVGCLHGIEAEEAPSEQTVSAQGVSQARTP

SEQ ID NO: 4653 - protein, 81 aa, Gorilla gorilla
VNMPQIPMVTEEFVKPSQGHVTFEDIAVYFSQEEWGLLDESQRCLYHDVMLENFSLMASVGCLHGIEAEEAPSEQTVSAQG

SEQ ID NO: 4654 - protein, 81 aa, Gorilla gorilla
LVNMPQIPMVTEEFVKPSQGHVTFEDIAVYFSQEEWGLLDESQRCLYHDVMLENFSLMASVAGLSQSNHKDSCSQQKVPVS

SEQ ID NO: 4655 - protein, 81 aa, Gorilla gorilla
MQGHVTFEDIAVYFSQEEWGLLDESQRCLYHDVMLENFSLMASVGCLHGIEAEEAPSEQTVSAQGVSQARTPKLGPSIPNA

SEQ ID NO: 4656 - protein, 81 aa, Gorilla gorilla
MLVTFKDVAVTFTREEWRQLDLAQRTLYREVMLETCGLLVSLGHRVPKPELVHLLEHGQELWIVKRGLSHATCAGDRAQVH

SEQ ID NO: 4657 - protein, 81 aa, Gorilla gorilla
RDSTSVPMTAEAKLMGFTQGCVTFEDVAIYFSQEEWGLLDEAQRLLYRDVMLENFALITALVCWHGMEDEETPEQSVSVEG

SEQ ID NO: 4658 - protein, 81 aa, Gorilla gorilla
MAAALRAPTRQGFVAFEDVAIYFSQEEWELLDEMQRLLYRDVMLENFAVMASLGCWCGAVDEGAPSAESVSVEELSQGRTP

SEQ ID NO: 4659 - protein, 81 aa, Gorilla gorilla
VQLRPQTRMATALMDPASGSVTFEDVAVYFSWEEWDLLDEAQKHLYFDVMLENFALTSSLGLTSSWSHVVAQLGLGEVPSV

SEQ ID NO: 4660 - protein, 81 aa, Gorilla gorilla
MDPASVPIATEVLFKLTEGSVTFEDVAVYFSWEEWDLLDEAQKHLYFDVMLENFALTSSLGCWCGVEHEETPSEQRISGER

SEQ ID NO: 4661 - protein, 81 aa, Gorilla gorilla
VQLRPQTRMATALMDPASGSVTFEDVAVYFSWEEWDLLDEAQKHLYFDVMLENFALTSSLGCWCGVEHEETPSEQRISGER

SEQ ID NO: 4662 - protein, 81 aa, Gorilla gorilla
MDPASVPIATEVLFKLTEGSVTFEDVAVYFSWEEWDLLDEAQKHLYFDVMLENFALTSSLGLTSSWSHVVAQLGLGEVPSV

SEQ ID NO: 4663 - protein, 81 aa, Gorilla gorilla
SPPSPRSSMAAVTLRDSAQGMTFEDVAIYFSQEEWELLDESQRFLYCDVMLENFAHVTSLGYCHGMENEAIASEQSVSIQV

SEQ ID NO: 4664 - protein, 81 aa, Gorilla gorilla
MAAVTLRDSAQGTVTFEDVAVNFSQEEWSLLSEAQRCLYHDVMLENLTLISSLGCWYGAKDETPSKQTLSIQQESPLRTHW

SEQ ID NO: 4665 - protein, 81 aa, Gorilla gorilla
MAAATLRTPAQGTVTFEDVAVHFSWEEWGLLDEAQRCLYRDVMLENLALLTSLDVHHQKQHLGEKHFRSNVGRALFVKTCT

SEQ ID NO: 4666 - protein, 81 aa, Gorilla gorilla
PAAVRAHGSMAELTDSARGCVVFEDVFVYFSREEWELLDDAQRLLYHDVMLENFALLASLGIAFSRSRAVMKLERGEEPWV

SEQ ID NO: 4667 - protein, 81 aa, Gorilla gorilla
MAAAAPRPPAQGTVTFEDVAVNFSQEEWSLLSEAQRCLYHDVMLENLTLISSLGCWYGAKDETPSKQTLSIQQESPLRTHW

SEQ ID NO: 4668 - protein, 81 aa, Gorilla gorilla
MAAAAALRAPAQSSVTFEDVAVNFSLEEWSLLNEAQGCLYHDVMLETLTLISSLGGVPPHRLFPTGACGPQVPSSRIRPSA

SEQ ID NO: 4669 - protein, 81 aa, Gorilla gorilla
MAAAAPRRPTQGTVTFEDVAVKFTQEEWNLLSEAQRCLYHDVTLENLALMSSLGCWCGVEDEAAPSKQSIYIQRETQVRTP

SEQ ID NO: 4670 - protein, 81 aa, Gorilla gorilla
MAVAATLRLSAQGTVTFEDVAVKFTQEEWNLLSEAQRCLYHDVTLENLALMSSLGCWCGVEDEAAPSKQSIYIQRETQVRT

SEQ ID NO: 4671 - protein, 81 aa, Gorilla gorilla
MAAAAPRRPTQGTVTFEDVAVNFSQEEWCLLSEVQRCLYRDVMLENLALISSLGCWCGSKDEEAPCKQSISVQRESQSRTP

SEQ ID NO: 4672 - protein, 81 aa, Gorilla gorilla
MAAAAPRRPTQQGTVTFEDVAVNFSQEEWCLLSEVQRCLYRDVMLENLALISSLGCWCGSKDEEAPCKQSISVQRESQSRT

SEQ ID NO: 4673 - protein, 81 aa, Gorilla gorilla
MAAAAKLRLSAQGTVTFEDVAVNFTWEEWNLLSEAQRCLYRDVTLENLALISSLDPALDGSADNTQTGNLGQSVLPSHPEQ

SEQ ID NO: 4674 - protein, 81 aa, Gorilla gorilla
WCDHGLPQPPPTGDILIQGTVTFEDVAVNFTWEEWNLLSEAQRCLYRDVTLENLALISSLDPALDGSADNTQTGNLGQSVL

SEQ ID NO: 4675 - protein, 81 aa, Gorilla gorilla
MAAAAKLRLSAQGTVTFEDVAVNFTWEEWNLLSEAQRCLYRDVTLENLALISSLGMTFLHVCQALDSTSGDPPTSASQRAG

SEQ ID NO: 4676 - protein, 81 aa, Gorilla gorilla
MAAAAKLRLSAQGTVTFEDVAVNFTWEEWNLLSEAQRCLYRDVTLENLALISSLGCWCGVEDEAAPSKQSIYIQRETQVRT

SEQ ID NO: 4677 - protein, 81 aa, Gorilla gorilla
MAAAAPRRPTQGTVTFEDVAVNFSQEEWCLLSEAQRCLYRDVMLENLALISSLGCWCGSKDEEAPCKQSISIVLCHLCQFL

SEQ ID NO: 4678 - protein, 81 aa, Gorilla gorilla
MQSTVAFEDVAVNFSQEEWSLLSEVQRCLYHDVMLENWVLISSLGCWCGSEDEEAPSKKSISIQRVSQVSTPGAGVSPKKA

SEQ ID NO: 4679 - protein, 81 aa, Gorilla gorilla
HRMTWDYIAIGSHENSVQSTVAFEDVAVNFSQEEWSLLSEVQRCLYHDVMLENWVLISSLGCWCGSEDEEAPSKKSISIQR

SEQ ID NO: 4680 - protein, 81 aa, Gorilla gorilla
MQSTVAFEDVAVNFSQEEWSLLSEVQRCLYHDVMLENWVLISSLGCWCGSEDEEAPSKKSISIQRVSQSLHLSAQAGVARS

SEQ ID NO: 4681 - protein, 81 aa, Gorilla gorilla
MQQSTVAFEDVAVNFSQEEWSLLSEVQRCLYHDVMLENWVLISSLGCWCGSEDEEAPSKKSISIQRVSQVSTPGAGVSPKK

SEQ ID NO: 4682 - protein, 81 aa, Gorilla gorilla
MAAAELTAPAQGIVTFEDVAVYFSWKEWGLLDEAQKCLYHDVMLENLTLTTSLGGSGAGDEEAPYQRSTSPQRVSQVRIPK

SEQ ID NO: 4683 - protein, 81 aa, Gorilla gorilla
RRRSVGCWCRGLCLAVRREQVTFEDVVVDFSQEEWGQLKPAQRTLYHDVMLDTFRLLVSVGHWLPKPNVISLLEQEAELWA

SEQ ID NO: 4684 - protein, 81 aa, Gorilla gorilla
MTPGVRVSTDPEQVTFEDVVVDFSQEEWGQLKPAQRTLYHDVMLDTFRLLVSVGHWLPKPNVISLLEQEAELWAVDSGLPQ

SEQ ID NO: 4685 - protein, 81 aa, Gorilla gorilla
MTPGVRVSTDPEQVTFEDVVVDFSQEEWGQLKPAQRTLYHDVMLDTFRLLVSVERLLWRRQDNCLGCLSCDQDQQKRQGHW

SEQ ID NO: 4686 - protein, 81 aa, Gorilla gorilla
QAEKQEDAAICPVTVLPEEPVTFQDVAVDFSREEWGLLGPTQRTEYRDVMLETFGHLVSVGWETTLENKELAPNSDIPEEE

SEQ ID NO: 4687 - protein, 81 aa, Gorilla gorilla
MEACSMLVPPQASVCFEDVAMAFTQEEWEQLDLAQRTLYREVTLETWEHIVSLGLFLSKSDVISQLEQEEDLCRAEQEAPR

SEQ ID NO: 4688 - protein, 81 aa, Gorilla gorilla
EDVAMAFTQEEWEQLDLAQRTLYREVTLETWEHIVSLGLFLSKSDVISQLEQEEDLCRAEQEAPRDGVSLLLPRLECNGTI

SEQ ID NO: 4689 - protein, 81 aa, Gorilla gorilla
EDVAMAFTQEEWEQLDLAQRTLYREVTLETWEHIVSLGLFLSKSDVISQLEQEEDLCRAEQEAPRGTRPSKKQRRYRARRI

SEQ ID NO: 4690 - protein, 81 aa, Gorilla gorilla
MEACSMLVPPQASVCFEDVAMAFTQEEWEQLDLAQRTLYREVTLETWEHIVSLDWKATLEENRLNSEKDRAREELSHHVEV

SEQ ID NO: 4691 - protein, 81 aa, Gorilla gorilla
GPAQHTSWPCGSAVPTLKSMVTFEDVAVYFSQEEWELLDAAQRHLYHSVMLENLELVTSLGCWHGVEGEEAHPEQNVSVEV

SEQ ID NO: 4692 - protein, 81 aa, Gorilla gorilla
PTLKSMVTFEDVAVYFSQEEWELLDAAQRHLYHSVMLENLELVTSLGNALSQHDVFTCSGEADLPNCFPNWLHHFTPLSAV

SEQ ID NO: 4693 - protein, 81 aa, Gorilla gorilla; identical to SEQ ID NO: 2425

SEQ ID NO: 4694 - protein, 81 aa, Gorilla gorilla
MTFEDVAVYFSQEEWGLLDTAQRALYRHVMLENFTLVTSLGLSTSRPRVVIQLERGEEPWVPSGKDMTLARNTYGRLNSGE

SEQ ID NO: 4695 - protein, 81 aa, Gorilla gorilla
PLAVQSPEGHHGHQEPASTSFQPPRIQEEWGLLDRSQKELYWDVMLEKYGTVVSLGLPPHQPEAQAQSELGMLLTGTGVCR

SEQ ID NO: 4696 - protein, 81 aa, Gorilla gorilla
LPSNDTDCPQKKEGKAQIVVPVTFRDVTVIFTEAEWKRLSPEQRNLYKEVMLENYRNLLSLAEPKPEFYTCSSCLLALSCQ

SEQ ID NO: 4697 - protein, 81 aa, Gorilla gorilla
PSNDTDCPQKKEGKAQIVVPVTFRDVTVIFTEAEWKRLSPEQRNLYKEVMLENYRNLLSLDGVSLLLPRLECSRALCLPGS

SEQ ID NO: 4698 - protein, 81 aa, Gorilla gorilla
AKGLPSNDTDCPQKKEGKAQIVVPVTFRDVTVIFTEAEWKRLSPEQRNLYKEVMLENYRNLLSLGQEIETILANTVKSHLY

SEQ ID NO: 4699 - protein, 81 aa, Gorilla gorilla
MLENYSNLVSVGYHVSKPDVIFKLEQGEEPWIVEEFSNQNYPDVDDALEKNNEIQDKHLTQTVFFSNKTLITERENVFVKT

SEQ ID NO: 4700 - protein, 81 aa, Gorilla gorilla
MAAVSPTTRCQESVTFEDVAVVFTDEEWSHLVPIQRDLYKEVMLENYNSIVSLGLPVPQPDVIFQMKRGDKPWMVDLHGSE

SEQ ID NO: 4701 - protein, 81 aa, Gorilla gorilla
EEAAQKRKQKEPGMALPQGHLTVRDVAIEFSLEEWKCLDPTQRALYRAVMLENYRNLHSVDISSKCMMKKFSSTGQGNTEV

SEQ ID NO: 4702 - protein, 81 aa, Gorilla gorilla
MLQTVWFQGLSRNLLFQEPVTFEDVAVYFTQNEWASLHPTQRALYREVMLENYANVTSLYPTAGGFPLDTERTEKVPGALS

SEQ ID NO: 4703 - protein, 81 aa, Gorilla gorilla
MLQTVWFQGLSRNLLFQEPVTFEDVAVYFTQNEWASLHPTQRALYREVMLENYANVTSLSAFPFPKPDLIFQLEQGEAAWG

SEQ ID NO: 4704 - protein, 81 aa, Gorilla gorilla
MLQTVWFQEPVTFEDVAVYFTQNEWASLHPTQRALYREVMLENYANVTSLSAFPFPKPDLIFQLEQGEAAWGPDPWTLAGG

SEQ ID NO: 4705 - protein, 81 aa, Gorilla gorilla
MFQTAWRQEPVTFEDVAVYFTQNEWASLDSVQRALYREVMLENYANVASLAFPFITPVLVSQLEQGELPWGLNPWEPMGRE

SEQ ID NO: 4706 - protein, 81 aa, Gorilla gorilla
EGCPGDQVTPTRSLTAQLQETMTFKDVEVTFSQDEWGWLDSAQRNLYRDVMLENYRNMASLVGPFTRPALISWLEAREPWG

SEQ ID NO: 4707 - protein, 81 aa, Gorilla gorilla
AGQSDTPAAQMPAIFPREGCPGDQVTPTRSLTAQLQETMTFKDVEVTFSQDEWGWLDSAQRNLYRDVMLENYRNMASLGKY

SEQ ID NO: 4708 - protein, 81 aa, Gorilla gorilla
MVRPQDTVAYEDLSEDYTQKKWKGLALSQRALHWNMMLENDRSMASLAGRNMMESSELTPKQKIFKGSESSNSTSGGLFGV

SEQ ID NO: 4709 - protein, 81 aa, Gorilla gorilla
MVRPQDTVAYEDLSEDYTQKKWKGLALSQRALHWNMMLENDRSMASLGRNMMESSELTPKQKIFKGSESSNSTSGGLFGVV

SEQ ID NO: 4710 - protein, 81 aa, Gorilla gorilla
YNSSLMVHQRTHTGEKPYKCNSCGKAFSDSSQLTVHQRVHTGKNLMNVLSVGKPLVSVPLLITTSELMLERSPQVWLGHLL

SEQ ID NO: 4711 - protein, 81 aa, Gorilla gorilla
VGNSGDQAGATVLRMVRPQDTVAYEDLSVDYTQKKWKGLTLSQRALQWNMMPENHYSMASLAGENVMKGSELTPKQEIFKG

SEQ ID NO: 4712 - protein, 81 aa, Gorilla gorilla
DFAQCASPVPTLPQVGNSGDQAGATVLRMVRPQDTVAYEDLSVDYTQKKWKGLTLSQRALQWNMMPENHYSMASLGWSTMA

SEQ ID NO: 4713 - protein, 81 aa, Gorilla gorilla
GNSGDQAGATVLRMVRPQDTVAYEDLSVDYTQKKWKGLTLSQRALQWNMMPENHYSMASLGENVMKGSELTPKQEIFKGSE

SEQ ID NO: 4714 - protein, 81 aa, Gorilla gorilla
TLPQVGNSGDQAGATVLRMVRPQDTVAYEDLSVDYTQKKWKGLTLSQRALQWNMMPENHYSMASLDGETGTEEELIPKHHS

SEQ ID NO: 4715 - protein, 81 aa, Gorilla gorilla
EALPAKDSAWPWEEKPRYLGPVTFEDVAVLFTEAEWKRLSLEQRNLYKEVMLENLGNLVSLVLELGSPRSGLLPLDLDLWL

SEQ ID NO: 4716 - protein, 80 aa, Gorilla gorilla
MWAPREQLLGWATEALPAKDSAWPWEEKPRYLGPVTFEDVAVLFTEAEWKRLSLEQRNLYKEVMLENLGNLVSLVLSYQI

SEQ ID NO: 4717 - protein, 81 aa, Gorilla gorilla
EALPAKDSAWPWEEKPRYLGPVTFEDVAVLFTEAEWKRLSLEQRNLYKEVMLENLGNLVSLAESKPEVHTCPSCPLAFGSQ

SEQ ID NO: 4718 - protein, 81 aa, Gorilla gorilla
ALPAKDSAWPWEEKPRYLGPVTFEDVAVLFTEAEWKRLSLEQRNLYKEVMLENLGNLVSLESKPEVHTCPSCPLAFGSQQF

SEQ ID NO: 4719 - protein, 81 aa, Gorilla gorilla
VSSVLWVFQELQETNKSLDLVSFEEVAVHFTWEEWQDLDDAQRTLYGDVMLETYSSLVSLGHCITKPEMIFKLEQGAEPWI

SEQ ID NO: 4720 - protein, 81 aa, Gorilla gorilla
MFPVSSGCQELQETNKSLDLVSFEEVAVHFTWEEWQDLDDAQRTLYGDVMLETYSSLVSLGHCITKPEMIFKLEQGAEPWI

SEQ ID NO: 4721 - protein, 81 aa, Gorilla gorilla
SIKVFTRGRNPINVANVEKPSVRSQSSLYIIEPIPEKNLMNVMSVGKPCQKSNLSTHQGTHSGEKPYECDECRKTFYDKTV

SEQ ID NO: 4722 - protein, 81 aa, Gorilla gorilla
MDLLTFRDVAIEFSPEEWKCLDPAQQNLYRDVMLENYRNLVSLGFVISNPDLVTCLEQIKEPCNLKIHETAARPPAIYSPF

SEQ ID NO: 4723 - protein, 81 aa, Gorilla gorilla
MDLLTFRDVAIEFSPEEWKCLDPAQQNLYRDVMLENYRNLVSLGFVISNPDLVTCLEQIKEPCNLKIHETAARPPVVQHFW

SEQ ID NO: 4724 - protein, 81 aa, Gorilla gorilla
MELLTFKDVAIEFSPEEWKCLDPSQQNLYRDVMLENYRNLVSLGVTISNPDLVTCLEQRKEPYNLKIHETAASPPAVCSHF

SEQ ID NO: 4725 - protein, 81 aa, Gorilla gorilla
MELLTFKDVAIEFSPEEWKCLDPSQQNLYRDVMLENYRNLVSLGVTISNPDLVTCLEQRKEPYNLKIHETAASPPGHYRKR

SEQ ID NO: 4726 - protein, 81 aa, Gorilla gorilla
MLENYRNLVSLGVTISNPDLVTCLEQRKEPYNLKIHETAASPPAVCSHFTPNLWTVQGIEDSFHKLIPKGHEKRGHENLRK

SEQ ID NO: 4727 - protein, 81 aa, Gorilla gorilla
MELLTFRDVAIEFSPEEWKCLDPAQQNVYRDVMLENYRNLVSLGGLPRRTLYELLRSVYILLLLRSILYGSLRHNCRIVLQ

SEQ ID NO: 4728 - protein, 81 aa, Gorilla gorilla
MELLTFRDVAIEFSPEEWKCLDPAQQNLYRDVMLENYRNLVSLGVAISNPDLVIYLEQRKEPYKVKIHETVAKHPAVCSHF

SEQ ID NO: 4729 - protein, 81 aa, Gorilla gorilla
ELLTFRDVAIEFSPEEWKCLDPAQQNLYRDVMLENYRNLVSLGVAISNPDLVIYLEQRKEPYKVKIHETVAKHPAVCSHFT

SEQ ID NO: 4730 - protein, 81 aa, Gorilla gorilla
MELLTFRDVAIEFSPEEWKCLDPDQQNLYRDVMLENYRNLVSLGVAISNPDLVTCLEQRKEPYNVKIHKIVARPPAVCSHS

SEQ ID NO: 4731 - protein, 81 aa, Gorilla gorilla
ADTSSSGLLEEQKMMKSQGLVSFKDVAVDFTQEEWQQLDPSQRTLYRDVMLENYSHLVSMGYPVSKPDVISKLEQGEEPWI

SEQ ID NO: 4732 - protein, 81 aa, Gorilla gorilla
MAAGQREARPQVSLTFEDVAVLFTRDEWRKLAPSQRNLYRDVMLENYRNLLSLGLPFTKPQVISLLQQGEDPWEVEKEGSG

SEQ ID NO: 4733 - protein, 81 aa, Gorilla gorilla
MAAGQREARPQVSLTFEDVAVLFTRDEWRKLAPSQRNLYRDVMLENYRNLLSLGLSFTKPKVISLLQQGEDPWELEKDSSG

SEQ ID NO: 4734 - protein, 81 aa, Gorilla gorilla
GRGCVGRRCSRSCWERFQESVTFKDVSIDFSWEEWIQADSAQRMTVYGEVMLENYRNPVSLAGNHLSKPNGTSQLEREELS

SEQ ID NO: 4735 - protein, 81 aa, Gorilla gorilla
GRGCVGRRCSRSCWERFQESVTFKDVSIDFSWEEWIQADSAQRMTVYGEVMLENYRNPVSLGNHLSKPNGTSQLEREELSL

SEQ ID NO: 4736 - protein, 81 aa, Gorilla gorilla
MAVDLLSAQERVTFRDVAVFFSQDEWLHLDSAQRALYREVMLENYSILVSLGIPFSMPKLIHQLQQGEDPCMVEREVPSDT

SEQ ID NO: 4737 - protein, 81 aa, Gorilla gorilla
MGIDGLPGCGCGLHQKEWKLLSSAQRTLYREVMLENYSHLVSLGIAFSKPKLIEQLEQGDEPWREENKHLLDLCPEPRTEF

SEQ ID NO: 4738 - protein, 81 aa, Gorilla gorilla
GSSGDQEMTATLLTAGFQTLEKIEDMAVSLIREEWLLDPSQKDLSRDNRPENFRNVFSLGGETRSENRELASKQVISTGIQ

SEQ ID NO: 4739 - protein, 81 aa, Gorilla gorilla
GGCCREDAMVASRLTPGSQGLLKMEDVALTLTPGWTQLDSSQVNLYRDEKQENHSSLVSLGGEIQTKSRDLPPVKKLPEKE

SEQ ID NO: 4740 - protein, 81 aa, Gorilla gorilla
GGCCREDAVVASRLTPESQGLLKVEDVALTLTPEWTQQDSSQGNLCRDEKQENHGSLVSLGDEKQTKSRDLPPAEELPEKE

SEQ ID NO: 4741 - protein, 81 aa, Gorilla gorilla
ATLQEAMKRDCWREARVKKKPVTFEDVAVNFSQEEWDCLDASQRVLYQDVMSETFKNLTSVARIFLHKPELITKLEQEEEQ

SEQ ID NO: 4742 - protein, 81 aa, Gorilla gorilla
EQLKPIEPRDCWREARVKKKPVTFEDVAVNFSQEEWDCLDASQRVLYQDVMSETFKNLTSVARIFLHKPELITKLEQEEEQ

SEQ ID NO: 4743 - protein, 81 aa, Gorilla gorilla
MAAGEPRSLLFFQKPVTFEDVAVNFSQEEWDCLDASQRVLYQDVMSETFKNLTSVARIFLHKPELITKLEQEEEQWRETRV

SEQ ID NO: 4744 - protein, 81 aa, Gorilla gorilla
MNTLQGPVSFKDVAVDFTQEEWQQLDPDEKITYRDVKACKVDDLIERIQENEDKHSSRSARRPCGPRCCCCCCCSRPPRSP

SEQ ID NO: 4745 - protein, 81 aa, Gorilla gorilla
MNTLQGPVSFKDVAVDFTQEEWQQLDPDEKITYRDVKACKVDDLIERIQENEDKHSRQAACINSKTLTEEKENTFSQIYME

SEQ ID NO: 4746 - protein, 81 aa, Gorilla gorilla
MNKSLGSVSFKDVAVDFTQEEWQQLDPEQKITYRDVMLENYSNLVSVGYHIIKPDVISKLEQGEEPWIVEGEFLLQSYPDE

SEQ ID NO: 4747 - protein, 81 aa, Gorilla gorilla
GLLTFRDIAIEFSLAEWQCLDHAQQNLYRDVMLENYRNLVSLGITVSPDLITCLEQNKEPQNIKRNEMVAKHPVTCSHFTQ

SEQ ID NO: 4748 - protein, 81 aa, Gorilla gorilla
MAKRPGPPGSREMGLLTFRDIAIEFSLEEWQCLDCAQRNLYRDVMLENYRNLVSLGIAVSKPDLITCLEQNKESQNIKRNE

SEQ ID NO: 4749 - protein, 81 aa, Gorilla gorilla
MAKRPGPPGSRKMGLLTFRDIAIEFSLAEWQCLDRAQQNLYRDVMLENYRNLVSLGMIVSKPDLIACLEQNKEPQNIKRNE

SEQ ID NO: 4750 - protein, 81 aa, Gorilla gorilla
MAKRPGSPGSRKMGLLTFRDVVIEFSLEEWQCLDHTQQNLYRDVMLENYRNLVSLGIAVSKPDLITCLEQNKEPWNKKRNE

SEQ ID NO: 4751 - protein, 81 aa, Gorilla gorilla
MPGPPGSLEMGPLTFRDVAIEFSLEEWQCLDTAQRNLYRKVMFENYRNLVFLGIAVSKPHLITCLEQGKEPWNRKRQEMVA

SEQ ID NO: 4752 - protein, 81 aa, Gorilla gorilla
MGPLTFMDMAIEFSLEECQCLDTAQRNVYRHVMLENYRNVVFLDLITCLEQGKEPWNMKRHEMVVAKHSGLCSRFAQDLWL

SEQ ID NO: 4753 - protein, 81 aa, Gorilla gorilla
MGPLTFMDMAIEFSLEECQCLDTAQRNVYRHVMLENYRNVVFLAVALTFDLSGLNILSFQSILPFVSALYVMGNRNQCLQK

SEQ ID NO: 4754 - protein, 81 aa, Gorilla gorilla
MGPLTFMDMAIEFSLEECQCLDTAQRNVYRHVMLENYRNVVFLGLCSRFAQDLWLEQNIKDSFQKVTLSRYGKYGHKNLQL

SEQ ID NO: 4755 - protein, 81 aa, Gorilla gorilla
MGPLTFMDMAIEFSLEECQCLDTAQRNVYRHVMLENYRNVVFLDLITCLEQGKEPWNMKRHEMVVAKHSAVALTFDLSGLN

SEQ ID NO: 4756 - protein, 81 aa, Gorilla gorilla
MDMAIEFSLEECQCLDTAQRNVYRHVMLENYRNVVFLGLCSRFAQDLWLEQNIKDSFQKVTLSRYGKYGHKNLQLRKGCKS

SEQ ID NO: 4757 - protein, 81 aa, Gorilla gorilla
MGPLTFMDMAIEFSLEECQCLDTAQRNVYRHVMLENYRNVVFLGIAISKPDLITCLEQGKEPWNMKRHEMVVAKHSDTLPL

SEQ ID NO: 4758 - protein, 81 aa, Gorilla gorilla
MGPLTFMDMAIEFSLEECQCLDTAQRNVYRHVMLENYRNVVFLGIAISKPDLITCLEQGKEPWNMKRHEMVVAKHSGLCSR

SEQ ID NO: 4759 - protein, 81 aa, Gorilla gorilla
DSLGDEMLAAALLKAKSQELVTFEDVAVYFIRKEWKRLEPAQRDLYRDVMLENYGNVFSLDIHVSLTTQKVMLAWLTGTLS

SEQ ID NO: 4760 - protein, 81 aa, Gorilla gorilla
GPGLPAMNPRDQEMAAGFFTAGSQGLGPFKDMALAFPEEEWRHVTPAQIDCFGEYVEPQDCRVSPGGGSKEKEAKPPQEDL

SEQ ID NO: 4761 - protein, 81 aa, Gorilla gorilla
GEEAVAVVRALQRALDGTSSQGMVTFEDMAVSLTWEEWERLDPARRDFCRESAQKDSGSTVPPSLESRVENKELIPMQQIL

SEQ ID NO: 4762 - protein, 81 aa, Gorilla gorilla
MAEPPRLPLTFEDVAIYFSEQEWQDLEAWQKELYKHVMRSNYETLVSLDDGLPKPELISWIEHGGEPFRKWRESQKSGNII

SEQ ID NO: 4763 - protein, 81 aa, Gorilla gorilla
MAEPASVTVTFDDVALYFSEQEWEILEKWQKQMYKQEMKTNYETLDSLGYAFSKPDLITWMEEGRMLLISEQGCLDKTRRT

SEQ ID NO: 4764 - protein, 81 aa, Gorilla gorilla
QEMKTNYETLDSLGYAFSKPDLITWMEEGRMLLISEQGCLDKTRRTTSPPTDEQLNMKNTGKLLCFDDEGTPRAKEESCRL

SEQ ID NO: 4765 - protein, 81 aa, Gorilla gorilla
GGGCRLCRNSGPCRSWIGVTVTFDDVALYFSEQEWEILEKWQKQMYKQEMKTNYETLDSLGYAFSKPDLITWMEEGRMLLI

SEQ ID NO: 4766 - protein, 81 aa, Gorilla gorilla
EMKTNYETLDSLGYAFSKPDLITWMEEGRMLLISEQGCLDKTRRTTSPPTDEQLNMKNTGKLLCFDDEGTPRAKEESCRLN

SEQ ID NO: 4767 - protein, 81 aa, Gorilla gorilla
SLGYAFSKPDLITWMEEGRMLLISEQGCLDKTRRTTSPPTDEQLNMKNTGKLLCFDDEGTPRAKEESCRLNGPQKQDLCAA

SEQ ID NO: 4768 - protein, 81 aa, Gorilla gorilla
KKLASCEKTVTELGTQLEGKWAVLGTLLQEYGLLQRRLENLENLLRNRNFWILRLPPGIKGDIPKVPVAFDDVSIYFSTPE

SEQ ID NO: 4769 - protein, 81 aa, Gorilla gorilla
RNFWVLRLPPGSKGEAPKVPVTFVDIAVYFSEDEWKNLDEWQKELYNNLVKENYKTLISLDAEGSVPKPDAPVQAEPREEP

SEQ ID NO: 4770 - protein, 81 aa, Gorilla gorilla
KKLADCEKTAVEFGNHMESKWAVLGTLLQEYGLLQRRLENLENLLRNRNFWVLRLPPGSKGEAPKAGVPVTFVDIAVYFSE

SEQ ID NO: 4771 - protein, 81 aa, Gorilla gorilla
FWVLRLPPGSKGEAPKAGVPVTFVDIAVYFSEDEWKNLDEWQKELYNNLVKENYKTLISLDAEGSVPKPDAPVQAEPREEP

SEQ ID NO: 4772 - protein, 81 aa, Gorilla gorilla
KKLADCEKMAVEFGNQLEGKWAVLGTLLQEYGLLQRRLENMENLLRNRNFWILRLPPGSKGEAPKVSRSLENDGVCFTEQE

SEQ ID NO: 4773 - protein, 81 aa, Gorilla gorilla
NFWILRLPPGSKGEAPKVSRSLENDGVCFTEQEWENLEDWQKELYRNVMESNYETLVSLNRVLLYCPGWSAVQWHDLGSLQ

SEQ ID NO: 4774 - protein, 81 aa, Gorilla gorilla
PGGAHPAGGVMIKQELQYTQEGPADPPGEFSCIAEEQAFLSPEQTELWGGQGSSVLLETGPGDSTLEEPVGSRDPSSSRTV

SEQ ID NO: 4775 - protein, 81 aa, Gorilla gorilla
GPGGAHPGGVMIKQELQYTQEGPADPPGEFSCIAEEQAFLSPEQTELWGGQGSSVLLETGPGDSTLEEPVGSRDPSSSRTV

SEQ ID NO: 4776 - protein, 81 aa, Gorilla gorilla
YGLLQRRLENMENLLRNRNFWILRLPPGSKGEAPKVSRSLENDGVCFTEQEWENLEDWQKELYRNVMESNYETLVSLSSSD

SEQ ID NO: 4777 - protein, 81 aa, Gorilla gorilla
LEEEGPGGAHPAGGVMIKQELQYTQEGPADPPGEFSCIAEEQAFLSPEQTELWGGQGSSVLLETGPGDSTLEEPVGSRDPS

SEQ ID NO: 4778 - protein, 81 aa, Gorilla gorilla
MRENYETLVSVGTAELLPLSAFLSPSEPGRAVGGGSHADEGQEPAGCEDPQGGQPRHSLHLTALVQLVKEIPEFLFGEVKG

SEQ ID NO: 4779 - protein, 81 aa, Gorilla gorilla
MPSPDSMTFEDIIVDFTQEEWALLDTSQRKLFQDVMLENISHLVSIGKQLCKSVVLSQLEQVEKLSTQRISLLQGREFGIK

SEQ ID NO: 4780 - protein, 81 aa, Gorilla gorilla
DFTQEEWALLDTSQRKLFQDVMLENISHLVSIGKQLCKSVVLSQLEQVEKLSTQRISLLQGREFGIKHQEIPFIQHIYQKG

SEQ ID NO: 4781 - protein, 81 aa, Gorilla gorilla
STQRISLLQGREFGIKHQEIPFIQHIYQKGTSTISTMRSHTQEDPFLCNDLGEDFTQHIALTQNVITYMRKKHFVSKKFGK

SEQ ID NO: 4782 - protein, 81 aa, Gorilla gorilla
GIKHQEIPFIQHIYQKGTSTISTMRSHTQEDPFLCNDLGEDFTQHIALTQNVITYMRKKHFESGRSSEHQSVVTATSIKTW

SEQ ID NO: 4783 - protein, 81 aa, Gorilla gorilla
SVVLSQLEQVEKLSTQRISLLQGREFGIKHQEIPFIQHIYQKGTSTISTMRSHTQEDPFLCNDLGEDFTQHIALTQNVITY

SEQ ID NO: 4784 - protein, 81 aa, Gorilla gorilla
MDMAQEPVTFRDVAIYFSREEWACLEPSQRALYRDVMLDNFSSVAALGFCSPRPDLVSRLEQWEEPWVEDWERPELQAVQR

SEQ ID NO: 4785 - protein, 81 aa, Gorilla gorilla
MDMAQEPVTFRDVAIYFSREEWACLEPSQRALYRDVMLDNFSSVAALAPDQTSSLAWNSGRSRGLKIGRDLSSRQCRGDPG

SEQ ID NO: 4786 - protein, 81 aa, Gorilla gorilla
MAATFQLPGHQAMPLTFQDVAVYFSQAEGRQLGPQQRALYRDVMLENYGNVASLGFPVPKPELISQLEQGKELWVLNLLGA

SEQ ID NO: 4787 - protein, 81 aa, Gorilla gorilla
AAHAHRMAATFQLPGHQAMPLTFQDVAVYFSQAEGRQLGPQQRALYRDVMLENYGNVASLGFPVPKPELISQLEQGKELWV

SEQ ID NO: 4788 - protein, 81 aa, Gorilla gorilla
RKPNPQAMAALFLSAPHQAKVTFEDVAVYLSREEWGRLGPAQRGLYRDVMLETYGNLVSLGVGPAGPKPGVISQLERGDEP

SEQ ID NO: 4789 - protein, 81 aa, Gorilla gorilla
MAALFLSAPHQAKVTFEDVAVYLSREEWGRLGPAQRGLYRDVMLETYGNLVSLGVGPAGPKPGVISQLERGDEPWVLDVQG

SEQ ID NO: 4790 - protein, 81 aa, Gorilla gorilla
MAALFLSAPHQAKVTFEDVAVYLSREEWGRLGPAQRGLYRDVMLETYGNLVSLALGIRTEYKELTSQETFGEEDPQGSEPV

SEQ ID NO: 4791 - protein, 81 aa, Gorilla gorilla
LRKPNPQAMAALFLSAPHQAKVTFEDVAVYLSREEWGRLGPAQRGLYRDVMLETYGNLVSLALGIRTEYKELTSQETFGEE

SEQ ID NO: 4792 - protein, 81 aa, Gorilla gorilla
MAMALPMPGPQEAVVFEDVAVYFTRIEWSCLAPDQQALYRDVMLENYGNLASLGFLVAKPALISLLEQGEEPGALILQVAE

SEQ ID NO: 4793 - protein, 81 aa, Gorilla gorilla
MAMALPMPGPQEAVVFEDVAVYFTRIEWSCLAPDQQALYRDVMLENYGNLASLALISLLEQGEEPGALILQVAEQSVAKAS

SEQ ID NO: 4794 - protein, 81 aa, Gorilla gorilla
LASLALISLLEQGEEPGALILQVAEQSVAKASLCTDSRMEAGIMESPLQRKLSRQAGLPGTVWGCLPWGHPAGGHPAPPHP

SEQ ID NO: 4795 - protein, 81 aa, Gorilla gorilla
MGFLGCWCVSFQEVVTFGDVAVHFSREEWQCLDPGQRALYREVMLENHSSVAGLAGFLVFKPELISRLEQGEEPWVLDLQG

SEQ ID NO: 4796 - protein, 81 aa, Gorilla gorilla
MAPGLLTTRKEALMAFRDVAVAFTQKEWKLLSSAQRTLYREVMLENYSHLVSLGIAFSKPKLIEQLEQGDEPWREENKHLL

SEQ ID NO: 4797 - protein, 81 aa, Gorilla gorilla
ENYSHLVSLGIAFSKPKLIEQLEQGDEPWREENKHLLDLCPGEWEALCKRGCRAVRSSAGKEGGAIFEVLGGSSSSGLLGH

SEQ ID NO: 4798 - protein, 81 aa, Gorilla gorilla
MNTFQASVSFQDVTVEFTQEEWQHMGPVERTLYRDVMLENYSHLVSVGYCFTKPELIFTLEQGEDPWLLEKEKGFLSRNSP

SEQ ID NO: 4799 - protein, 81 aa, Gorilla gorilla
MASPSPPPESKEEWDYLDPAQRSLYKDVMMENYGNLVSLGLTLLPRLVCSDANTACCSLNLLGLSDQSSHLSYLSSWDYRC

SEQ ID NO: 4800 - protein, 81 aa, Gorilla gorilla
ENSKEDKMVTVCPNTESCESITLKDIAVNFSRGEWKKLEPFQKELYKEVLLENLRNLEFLDFPVSKLELISQLKWVELPWL

SEQ ID NO: 4801 - protein, 81 aa, Gorilla gorilla
DRRRSAGTTKEAGRPLEMAVSEPEASAAEWKQLDPAQSNLDNDVMLENYSNQASMGCQAPKPDMISKLEKGEAPWLGKGKR

SEQ ID NO: 4802 - protein, 81 aa, Gorilla gorilla
RRRSAGTTKEAGRPLEMAVSEPEASAAKEWKQLDPAQSNLDNDVMLENYSNQASMGCQAPKPDMISKLEKGEAPWLGKGKR

SEQ ID NO: 4803 - protein, 81 aa, Gorilla gorilla
EAGRPLEMAVSEPEASAAVSVTFKHVTMAFTQKEWKQLDPAQSNLDNDVMLENYSNQASMGCQAPKPDMISKLEKGEAPWL

SEQ ID NO: 4804 - protein, 81 aa, Gorilla gorilla
MAAGLLTAGPRGSTFFSSVTVAFAQEGWRCLVSTPRDRFKEGIPGKSRSLVLLGLPVSQPGMNSQLEQREGAWMLEGEDLR

SEQ ID NO: 4805 - protein, 81 aa, Gorilla gorilla
ENTGEEGMAAGLLTAGPRGSTFFSSVTVAFAQEGWRCLVSTPRDRFKEGIPGKSRSLVLLGLPVSQPGMNSQLEQREGAWM

SEQ ID NO: 4806 - protein, 81 aa, Gorilla gorilla
MAMSQESLTFKDVFVDFTLEEWQQLDSAQKNLYRDVMLENYSHLVSVGYLVEKPDVIFRLGPGEESWMADGGTPVRTCAEV

SEQ ID NO: 4807 - protein, 81 aa, Gorilla gorilla
MAMSQESLTFKDVFVDFTLEEWQQLDSAQKNLYRDVMLENYSHLVSVGYLVEKPDVIFRLGPGEESWMADGGTPVRTCAGE

SEQ ID NO: 4808 - protein, 81 aa, Gorilla gorilla
VEKPDVIFRLGPGEESWMADGGTPVRTCAGEDRPGESGRGKETRLVGESLASGMCSGALLRALDLWTCLGSDERNCCHVQM

SEQ ID NO: 4809 - protein, 81 aa, Gorilla gorilla
MAMSQESLTFKDVFVDFTLEEWQQLDSAQKNLYRDVMLENYSHLVSVGYLVEKPDVIFRLGPGEESWMADGGTPVRTCAGT

SEQ ID NO: 4810 - protein, 81 aa, Gorilla gorilla
MAMSQESLTFKDVFVDFTLEEWQQLDSAQKNLYRDVMLENYSHLVSVGHLVEKPDMIFRLGPGEESWMADGGTPVQTCAGE

SEQ ID NO: 4811 - protein, 81 aa, Gorilla gorilla
MAMSQESLTFKDVFVDFTLEEWQQLDSAQKNLYRDVMLENYSHLVSVGHLVEKPDMIFRLGPGEESWMADGGTPVQTCAVW

SEQ ID NO: 4812 - protein, 81 aa, Gorilla gorilla
MAMSQESLTFKDVFVDFTLEEWQQLDSAQKNLYRDVMLENYSHLVSVGHLVEKPDMIFRLGPGEESWMADGGTPVQTCAEV

SEQ ID NO: 4813 - protein, 81 aa, Gorilla gorilla
MAMSQESLTFKDVFVDFTLEEWQQLDSAQKNLYRDVMLENYSHLVSVGHLVEKPDMIFRLGPGEESWMADGGTPVQTCAVF

SEQ ID NO: 4814 - protein, 81 aa, Gorilla gorilla
MAMSQESLTFKDVFVDFTLEEWQQLDSAQKNLYRDVMLENYSHLVSVGHLVEKPDMIFRLGPGEESWMADGGTPVQTCAVE

SEQ ID NO: 4815 - protein, 81 aa, Gorilla gorilla
MAKPQGLVTFEDVAVDFTQEEWQYLNPPQRTLYRDVMLETYSNLVFVGQQVTKPNLILKLEVEECPAEGKIPFWNFPEVCH

SEQ ID NO: 4816 - protein, 81 aa, Gorilla gorilla
MIESQEPVTFEDVAVDFTQEEWQQLNPAQKTLHRDVMLETYNHLVSVGCSDIKPDVIFKVEHGKDPWIIESELSRWIYPGI

SEQ ID NO: 4817 - protein, 81 aa, Gorilla gorilla
MIESQEPVTFEDVAVDFTQEEWQQLNPAQKTLHRDVMLETYNHLVSVGCSDIKPDVIFKVEHGKDPWIIESELSRWIYPDR

SEQ ID NO: 4818 - protein, 81 aa, Gorilla gorilla
MVEGEEEWQQLNPAQKTLHRDVMLETYNHLVSVGCSDIKPDVIFKVEHGKDPWIIESELSRWIYPDRVKGLESSQQIISGE

SEQ ID NO: 4819 - protein, 80 aa, Gorilla gorilla
MIESQEPVTFEDVAVDFTQEEWQQLNPAQKTLHRDVMLETYNHLVSVGCSDIKPDVIFKVEHGKDPWIIESELSRWIYPE

SEQ ID NO: 4820 - protein, 81 aa, Gorilla gorilla
MIESQEPVTFEDVAVDFTQEEWQQLNPAQKTLHRDVMLETYNHLVSVGCSDIKPDVIFKVEHGKDPWIIESELSRWIYPDN

SEQ ID NO: 4821 - protein, 81 aa, Gorilla gorilla
MIESQEEWQQLNPAQKTLHRDVMLETYNHLVSVGCSDIKPDVIFKVEHGKDPWIIESELSRWIYPDRVKGLESSQQIISGE

SEQ ID NO: 4822 - protein, 81 aa, Gorilla gorilla
KVGREPASSIKALLCGRGEARAFDDIAKYFSEKEWEKMKAWEKIIYVYMKRKYEAMTKLGFKATLPPFMCNKRVADFQGND

SEQ ID NO: 4823 - protein, 81 aa, Gorilla gorilla
GDDAFVRRPRVGSQIPEKIQKAFDDIAKYFSEKEWEKMKAWEKIIYVYMKRKYEAMTKLGFKATLPPFMCNKRVADFQGND

SEQ ID NO: 4824 - protein, 81 aa, Gorilla gorilla
RDHTFAKRPRDDAKTSEKRSKALDDIATYFSKKEWEEMKYSEKISYVYMKRNYKAMTKLGFNVTLPPFMCNKQATDFQGND

SEQ ID NO: 4825 - protein, 81 aa, Gorilla gorilla
GDDAFARRPRAGAQIPEKIQKAFDDIAKYFSKKEWEKMKSSEKIIYVYMKRKYEAMTKLGFKATLSPFMHNTGATDLQEND

SEQ ID NO: 4826 - protein, 81 aa, Gorilla gorilla
GDDAFARRPMVGAQIPEKIQKAFDDIAKYFSKEEWEKMKASEKIFYVYMKRKYEAMTKLGFKATLPPFMCNKRAEDFQGND

SEQ ID NO: 4827 - protein, 81 aa, Gorilla gorilla
GDDAFARRPRDDAQISEKLRKAFDDIAKYFSKKEWEKMKSSEKIIYVYMKLNYEVMTKLGFKVTLPPFMCSKRAADFHGND

SEQ ID NO: 4828 - protein, 81 aa, Gorilla gorilla
KRIKHWKMASKLILPESLSLLTFEDVAVYFSEEEWKLLNPLEKTLYNDVMQDIYETVISLGLKLKNDTGNDHPISVSTSEI

SEQ ID NO: 4829 - protein, 81 aa, Gorilla gorilla
ALVLVEFLQREPDGTKNESLLTFEDVAVYFSEEEWKLLNPLEKTLYNDVMQDIYETVISLGLKLKNDTGNDHPISVSTSEI

SEQ ID NO: 4830 - protein, 81 aa, Pongo abelii
FPVSSGCFQELQETNKSLGLVSFEDVAVHFTWEEWQDLDDVQRTLYWDVMLETYSSLVSLGHCITKPEMIFKLEQGAEPWI

SEQ ID NO: 4831 - protein, 81 aa, Pongo abelii
MHSLKKVTFEDVAIDFTQEEWAMMDTSKRKLYRDVMLENISHLVSLGYQISKSCITLQLEQGKELWQEGREFLPDQNPDRE

SEQ ID NO: 4832 - protein, 81 aa, Pongo abelii
FPVSSGCFQELQETNKSLGLVSFEDVAVHFTWEEWQDLDDVQRTLYRDVMLETCSSLVSLGHCITKPEMIFKLEQGAEPWI

SEQ ID NO: 4833 - protein, 81 aa, Pongo abelii
MFPVSSGCFQELQETNKSLVSFEDVAVHFTWEEWQDLDDVQRTLYRDVMLETCSSLVSLGHCITKPEMIFKLEQGAEPWIV

SEQ ID NO: 4834 - protein, 81 aa, Pongo abelii
MIKFQERVTFKDVAVVFTNEELALLDKAQINLYQDVMLENFRNLISVRDGIKNNILNLQEKGLNYLSQEVLHCWQIWKQRI

SEQ ID NO: 4835 - protein, 81 aa, Pongo abelii
MIKFQIKGIHVQERVTFKDVAVVFTNEELALLDKAQINLYQDVMLENFRNLISVRDGIKNNILNLQEKGLNYLSQEVLHCW

SEQ ID NO: 4836 - protein, 81 aa, Pongo abelii
ASGCPGADRNLLVYSVYEKGPLTFRDVAIEFSLEEWQCLDTAQQDLYRKVMLENYRNLVFLAGIAVSKPDLITCLEQGKEP

SEQ ID NO: 4837 - protein, 81 aa, Pongo abelii
SGCPGADRNLLVYSVYEKGPLTFRDVAIEFSLEEWQCLDTAQQDLYRKVMLENYRNLVFLGIAVSKPDLITCLEQGKEPWN

SEQ ID NO: 4838 - protein, 81 aa, Pongo abelii
LQEENVRDTQQVTTLQLPPNRVSPFKDMILCFSEEDWSLLDPAQTGFYGEFIIGEDYGVSMPPNDLAAQPDLSQGEENEPR

SEQ ID NO: 4839 - protein, 81 aa, Pongo abelii
LGSGGKKAQIISVLSQIYVNRVSPFKDMILCFSEEDWSLLDPAQTGFYGEFIIGEDYGVSMPPNDLAAQPDLSQGEENEPR

SEQ ID NO: 4840 - protein, 81 aa, Pongo abelii
MAGSQGLLIFRDVAIEFSPEEWSYLDPAQQNLYRDVMLENYRNLVSLGIAVSKPDLITCLEQRNEPWDVKKHETVARHPAV

SEQ ID NO: 4841 - protein, 81 aa, Pongo abelii
RHFRRPEPCREPGASPTQDSVAFEDVAVNFTQEEWALLDSSQKNLYREVMQETCRNLASVGSKWKDQNIEDHFEKPGKDIR

SEQ ID NO: 4842 - protein, 81 aa, Pongo abelii
MDSVAFEDVAVNFTQEEWALLDSSQKNLYREVMQETCRNLASVGSKWKDQNIEDHFEKPGKDIRNHMVQRLCESKEGGQYG

SEQ ID NO: 4843 - protein, 81 aa, Pongo abelii
AEPLHPVCTCGRHFRRPEPCREPGASPTQDSVAFEDVAVNFTQEEWALLDSSQKNLYREVMQETCRNLASVEIIWYRDCVK

SEQ ID NO: 4844 - protein, 81 aa, Pongo abelii
MGLLAFRDVALEFSAEEWECLDLAQRSLYRDVMLENYRNLFSLGLAMSKPELIICLEARKEPWNVNTEKTAKHSALSSYLT

SEQ ID NO: 4845 - protein, 81 aa, Pongo abelii
EARKEPWNVNTEKTAKHSALSSYLTEDILPEQGLQVSFQKVMLRRYERCCLEKLHLRNDWEIVVETGFHRVSQDDLDLLTS

SEQ ID NO: 4846 - protein, 81 aa, Pongo abelii
MDSVSFEDVAVAFTQEEWALLDPSQKNLYRDVMQEIFRNLASVGNKSEDQNIQDDFKNPGRNLSSHVVERLFAIKEGSQYG

SEQ ID NO: 4847 - protein, 81 aa, Pongo abelii
MGLLAFRDVALEFSAEEWECLDLAQRSLYRDVMLENYRNLFSLGEDNFNMQFLFHSLAMSKPELIICLEARKEPWNVNTEK

SEQ ID NO: 4848 - protein, 81 aa, Pongo abelii
RKEPWNVNTEKTAKHSALSSYLTEDILPEQGLQVSFQKVMLRRYERCCLEKLHLRNDWEIPCEDVLASPLPSAMIVSFLRP

SEQ ID NO: 4849 - protein, 81 aa, Pongo abelii
FSLGLAMSKPELIICLEARKEPWNVNTEKTAKHSALSSYLTEDILPEQGLQVSFQKVMLRRYERCCLEKLHLRNDWEIVAM

SEQ ID NO: 4850 - protein, 81 aa, Pongo abelii
LFHSLAMSKPELIICLEARKEPWNVNTEKTAKHSALSSYLTEDILPEQGLQVSFQKVMLRRYERCCLEKLHLRNDWEIVAM

SEQ ID NO: 4851 - protein, 81 aa, Pongo abelii
KGTGSYIAKMPGHPENRKTGLLAFSDVVIEFSPEEWACLDPAQRNLYRNVMFENYRNLVSLAILSYSIQDLLPEQDMKDLC

SEQ ID NO: 4852 - protein, 81 aa, Pongo abelii
QRNLYRNVMFENYRNLVSLAILSYSIQDLLPEQDMKDLCQKVTLTRHRSWGLDNLHLVKDWRTVNEERVLLVLREVRNPEW

SEQ ID NO: 4853 - protein, 81 aa, Pongo abelii
ILSYSIQDLLPEQDMKDLCQKVTLTRHRSWGLDNLHLVKDWRTVNEERVLLVLREVRNPEWRDQLKPWQKNMDCEDFMDIY

SEQ ID NO: 4854 - protein, 81 aa, Pongo abelii
NSFPQVILLPNPPKVFRLQGLLAFSDVVIEFSPEEWACLDPAQRNLYRNVMFENYRNLVSLAILSYSIQDLLPEQDMKDLC

SEQ ID NO: 4855 - protein, 81 aa, Pongo abelii
AQRNLYRNVMFENYRNLVSLAILSYSIQDLLPEQDMKDLCQKVTLTRHRSWGLDNLHLVKDWRTVNEGKGQKEYYNRLTQC

SEQ ID NO: 4856 - protein, 81 aa, Pongo abelii
EDSPADMQKVRICSEGGWVPALFDEVAIYFSDEEWEVLTEQQKALYREVMRMNYETVLSLEFPFPKPDMITRLEGEEESQN

SEQ ID NO: 4857 - protein, 81 aa, Pongo abelii
MINFQESVTFQDVAVDFTVEEWQLLDCAERTLYWDVMLENYRNLISVGFPITKTKVILKVEQGQEPWMVEGVNPHQSSPES

SEQ ID NO: 4858 - protein, 81 aa, Pongo abelii
MINFQESVTFQDVAVDFTVEEWQLLDCAERTLYWDVMLENYRNLISVGFPITKTKVILKVEQGQEPWMVEGVNPHQSSPGW

SEQ ID NO: 4859 - protein, 81 aa, Pongo abelii
EEPWMAEKEGPGDPSSDSKSKMETTESTAKSAISQERLYHGIMMERFMRDDILYSTLRKVSTYDDVLERHQETCVRDVRQA

SEQ ID NO: 4860 - protein, 81 aa, Pongo abelii
GESLESRVTLGSLTAESQELLTFKDVSVDFTQEEWGQLAPAHRNLYREVMLENYGNLVSVGYQLSKPGVISQLEKGEEPWL

SEQ ID NO: 4861 - protein, 81 aa, Pongo abelii
GESLESRVTLGSLTAESQELLTFKDVSVDFTQEEWGQLAPAHRNLYREVMLENYGNLVSVDLESKTKTKESALQNGISWEE

SEQ ID NO: 4862 - protein, 81 aa, Pongo abelii
QGESLESRVTLGSLTAESQELLTFKDVSVDFTQEEWGQLAPAHRNLYREVMLENYGNLVSVAGYQLSKPGVISQLEKGEEP

SEQ ID NO: 4863 - protein, 81 aa, Pongo abelii
SNLVSVGYCITKPEVIFKIEQGEEPWILEKGFPSQCHPERKWKVDDMLESSQENEDDHFWELLFHNNKTLRFQLLGIKQFL

SEQ ID NO: 4864 - protein, 81 aa, Pongo abelii
MSKFQGPVTLKDVIVEFTKEEWKLLTPAQRTLYKDVMLENYSHLVSVGYHVNKPNAVFKLKQGKQPWILEVEFPHRGFPED

SEQ ID NO: 4865 - protein, 81 aa, Pongo abelii
SNWMSSPLYSTEVEQKFQGSVSFKDVTVGFTQEEWQHLDPSQRALYRDVMLENYSNLVSVGYCVHKPEVIFRLEQGEEPWK

SEQ ID NO: 4866 - protein, 81 aa, Pongo abelii
MANATGSGVEQKFQGSVSFKDVTVGFTQEEWQHLDPSQRALYRDVMLENYSNLVSVGYCVHKPEVIFRLEQGEEPWKLEEE

SEQ ID NO: 4867 - protein, 81 aa, Pongo abelii
MNKVEQKFQGSVSFKDVTVGFTQEEWQHLDPSQRALYRDVMLENYSNLVSVGYCVHKPEVIFRLEQGEEPWKLEEEFPSQS

SEQ ID NO: 4868 - protein, 81 aa, Pongo abelii
DVMLENYSLLLSVGYCITKPEVVCKLERGEVLWILEEESPSQSHLDCCIDDDLMEKRQENQDQHLQKVDFVNNKTLTMDRN

SEQ ID NO: 4869 - protein, 81 aa, Pongo abelii
RDVMLENYGNLVSVGLLSSKPKLITQLEQGAEPWTEVREAPSGTHTVQDYWFETKMSALKQSTSEGSVLGERTKTVMMEKG

SEQ ID NO: 4870 - protein, 81 aa, Pongo abelii
MTLLTFRDVAIEFSLEEWKCLDLAQQNLYRDVMLENYRNLFSIGLTVSKPGLITCLEQRKEPWNVKRQEAVDGHPAVSSHF

SEQ ID NO: 4871 - protein, 81 aa, Pongo abelii
SHFTQDLLPEQGIQDAFPKTILRGYGNCGLDNLYLRKDWESLDECKLQKDYNGLNQCSSTTHSKIFQCNKYVKIFDNFSNL

SEQ ID NO: 4872 - protein, 81 aa, Pongo abelii
MTLLTFRDVAIEFSLEEWKCLDLAQQNLYRDVMLENYRNLFSIGLTVSKPGLITCLEQRKEPWNVKRQEAVDGHPEMGFHH

SEQ ID NO: 4873 - protein, 81 aa, Pongo abelii
MAGAQTLLTFRDVAIEFSLEEWKCLDLAQQNLYRDVMLENYRNLFSIGLTVSKPGLITCLEQRKEPWNVKRQEAVDGHPAV

SEQ ID NO: 4874 - protein, 81 aa, Pongo abelii
MAGAQTLLTFRDVAIEFSLEEWKCLDLAQQNLYRDVMLENYRNLFSIGLTVSKPGLITCLEQRKEPWNVKRQEAVDGHPEM

SEQ ID NO: 4875 - protein, 81 aa, Pongo abelii
SSHFTQDLLPEQGIQDAFPKTILRGYGNCGLDNLYLRKDWESLDECKLQKDYNGLNQCSSTTHSKIFQCNKYVKIFDNFSN

SEQ ID NO: 4876 - protein, 81 aa, Pongo abelii
MAGAQTLLTFRDVAIEFSLEEWKCLDLAQQNLYRDVMLENYRNLFSIGLTVSKPGLITCLEQRKEPWNVKRQEAVDGHPDI

SEQ ID NO: 4877 - protein, 81 aa, Pongo abelii
MAGAQTLLTFRDVAIEFSLEEWKCLDLAQQNLYRDVMLENYRNLFSIGLTVSKPGLITCLEQRKEPWNVKRQEAVDGHPAL

SEQ ID NO: 4878 - protein, 81 aa, Pongo abelii
MTLLTFRDVAIEFSLEEWKCLDLAQQNLYRDVMLENYRNLFSIGLTVSKPGLITCLEQRKEPWNVKRQEAVDGHPGWCSGV

SEQ ID NO: 4879 - protein, 81 aa, Pongo abelii
VSLDKFTAVSSHFTQDLLPEQGIQDAFPKTILRGYGNCGLDNLYLRKDWESLDECKLQKDYNGLNQCSSTTHSKIFQCNKY

SEQ ID NO: 4880 - protein, 81 aa, Pongo abelii
MTLLTFRDVAIEFSLEEWKCLDLAQQNLYRDVMLENYRNLFSIGLTVSKPGLITCLEQRKEPWNVKRQEAVDGHPGWSAVV

SEQ ID NO: 4881 - protein, 81 aa, Pongo abelii
VSKPGLITCLEQRKEPWNVKRQEAVDGHPAVSSHFTQDLLPEQGIQDAFPKTILRGYGNCGLDNLYLRKDWESLDECKLQK

SEQ ID NO: 4882 - protein, 81 aa, Pongo abelii
MPWAEKNLLVYSSSKETLLTFRDVAIEFSLEEWKCLDLAQQNLYRDVMLENYRNLFSIGLTVSKPGLITCLEQRKEPWNVK

SEQ ID NO: 4883 - protein, 80 aa, Pongo abelii
MTLLTFRDVAIEFSLEEWKCLDLAQQNLYRDVMLENYRNLFSIGLTVSKPGLITCLEQRKEPWNVKRQEAVDGHPASTNV

SEQ ID NO: 4884 - protein, 81 aa, Pongo abelii
MTLLTFRDVAIEFSLEEWKCLDLAQQNLYRDVMLENYRNLFSIGLTVSKPGLITCLEQRKEPWNVKRQEAVDGHPEFHSVT

SEQ ID NO: 4885 - protein, 81 aa, Pongo abelii
PGLITCLEQRKEPWNVKRQEAVDGHPEFHSVTRAVVQWRHLSSLQPLPPGLEPSSHFSLLRTWNYRCTPPHPANFCIFNRD

SEQ ID NO: 4886 - protein, 81 aa, Pongo abelii
MAGAQTLLTFRDVAIEFSLEEWKCLDLAQQNLYRDVMLENYRNLFSIGLTVSKPGLITCLEQRKEPWNVKRQEAVDGHPGP

SEQ ID NO: 4887 - protein, 81 aa, Pongo abelii
MAVTFEDVTIIFTWEEWKFLDSSQKRLYREVMWENYTNVMSVENWNESYKSQEEKFRYLEYENFSCWQGWWNAGAQMYKNQ

SEQ ID NO: 4888 - protein, 81 aa, Pongo abelii
SRKNLSMEKEQKLIVQHSYIPVEEALPQYVGVICQKDLLRDSTEEKYCGCNKCKEIYYWNSRCVFHKRNQPGENLYQCSIR

SEQ ID NO: 4889 - protein, 81 aa, Pongo abelii
QMGSIKEKMKAGSPTGKPQEPVTFKDVVVEFSKEEWGQLDSAVKNLYRNVMLENFRNLNSLRKAHLLSKPFESLKLESRKK

SEQ ID NO: 4890 - protein, 81 aa, Pongo abelii
MIQSQISFEDVAVDFTLEEWQLLNPTQKNLYRDVMLENYSNLVFLEVWLDNPKMWLRDNQDNLKNMERGHKYDVFGKIFNS

SEQ ID NO: 4891 - protein, 81 aa, Pongo abelii
MIQSQISFEDVAVDFTLEEWQLLNPTQKNLYRDVMLENYSNLVFLGFQILKPDAVFKLEQQDPWIIDQEILKQNFSEVWLD

SEQ ID NO: 4892 - protein, 81 aa, Pongo abelii
MSQGLVTFRDVAIDFSQEEWKWLQPAQRDLYRCVMLENYGHLVSLGLSISKPDVVSLLEQGKEPWLGKREVKRDLFSVSES

SEQ ID NO: 4893 - protein, 81 aa, Pongo abelii
MLENYGHLVSLGLSISKPDVVSLLEQGKEPWLGKREVKRDLFSVSESSGEIKDFSAKNVIYDDSSQYLIMERILSQGPVYS

SEQ ID NO: 4894 - protein, 81 aa, Pongo abelii
MSQGLVTFRDVAIDFSQEEWKWLQPAQRDLYRCVMLENYGHLVSLAGLSISKPDVVSLLEQGKEPWLGKREVKRDLFSVRV

SEQ ID NO: 4895 - protein, 81 aa, Pongo abelii
MSQGLVTFRDVAIDFSQEEWKWLQPAQRDLYRCVMLENYGHLVSLGLSISKPDVVSLLEQGKEPWLGKREVKRDLFSVLKE

SEQ ID NO: 4896 - protein, 81 aa, Pongo abelii
REFVGMCAGHANICLSFQGLVTFRDVAIDFSQEEWKWLQPAQRDLYRCVMLENYGHLVSLGLSISKPDVVSLLEQGKEPWL

SEQ ID NO: 4897 - protein, 81 aa, Pongo abelii
RNAEEERMIAVFLTTWLQEPMTFKDVAVEFTQEEWMLLDSAQRSLYRDVMLENYRNLTSVEYQLCGLTVTSPLDQEEIRNM

SEQ ID NO: 4898 - protein, 81 aa, Pongo abelii
MDAKSLTAWSQTLVTFKDVFVDFTREEWKLLDTAQQIVYRNVMLENYKNLVSLGYQLTKPDVIIRLEKGEEPWLVERGIHQ

SEQ ID NO: 4899 - protein, 81 aa, Pongo abelii
VLEWLFVSQEQPKITKSWGPLSFMDVFVDFTWEEWQLLDPAQKCLYRSVMLENYSNLVSLGYQHTKPDIIFKLEQGEELCM

SEQ ID NO: 4900 - protein, 81 aa, Pongo abelii
MDVFVDFTWEEWQLLDPAQKCLYRSVMLENYSNLVSLGYQHTKPDIIFKLEQGEELCMVQAQVPNQSCPNTVWKIDDLMDW

SEQ ID NO: 4901 - protein, 81 aa, Pongo abelii
KQKSRRTEKVLEWLFVSQEQPKITKSWEWQLLDPAQKCLYRSVMLENYSNLVSLGYQHTKPDIIFKLEQGEELCMVQAQVP

SEQ ID NO: 4902 - protein, 81 aa, Pongo abelii
SFMDVFVDFTWEEWQLLDPAQKCLYRSVMLENYSNLVSLGYQHTKPDIIFKLEQGEELCMVQAQVPNQSCPILKAGKSKAK

SEQ ID NO: 4903 - protein, 81 aa, Pongo abelii
SGDPSSEGTSGSGSVSIRKPASEMQLQVQSQQEELEQLKKDLSSQKELVRLLQQTVRSSQYDKYFTSSRLCEGVPKDMLEL

SEQ ID NO: 4904 - protein, 81 aa, Pongo abelii
SSGDPSSEGTSGSGSVSIRKPASEMQLQVQSQQEELEQLKKDLSSQKELVRLLQQTVRSSQYDKYFTSSRLCEGVPKDMLE

SEQ ID NO: 4905 - protein, 81 aa, Pongo abelii
MLVAAAAERNKDPILHVLRQYLDPAQRGVRVLEVASGSGQHVAHFARAFPLAEWQPSDVDQRCLDRNPEWGLRDTALLEDL

SEQ ID NO: 4906 - protein, 81 aa, Pongo abelii
VLRQYLDPAQRGVRVLEVASGSGQHVAHFARAFPLAEWQPSDVDQRCLDRNPEWGLRDTALLEDLGKASGLLLERMVDMPA

SEQ ID NO: 4907 - protein, 81 aa, Pongo abelii
RGVRVLEVASGSGQHVAHFARAFPLAEWQPSDVDQRCLDRNPEWGLRDTALLEDLGKASGLLLERMVDMPANNKCLIFRKN

SEQ ID NO: 4908 - protein, 81 aa, Pongo abelii
EGRTRDRQMAAALLTAWSQMPVTFEDVALYLSREEWGRLDHTQQNFYRDVLQKKNGLSLGAVEVGQRVPTSSVAALGDVKP

SEQ ID NO: 4909 - protein, 81 aa, Pongo abelii
LKEGRTRETTDTCFVSGVHGPVALGDIPFYFSREEWGTLDPAQRDLFWDIKRENSRNTTLGLGLKGQSEKSRLQEVVPVVP

SEQ ID NO: 4910 - protein, 81 aa, Pongo abelii
NTTLGLGLKGQSEKSRLQEVVPVVPGQTGSYVTVSWSPEEAEAWESENRPRAALGPVVGARRGRPPTRRRQFRDLAAEKPH

SEQ ID NO: 4911 - protein, 81 aa, Pongo abelii
RPLVKLLPKGVQKEQETVSLYLKANPELVVFEDLNVFHCQEECVSLDPTQQLTSEKEDDSSVGEMMLLAVNGSNPEGEDPE

SEQ ID NO: 4912 - protein, 81 aa, Pongo abelii
PLVKLLPKGVQKEQETVSLYLKANPEELVVFEDLNVFHCQEECVSLDPTQQLTSEKEDDSSVGEMMLLAVNGSNPEGEDPE

SEQ ID NO: 4913 - protein, 81 aa, Pongo abelii
PLVKLLPKGVQKEQETVSLYLKANPEELVVFEDLNVFHCQEECVSLDPTQQLTSEKEDDSSVGEMMLLVNGSNPEGEDPER

SEQ ID NO: 4914 - protein, 81 aa, Pongo abelii
QTNTKDWTVTPERVLPESQSLLTFEEVAMYFSQEEWELLDPTQKALYNDVMQENYETVISLALFVLPKPKVISCLEQGEEP

SEQ ID NO: 4915 - protein, 81 aa, Pongo abelii; identical to SEQ ID NO: 2426

SEQ ID NO: 4916 - protein, 81 aa, Pongo abelii
TCDNRAVSLCQQEWMCPGPAQRALYRGATQRKDRHVSRATGVPWGYEETKTLLAILSSSQFYGKLQTCQQNSQIYRAMAEG

SEQ ID NO: 4917 - protein, 81 aa, Pongo abelii
QNTGLHDQETGAVVWTAGSQGPATCDNRAVSLCQQEWMCPGPAQRALYRGATQRKDRHVSRATGVPWGYEETKTLLAILSS

SEQ ID NO: 4918 - protein, 81 aa, Pongo abelii
MASMPPTPEAQGPILFEDLAVYFSQEECVTLHPAQRSLSKDATKECLEDVALMGEEGKPEINQQLSLDCMELDELALEKYP

SEQ ID NO: 4919 - protein, 81 aa, Pongo abelii
WPERGPPAPRHQEMASASPFLSAWSQVPVNLEDMAVYLSGEEPGCLDPAQRDAPLENEGRGIQLEDGGDGREDAPVRMEWY

SEQ ID NO: 4920 - protein, 81 aa, Pongo abelii
EAGSLHSGHQEQLNRKREHRPLPKNARPSPWVPALADEWNTLDQEVTTTRLPARSQEPVKDVHVARGFSYKKSVHQIPAHR

SEQ ID NO: 4921 - protein, 81 aa, Pongo abelii
NTLDQEVTTTRLPARSQEPVKDVHVARGFSYKKSVHQIPAHRDLYRDFRKENVGNVVSLGSAVSTSNKITRLEQRKEPWTV

SEQ ID NO: 4922 - protein, 81 aa, Pongo abelii
APLPPRDPNRAGPEWRKPGAVSFADVAVYFSREEWGCLRPAQRALYWDVMREIYGHLGALGVGGSKPALMSWVEEEAELWD

SEQ ID NO: 4923 - protein, 81 aa, Pongo abelii
LRPAQRALYWDVMREIYGHLGALGVGGSKPALMSWVEEEAELWDPAAQDPEVAKCPTEADPDSRNKEEERQREGTGALEKP

SEQ ID NO: 4924 - protein, 81 aa, Pongo abelii
APLPPRDPNRAGPEWRKPGAVSFADVAVYFSREEWGCLRPAQRALYWDVMREIYGHLGALGENPTCSPGPCAPTGPAVPLG

SEQ ID NO: 4925 - protein, 81 aa, Pongo abelii
APLPPRDPNGAGPEWGEPGAVSFADVAVYFCREEWGCLRPAQRALYRDVMRETYGHLSALGIGGNKPALISWVEEEAELWD

SEQ ID NO: 4926 - protein, 81 aa, Pongo abelii
LRPAQRALYRDVMRETYGHLSALGIGGNKPALISWVEEEAELWDPAAQDPEVAKCQTEADPADSRNKEEERQREGTGALEK

SEQ ID NO: 4927 - protein, 81 aa, Pongo abelii
LRPAQRALYRDVMRETYGHLSALGIGGNKPALISWVEEEAELWDPAAQDPEVAKCQTEADPDSRNKEEERQREGTGALEKP

SEQ ID NO: 4928 - protein, 81 aa, Pongo abelii
APLLAPRPGETRPGCRKPGAVSFADVAVYFSPEEWGCLRPAQRALYRDVMRETYGHLGALGFPGPKPALISWMEQESEAWS

SEQ ID NO: 4929 - protein, 81 aa, Pongo abelii
PAHVPGEAGPRRTRESRPGAVSFADVAVYFSPEEWGCLRPAQRALYRDVMRETFGHLGALGFSGPKPAFISWVEGEVEAWS

SEQ ID NO: 4930 - protein, 81 aa, Pongo abelii
PSQGPGEARPSRKRGRRPRALKFVDVAVYFSPEEWGCLRPAQRALYRDVMRETYGHLGALGCAGPKPALISWLERNTDDWE

SEQ ID NO: 4931 - protein, 81 aa, Pongo abelii
MGLLTFRDVAIEFSREEWEHLDSDQKLLYGDVMLENYRNLVSLGLVVSKPDLITFLEQRKEPWNVKSEETVAIQPDIFSHD

SEQ ID NO: 4932 - protein, 81 aa, Pongo abelii
MGLLTFRDVAIEFSREEWEHLDSDQKLLYGDVMLENYRNLVSLGLVVSKPDLITFLEQRKEPWNVKSEETVAIQPEVKVNT

SEQ ID NO: 4933 - protein, 81 aa, Pongo abelii
EVTEHLTGWAPAPVPSVEGLLTFRDVAIEFSREEWEHLDSDQKLLYGDVMLENYRNLVSLGLVVSKPDLITFLEQRKEPWN

SEQ ID NO: 4934 - protein, 81 aa, Pongo abelii
PDLITFLEQRKEPWNVKSEETVAIQPDIFSHDSQGLLRKKLIEASFQKVILDGYGSCGPQNLNLRKEWENEEKNQYNKSDT

SEQ ID NO: 4935 - protein, 81 aa, Pongo abelii
KPDLITFLEQRKEPWNVKSEETVAIQPDIFSHDSQGLLRKKLIEASFQKVILDGYGSCGPQNLNLRKEWENEGKKILHKEA

SEQ ID NO: 4936 - protein, 81 aa, Pongo abelii
MGLLTFRDVAVEFSLEEWEHLEPAQKNLYQDVMLENYRNLVSLGLVVSKPDLITFLEQRKEPWNVKSEETVAIQPDVFLHY

SEQ ID NO: 4937 - protein, 81 aa, Pongo abelii
MLENYRNLVSLGLVVSKPDLITFLEQRKEPWNVKSEETVAIQPDVFLHYNKDLLTEHCTEASFQKVISRRHGSCDLENLHL

SEQ ID NO: 4938 - protein, 81 aa, Pongo abelii
MAPRPPTAAPQESVTFKDVSVDFTQEEWYHVDPAQRSLYRDVMLENYSHLVSLGYQVSKPEVIFKLEKGEEPWISEGEIQR

SEQ ID NO: 4939 - protein, 81 aa, Pongo abelii
SVTFKDVSVDFTQEEWYHVDPAQRSLYRDVMLENYSHLVSLGYQVSKPEVIFKLEKGEEPWISEGEIQRPFYPAVYFNRKE

SEQ ID NO: 4940 - protein, 81 aa, Pongo abelii
ESVTFKDVSVDFTQEEWYHVDPAQRSLYRDVMLENYSHLVSLGYQVSKPEVIFKLEKGEEPWISEGEIQRPFYPGFVCLLP

SEQ ID NO: 4941 - protein, 81 aa, Pongo abelii
MAAMPLKARYEEMVTFEDVAVHFTKTEWTGLSPAQRALYRSVMLENFGNLTALGYPVPKPALISLLEGGDMAWGLEAQDDP

SEQ ID NO: 4942 - protein, 80 aa, Pongo abelii
VTFEDVAVHFTKTEWTGLSPAQRALYRSVMLENFGNLTALGYPVPKPALISLLEGGDMAWGLEAQDDPLAEMTKNVCKGR

SEQ ID NO: 4943 - protein, 81 aa, Pongo abelii
MVTFEDVAVHFTKTEWTGLSPAQRALYRSVMLENFGNLTALGYPVPKPALISLLEGGDMAWGLEAQDDPLAEMTKNVCKVI

SEQ ID NO: 4944 - protein, 81 aa, Pongo abelii
MLENYGNVASLGFPLLKPAVISQLEGGGELGGPSPLAAGRGLQGLRTDIQTDNDLTKEMYERKENVSFELQRDFSQETDFS

SEQ ID NO: 4945 - protein, 81 aa, Pongo abelii
MLENYGNVASLGFPLLKPAVISQLEGGGELGGPSPLAAGRGLQGLRTDGVSLCRPNWSAVARTWLTATSVSRVRAILLPHP

SEQ ID NO: 4946 - protein, 81 aa, Pongo abelii
MLENYGNVASLGFPLLKPAVISQLEGGVDIQTDNDLTKEMYERKENVSFELQRDFSQETDFSEASLLEKQQEVYSAGNIKK

SEQ ID NO: 4947 - protein, 81 aa, Pongo abelii
QLEGGVDIQTDNDLTKEMYERKENVSFELQRDFSQETDFSEASLLEKQQEVYSAGNIKKEKSSTIDGTVKDETSPVEECFF

SEQ ID NO: 4948 - protein, 81 aa, Pongo abelii
MHLTAWPQKSVTFEDVAVYFTQAEWDGLSPAQRTLYRDVMLENYGNVASLGFPLLKPAVISQLEGGGELGGPSPLAAGRGL

SEQ ID NO: 4949 - protein, 81 aa, Pongo abelii
MDVMLENYSNLLSVEVWKADDQMERDHRNPDEQARQFLILKNQTPIEERGDLFGRALNLNTDFVSLRQVPYKYDLYEKTLK

SEQ ID NO: 4950 - protein, 81 aa, Pongo abelii
EQTQAAGMVAGCLINCYQDSVTFDDVAVDFTQEEWTLLDPSQRDLYRDVMLENYENLASVGHHLFKPSVIYWLEEEEEMRA

SEQ ID NO: 4951 - protein, 81 aa, Pongo abelii
MAAPDLAHGGHVPRDSICLHEEQTQAAGMVAGCLINCYQDSVTFDDVAVDFTQEEWTLLDPSQRDLYRDVMLENYENLASV

SEQ ID NO: 4952 - protein, 81 aa, Pongo abelii
EQTQAAGMVAGCLINCYQDSVTFDDVAVDFTQEEWTLLDPSQRDLYRDVMLENYENLASVEWRLKTKGPALRQDRSWFRAS

SEQ ID NO: 4953 - protein, 81 aa, Pongo abelii
MLENYENLASVGHHLFKPSVIYWLEEEEEMRAGWRVLQEWRLKTKGPALRQDRSWFRASNETQTARSHNGGQLCDRTQRGE

SEQ ID NO: 4954 - protein, 81 aa, Pongo abelii
VLFQEATAFEDMTKDWNYLEGSQKDCYRDTMLDSYENTVPQGSFLKFSMMPQRAGNDPPGVSNASEMEMEISNMREKFLMS

SEQ ID NO: 4955 - protein, 81 aa, Pongo abelii
LQGKYGNVTKEVIVLYLTLCKQCHQKNPVPKRGLAPKPMTFKDIDSTCQVEILDMQSSADGEFKFILYYQDHLTKFIILRP

SEQ ID NO: 4956 - protein, 81 aa, Pongo abelii
MVPVAEPVLFQEATAFEDMTKDWNYLEGSQKDCYRDTMLDSYENTVPQGSFLKFSMMPQRAGNDPPGVSNASEMEMEISNM

SEQ ID NO: 4957 - protein, 81 aa, Pongo abelii
ASQPARLEERLIRDQDLGASLLPAAPQEQWRHLDSTQKEQYWDLMLETYGKMVSGAGISHPKSDLTNSIEFGDEPAGLYLH

SEQ ID NO: 4958 - protein, 81 aa, Pongo abelii
ASQPARLEERLIRDQDLGASLLPAAPQEQWRHLDSTQKEQYWDLMLETYGKMVSGGISHPKSDLTNSIEFGDEPAGLYLHV

SEQ ID NO: 4959 - protein, 81 aa, Pongo abelii
AASQPARLEERLIRDQDLGASLLPAAPQWRHLDSTQKEQYWDLMLETYGKMVSGGISHPKSDLTNSIEFGDEPAGLYLHVN

SEQ ID NO: 4960 - protein, 81 aa, Pongo abelii
FQEKSTEEGEVAALRLTARSQEKVTFKDVAMDFTPEEWGKLDPAQRDVMLENYRNLVSLWLPVSKPENYNLENGKEPLKLE

SEQ ID NO: 4961 - protein, 81 aa, Pongo abelii
EGEVAALRLTARSQEKVTFKDVAMDFTPEEWGKLDPAQRDVMLENYRNLVSLWLPVSKPENYNLENGKEPLKLERRAPKSS

SEQ ID NO: 4962 - protein, 81 aa, Pongo abelii
MELLTFRDVAIEFSPEEWKCLDPAQQNLYRDVMLENYRNLVSLAAYSYYNQGILPEQGIEDSFKKATLGRYGSCGLENICL

SEQ ID NO: 4963 - protein, 81 aa, Pongo abelii
CFSEEERMAAGYLPRWSQELVTFEDVSVDFSQEEWELLDPAQKNLYREVMLENYRNVVSLEDMKNQCTDGGIKEGPLSPAQ

SEQ ID NO: 4964 - protein, 81 aa, Pongo abelii
MVTCAHLGRRARLPAAQPSACPGTCFSEEERMAAGYLPRWSQELVTFEDVSVDFSQEEWELLDPAQKNLYREVMLENYRNV

SEQ ID NO: 4965 - protein, 81 aa, Pongo abelii
MDSVVFEDVAVDFTMEEWALLDSAQRDLYRDVMLETFENLASVDDETQFKASGSVSQQDIYGEKIPKKSKIAAFTRNVSLA

SEQ ID NO: 4966 - protein, 81 aa, Pongo abelii
MDTVVFEDVVVDFTLEEWALLNPAQRKLYRDVMLETFKRLASVDNEAQLKANGSISQQDTSGEKLSLKQKIEKFTGKNIWA

SEQ ID NO: 4967 - protein, 81 aa, Pongo abelii
MDSVVFEDVAVDFTMEEWALLDSAQRNLYRDVMLETFRNLASVGCEMWERTNGSVSQQDMYGEEKSKKQTIPNFTGNNSCA

SEQ ID NO: 4968 - protein, 81 aa, Pongo abelii
MDSVVFEDVAVDFTMEEWALLDSAQRNLYRDVMLETFRNLASVDDETQFKANGSVSQQDMYGEEKSKKQTIPNFTGNNSCA

SEQ ID NO: 4969 - protein, 81 aa, Pongo abelii
MDSVVFEEVAVNFTPEEWALLDHAQRSLYRDVMLETCRNLASLDCCIYVRTSGSSSQRDVFGNGISNDEEIVKFTRSDSWS

SEQ ID NO: 4970 - protein, 81 aa, Pongo abelii
GHTEGGELVNELLTSWLKGLVTFEDVAVEFTQEEWALLDPAQRTLYRDVMLENFRNLASSLGNQVDKPSLISQLEQEDKVM

SEQ ID NO: 4971 - protein, 81 aa, Pongo abelii
GHTKGGELVNELLTSWLQGLVTFEDVAVEFTQEEWALLDPAQRTLYRDVMLENCRNLASLGCRVNKPSLISQLEQDKKVMT

SEQ ID NO: 4972 - protein, 81 aa, Pongo abelii
SSPFPASQQKGHTKGGELVNELLTSWLQGLVTFEDVAVEFTQEEWALLDPAQRTLYRDVMLENCRNLASLALVCSRSLAMP

SEQ ID NO: 4973 - protein, 81 aa, Pongo abelii
MAAGWLTAWSQNSVTFQEVAVDFSQEEWALLDPAQKNLYKDVMLENFRNLASVGYQLCRHSLISKVDQEQLKTDERGILQG

SEQ ID NO: 4974 - protein, 81 aa, Pongo abelii
SALQQDFWKIQTSNGIQMDLVTFDSVAVEFTQEEWTLLDPTQRNLYSDVMLENYKNLSSVGYQLFKPSLISWLEEEEELST

SEQ ID NO: 4975 - protein, 81 aa, Pongo abelii
EKTPAGRIVADCLTNCYQDSVTFDDVAVDFTQEEWTLLDSTQRSLYSDVMLENYKNLATVGGQIIKPSLISWLEQEESKTV

SEQ ID NO: 4976 - protein, 81 aa, Pongo abelii
MDSVTFDDVAVDFTQEEWTLLDSTQRSLYSDVMLENYKNLATVGGQIIKPSLISWLEQEESKTVQGGVLQGWETQLETQWS

SEQ ID NO: 4977 - protein, 81 aa, Pongo abelii
MAAVDFSHGHYLSGDPVCLHEEKTPAGRIVADCLTNCYQDSVTFDDVAVDFTQEEWTLLDSTQRSLYSDVMLENYKNLATV

SEQ ID NO: 4978 - protein, 81 aa, Pongo abelii
EKTEVERMVEDYLANGYQDSVTFDDVAVDFTPEEWALLDTTEKYLYRDVMLENYMNLASVEWEMQPRTKRSSLQQGFLKNQ

SEQ ID NO: 4979 - protein, 81 aa, Pongo abelii
FFSREPICPFEEKTEVERMVEDYLANGYQDSVTFDDVAVDFTPEEWALLDTTEKYLYRDVMLENYMNLASVDKRLQWMETL

SEQ ID NO: 4980 - protein, 81 aa, Pongo abelii
LDSVTFDDVAVEFTPEEWALLDTTQKYLYRDVMLENYMNLASVDFFFCLTSEWEIQPRTKRSSLQQGFLKNQIFTGIQMQT

SEQ ID NO: 4981 - protein, 81 aa, Pongo abelii
LASVDFFFCLTSEWEIQPRTKRSSLQQGFLKNQIFTGIQMQTRSYSGWKLCENCGEVFSEQFCLKTHMRAQNGGNTSEGNC

SEQ ID NO: 4982 - protein, 81 aa, Pongo abelii
MDFSQHLVTFEDVAVDFTQEEWTLLDQTQRDLYRDVMLENYKNLIILAGSELCKPSLMSGLEQMEELRTGVTGVLQGEKQY

SEQ ID NO: 4983 - protein, 81 aa, Pongo abelii
MDFSQHLVTFEDVAVDFTQEEWTLLDQTQRDLYRDVMLENYKNLIILAGSELCKPSLMSGLEQMEELRTGVTGVLQELDLQ

SEQ ID NO: 4984 - protein, 81 aa, Pongo abelii
MDFSQHLVTFEDVAVDFTQEEWTLLDQTQRDLYRDVMLENYKNLIILGSELCKPSLMSGLEQMEELRTGVTGVLQELDLQL

SEQ ID NO: 4985 - protein, 81 aa, Pongo abelii
MDSVAFEDVAVNFTLEEWALLDPSQKNLYRDVMRETFRNLASIGKQWEDQNIEDPFKIPRRNISHIPERLCESKESGQGEE

SEQ ID NO: 4986 - protein, 81 aa, Pongo abelii
MDSVAFEDVAVNFTQEEWALLGPSQKSLYRNVMQETIRNLDCIEMKCEDQNIGDQCQNPRRNLRSHTCEIKDDSQYGETFG

SEQ ID NO: 4987 - protein, 81 aa, Pongo abelii
MDPVAFDDVAVNFTQEEWALLDISQRKLYREVMLETFRNLTSIGKRWKDQNIEYEYQNPRRNFRSVIEKKVNEIKEDSHCG

SEQ ID NO: 4988 - protein, 81 aa, Pongo abelii
MMFQDPVAFDDVAVNFTQEEWALLDISQRKLYREVMLETFRNLTSIGKRWKDQNIEYEYQNPRRNFRSVIEKKVNEIKEDS

SEQ ID NO: 4989 - protein, 81 aa, Pongo abelii
MFQDPVAFDDVAVNFTQEEWALLDISQRKLYREVMLETFRNLTSIGKRWKDQNIEYEYQNPRRNFRSVIEKKVNEIKEDSH

SEQ ID NO: 4990 - protein, 81 aa, Pongo abelii
MFQDPVAFKDVAVNFTQEEWALLDISQKNLYREVMLETFRNLTSTGKKWKDQNIEYEYQNPRRNFRSVIEERVNEIKEDSH

SEQ ID NO: 4991 - protein, 81 aa, Pongo abelii
VLSLSPILLYTCGMFQDPVAFKDVAVNFTQEEWALLDISQKNLYREVMLETFRNLTSTGKKWKDQNIEYEYQNPRRNFRSV

SEQ ID NO: 4992 - protein, 81 aa, Pongo abelii
CSHRSCREDPGTSESQEMDPVAFDDVAVNFTQEEWALLDISQRKLYREVMLETFRNLTSIGKSWKDQNIEYEYQNPRRKFR

SEQ ID NO: 4993 - protein, 81 aa, Pongo abelii
MPCCSHRSCREDPGTSESQEMEEWALLDISQRKLYREVMLETFRNLTSIGKSWKDQNIEYEYQNPRRKFRSVIEKKVNEIK

SEQ ID NO: 4994 - protein, 81 aa, Pongo abelii
RSCREDPGTSESREMMFQDPVAFEDVAVNFTQEEWTLLDISQKNLFREVMLETFWNLTSIGKKWKDQNIEYEYQNPRRSFR

SEQ ID NO: 4995 - protein, 81 aa, Pongo abelii
CSHRSCREDPGTSESREMDPVAFEDVAVNFTQEEWTLLDISQKNLFREVMLETFWNLTSIGKKWKDQNIEYEYQNPRRSFR

SEQ ID NO: 4996 - protein, 81 aa, Pongo abelii
MFQDPVAFEDVAVNFTQEEWTLLDISQKNLFREVMLETFWNLTSIGKKWKDQNIEYEYQNPRRSFRSLIEEKVSEIKDNSH

SEQ ID NO: 4997 - protein, 81 aa, Pongo abelii
CSHRSCREDPGTSESREMDPVAFEDVAVKFTQEEWALLDISQRKLYRELMLETFRNLTSIGKKWKDQNIEYEYKNPRRSFR

SEQ ID NO: 4998 - protein, 81 aa, Pongo abelii
MPCCSHRSCREDPGTSESREMRPESTDCKLRPMRNLQKEVIESSHQAQWLTPVIPALWEAEADGSSQMFQDPVAFEDVAVK

SEQ ID NO: 4999 - protein, 81 aa, Pongo abelii
NLQKEVIESSHQAQWLTPVIPALWEAEADGSSQMFQDPVAFEDVAVKFTQEEWALLDISQRKLYRELMLETFRNLTSIGVS

SEQ ID NO: 5000 - protein, 81 aa, Pongo abelii
DPVAFEDVAVNFTQEEWTLLDISQKNLFREVMLETFWNLTSIGKKWKDQNIEYEYQNPRRSFRSLIEEKPYECKDCGKAFS

SEQ ID NO: 5001 - protein, 81 aa, Pongo abelii
MDPVAFEDVAVKFTQEEWALLDISQRKLYRELMLETFRNLTSIGKKWKDQNIEYEYKNPRRSFRSLIEGNVNEIKEDSHCG

SEQ ID NO: 5002 - protein, 81 aa, Pongo abelii
MMFQDPVAFEDVAVKFTQEEWALLDISQRKLYRELMLETFRNLTSIGKKWKDQNIEYEYKNPRRSFRSLIEGNVNEIKEDS

SEQ ID NO: 5003 - protein, 81 aa, Pongo abelii
PPVLSLSPILLYTCEMFQDPVAFEDVAVKFTQEEWALLDISQRKLYRELMLETFRNLTSIGKKWKDQNIEYEYKNPRRSFR

SEQ ID NO: 5004 - protein, 81 aa, Pongo abelii
MMFQDSVAFEDVAVTFTQEEWALLDPSQKNLYRDVMQETFRNLASIGKKWKAQNIYVEYENLRRNLRIVGERLFESKEGHQ

SEQ ID NO: 5005 - protein, 81 aa, Pongo abelii
MDSVAFEDVAVTFTQEEWALLDPSQKNLYRDVMQETFRNLASIGKKWKAQNIYVEYENLRRNLRIVGERLFESKEGHQHGE

SEQ ID NO: 5006 - protein, 81 aa, Pongo abelii
LLVLSILLYTCEMFQDSVAFEDVAVTFTQEEWALLDPSQKNLYRDVMQETFRNLASIGKKWKAQNIYVEYENLRRNLRIVG

SEQ ID NO: 5007 - protein, 81 aa, Pongo abelii
MDSVAFEDVAVNFTQGEWALLDPSQKNLYREVMQESLRNLASIGKKWNNQYIEDEHQNPRRNLRRLIGERLSESKESHQHG

SEQ ID NO: 5008 - protein, 81 aa, Pongo abelii
MDLVAFEDVAVNFTQEEWSLLDPSQKNLYREVMQETLRNLASIGEKWKDQNIEDQYKNPRNNLRSLLGERVDENTEENRCG

SEQ ID NO: 5009 - protein, 81 aa, Pongo abelii
MNSVAFEDVAVSFTQEEWALLDPSQKSLYRDVMQETFKNLTSVGKTWKVQNIEDEFKNPRRNLRRSFTLVAQAGVQWRDLG

SEQ ID NO: 5010 - protein, 81 aa, Pongo abelii
MMFQNSVAFEDVAVSFTQEEWALLDPSQKSLYRDVMQETFKNLTSVGKTWKVQNIEDEFKNPRRNLSLMREKLCESKESHH

SEQ ID NO: 5011 - protein, 81 aa, Pongo abelii
MNSVAFEDVAVSFTQEEWALLDPSQKSLYRDVMQETFKNLTSVGKTWKVQNIEDEFKNPRRNLSLMREKLCESKESHHCGE

SEQ ID NO: 5012 - protein, 81 aa, Pongo abelii
MDSVAFEDVDVNFTQDEWALLDPSQKNLYRDVMQETFRNLASVGKKWKDQKIEDEYKNPRRNLRGLMGERLLEILESGVGS

SEQ ID NO: 5013 - protein, 81 aa, Pongo abelii
MDSVAFEDVDVNFTQDEWALLDPSQKNLYRDVMQETFRNLASVGKKWKDQKIEDEYKNPRRNLRGLMGERLLESKKDHQHG

SEQ ID NO: 5014 - protein, 81 aa, Pongo abelii
MDSVAFEDVDVNFTQEEWALLDPSQKNLYRDVMWETMRNLASVGKKWKDQNIKDHYKHRGRNLRSHMLERLYQTKDSSQRG

SEQ ID NO: 5015 - protein, 81 aa, Pongo abelii
SLRRGQPEVLGWGLPKDQDSVAFEDVAVNFTHEEWALLGPSQKNLYRDVMRETIRNLNFIGMKWENQNIDDQYQNLRRNSR

SEQ ID NO: 5016 - protein, 81 aa, Pongo abelii
KNLYRDVMRETIRNLNFIGMKWENQNIDDQYQNLRRNSRLSETWLQNFILIHYGHLVALSDGGLLQFSTGQGLPVTQARVQ

SEQ ID NO: 5017 - protein, 81 aa, Pongo abelii
MDSVAFEDVAVNFTHEEWALLGPSQKNLYRDVMRETIRNLNFIGMKWENQNIDDQYQNLRRNSRCDVVERFGKSKDGSQCG

SEQ ID NO: 5018 - protein, 81 aa, Pongo abelii
MDVVAFEDVAVNFTQEEWALLGPSQKNLYRYVMQETIRNLDCIRMIWEEQNTEDQYKNPRRNLRCHMVERFSESKDSSQCG

SEQ ID NO: 5019 - protein, 81 aa, Pongo abelii
RNYFFLPDSQTNEERKQYDSVAFEDVAVNFTREEWALLGPSQKSLYRDVLWETIRNLDCIGMKWEDTNIEDQHKNPRRSLR

SEQ ID NO: 5020 - protein, 81 aa, Pongo abelii
MASVALEDVAVNFTREEWALLGPCQKNLYKDVMQETIRNLDCVGMKWKDQNIEDQYRYPRKNLRCRMLERFVESKDGSQCG

SEQ ID NO: 5021 - protein, 81 aa, Pongo abelii
ASVALEDVAVNFTQEEWALLGPCQKNLYKDVMQETIRNLDCVGMKWKDQNIEDQYRYPRKNLRCRMLERFVESKHGSQCGE

SEQ ID NO: 5022 - protein, 81 aa, Pongo abelii
MDSVVFEDVAVNFTQEEWALLGPSQKKLYRDVMQETFVNLASIGENWEEKNIEDHKNQGRKLRSHMVERLCERKQGSQSGE

SEQ ID NO: 5023 - protein, 81 aa, Pongo abelii
SDQRRHSKEARTPGSQDTDSVVFEDVAVNFTQEEWALLGPSQKKLYRDVMQETFVNLASIGENWEEKNIEDHKNQGRKLRS

SEQ ID NO: 5024 - protein, 81 aa, Pongo abelii
MDSVASEDVAVNFTLEEWALLDPSQKKLYRDVMRETFRNLACVGKKWEDQSIEDWYKNQGRILSNHMEEGLNESKEYDQCG

SEQ ID NO: 5025 - protein, 81 aa, Pongo abelii
VLQMQNSEHHGQSIKTQTDSISLEDVAVNFTLEEWALLDPGQRNIYRDVMRATFKNLACIGEKWKDQDIEDDHKNQGKNLR

SEQ ID NO: 5026 - protein, 81 aa, Pongo abelii
MDSISLEDVAVNFTLEEWALLDPGQRNIYRDVMRATFKNLACIGEKWKDQDIEDDHKNQGKNLRGPVVEALCENKEDRLCG

SEQ ID NO: 5027 - protein, 81 aa, Pongo abelii
MDSVAFKDVSVSFSQEEWALLAPSQKKLYRDVMQETFKNLASIGEKWEDPNVEDQHKNQGRNLRSHMGERLCEGKEGSQCA

SEQ ID NO: 5028 - protein, 81 aa, Pongo abelii
MESVTFEDVAVEFIQEWALLDSARRSLCRYRMLDQCRTLASRGTPPCKPSCVSQLGPRAEPRATEQGILHATGVAWESQLK

SEQ ID NO: 5029 - protein, 81 aa, Pongo abelii
MQDLLEEASSRDMQMGPGLFLRMQLVPSIEERETPLTREDWPALQEPPWSPGCMGLKAAVQIQRVVIPVPTLSHCNPWVAR

SEQ ID NO: 5030 - protein, 81 aa, Pongo abelii
MESVTFEDVAVEFIQEWALLDSARRSLCRYRMLDQCRTLASRGAGAVPEDAAGALHRREGDTIDSRGLASSPGATLVSRMH

SEQ ID NO: 5031 - protein, 81 aa, Pongo abelii
MGPLQFRDVAIEFSLEEWHCLDTTQRNLYRDVMLENYRNLVFLGIVVSKPDLITCLEQGKKPLTMKRHEMIAKPPVMCSHF

SEQ ID NO: 5032 - protein, 81 aa, Pongo abelii
QRRYEKCRHDNLQLKKGCESVDECPMHKRGYNGLKQCLTSTQRKIFQCDEYVKFLHKFSNSNKHKRRDTGKKPFKCIEYGK

SEQ ID NO: 5033 - protein, 81 aa, Pongo abelii
MGPLQFRDVAIEFSLEEWHCLDTTQRNLYRDVMLENYRNLVFLGIVVSKPDLITCLEQGKKPLTMKRHEMIAKPPGQAQWL

SEQ ID NO: 5034 - protein, 81 aa, Pongo abelii
MGPLQFRDVAIEFSLEEWHCLDTTQRNLYRDVMLENYRNLVFLGIVVSKPDLITCLEQGKKPLTMKRHEMIAKPPDGVLLF

SEQ ID NO: 5035 - protein, 81 aa, Pongo abelii
MGPLQFRDVAIEFSLEEWHCLDTTQRNLYRDVMLENYRNLVFLVMCSHFALDLWSEQSIKDSFQKVIQRRYEKCRHDNLQL

SEQ ID NO: 5036 - protein, 81 aa, Pongo abelii
MGPLQFRDVAIEFSLEEWHCLDTTQRNLYRDVMLENYRNLVFLGIVVSKPDLITCLEQGKKPLTMKRHEMIAKPPETVFHR

SEQ ID NO: 5037 - protein, 81 aa, Pongo abelii
MERLQFRDVAIEFSLEEWHCLDTAQRNLYRNVMLENYRHLIFLGIIVSKPDLITCLEYGKNPLTMRREMIAKPPGNKSLFC

SEQ ID NO: 5038 - protein, 81 aa, Pongo abelii
QVLGEPQLNPGTPGSLEMGPLQFRDVAIEFSLEEWHCLDTAQRNLYRDVMLENYRNFVFLGIVVSKPDLVTCLEQGKKPLT

SEQ ID NO: 5039 - protein, 81 aa, Pongo abelii
LRRYEKCRRDNLQLKKGCKSVGEHKVHKGGYNGLNQCLTTTQKKIFQCDKYGKVFHKVSNSNTYKTRHTGINLFKCIICGK

SEQ ID NO: 5040 - protein, 81 aa, Pongo abelii
MGPLQFRDVAIEFSLEEWHCLDTAQRNLYRDVMLENYRNFVFLGIVVSKPDLVTCLEQGKKPLTMKRHEMIAKPPVMSSHF

SEQ ID NO: 5041 - protein, 81 aa, Pongo abelii
MGPLQFRDVAIEFSLEEWHCLDTAQRNLYRNVMLENYSNLVFLGIVVSKPDLITRLEQGKKPLTMKRHEMVANPSGPGVAV

SEQ ID NO: 5042 - protein, 81 aa, Pongo abelii
MGPLQFRDVAIEFSLEEWHCLDTAQRNLYRNVMLENYSNLVFLGIVVSKPDLITRLEQGKKPLTMKRHEMVANPSVICSHF

SEQ ID NO: 5043 - protein, 81 aa, Pongo abelii
MGPLQFRDVAIEFSLEEWHCLDTAQRNLYRNVMLENYSNLVFLGIVVSKPDLITRLEQGKKPLTMKRHEMVANPSDGVNLC

SEQ ID NO: 5044 - protein, 81 aa, Pongo abelii
MGPLQFRDVAIEFSLEEWHCLDTAQRNLYRNVMLENYSNLVFLGIVVSKPDLITRLEQGKKPLTMKRHEMVANPSGARLLS

SEQ ID NO: 5045 - protein, 81 aa, Pongo abelii
MELLTFRDVTIEFSLEEWEFLKPAQQNLYRKVMLENYRNLVSLGLTVSKPELISCLEQRQEPWNVKRHETIAKPPGTYRVG

SEQ ID NO: 5046 - protein, 81 aa, Pongo abelii
MLENYRNLVSLGLTVSKPELISCLEQRQEPWNVKRHETIAKPPAISSHYIEDFLPEQGMKDSFQKVILRRYASCGLEDLHL

SEQ ID NO: 5047 - protein, 81 aa, Pongo abelii
MELLTFRDVTIEFSLEEWEFLKPAQQNLYRKVMLENYRNLVSLGLTVSKPELISCLEQRQEPWNVKRHETIAKPPAISSHY

SEQ ID NO: 5048 - protein, 81 aa, Pongo abelii
MAGSQELLTFRDVTIEFSLEEWEFLKPAQQNLYRKVMLENYRNLVSLGLTVSKPELISCLEQRQEPWNVKRHETIAKPPAI

SEQ ID NO: 5049 - protein, 81 aa, Pongo abelii
MFCFVFQELLTFRDVTIEFSLEEWEFLKPAQQNLYRKVMLENYRNLVSLGLTVSKPELISCLEQRQEPWNVKRHETIAKPP

SEQ ID NO: 5050 - protein, 81 aa, Pongo abelii
MELLTFRDVTIEFSLEEWEFLKPAQQNLYRKVMLENYRNLVSLGLTVSKPELISCLEQRQEPWNVKRHETIAKPPDYSLTI

SEQ ID NO: 5051 - protein, 81 aa, Pongo abelii
MAGSQELLTFRDVTIEFSLEEWEFLKPAQQNLYRKVMLENYRNLVSLGLTVSKPELISCLEQRQEPWNVKRHETIAKPPDT

SEQ ID NO: 5052 - protein, 81 aa, Pongo abelii
MPGPPRSLEMGPLQFRDVAIEFSLEEWHCLDTTQRNLYRDVMLENYRNLVFLGIVVSKPDLITCLEQGIKPLTMKRHEMIA

SEQ ID NO: 5053 - protein, 81 aa, Pongo abelii
MGPLQFRDVAIEFSLEEWHCLDTTQRNLYRDVMLENYRNLVFLGIVVSKPDLITCLEQGIKPLTMKRHEMIANTPDKPSTF

SEQ ID NO: 5054 - protein, 81 aa, Pongo abelii
MGPLLFRDVAIEFSLEEWHCLDTAQWNLFRDVMLENYRNLVFLGIVVSKADLTTHLEQKKRPFTMRRHEMVANPSVMHSHF

SEQ ID NO: 5055 - protein, 81 aa, Pongo abelii
MQSQGPLQFRDVAIEFSLEESHCLDTEQRNLYKDVMLENYRNLIFLGITVSKPDLITCLEQGKKPLTMKRNEMIANPPVMC

SEQ ID NO: 5056 - protein, 81 aa, Pongo abelii
MGPLQFRDVAIEFSLEESHCLDTEQRNLYKDVMLENYRNLIFLGITVSKPDLITCLEQGKKPLTMKRNEMIANPPVMCSHF

SEQ ID NO: 5057 - protein, 81 aa, Pongo abelii
MGPLQFRDVAIEFSLEESHCLDTEQRNLYKDVMLENYRNLIFLGITVSKPDLITCLEQGKKPLTMKRNEMIANPPVSFLQL

SEQ ID NO: 5058 - protein, 81 aa, Pongo abelii
MGSLTFRDVAIEFCLEEWQCLDTAQRNLYRNVMLENYRNLVFLGIAVSKPDLITCLEQGKEAWSMKRHEIMVAKPTVMCSH

SEQ ID NO: 5059 - protein, 81 aa, Pongo abelii
MGSLTFRDVAIEFCLEEWQCLDTAQRNLYRNVMLENYRNLVFLDLITCLEQGKEAWSMKRHEIMVAKPTVMCSHFAQDLWP

SEQ ID NO: 5060 - protein, 81 aa, Pongo abelii
MGSLTFRDVAIEFCLEEWQCLDTAQRNLYRNVMLENYRNLVFLGIAVSKPDLITCLEQGKEAWSMKRHEIMVAKPTESYSV

SEQ ID NO: 5061 - protein, 81 aa, Pongo abelii
MGSLTFRDVAIEFCLEEWQCLDTAQRNLYRNVMLENYRNLVFLGIAVSKPDLITCLEQGKEAWSMKRHEIMVAKPTDGVSL

SEQ ID NO: 5062 - protein, 81 aa, Pongo abelii
MGSLTFRDVAIEFCLEEWQCLDTAQRNLYRNVMLENYRNLVFLGIAVSKPDLITCLEQGKEAWSMKRHEIMVAKPTGGLSK

SEQ ID NO: 5063 - protein, 81 aa, Pongo abelii
MNVMLENYKNLVFLGIAVSKQDPMTSLEQKEPWNMKRHEMVDESPGQVWWLTPVIPALWEARAGGLLEPRSLRLAWSTWKN

SEQ ID NO: 5064 - protein, 81 aa, Pongo abelii
MNVMLENYKNLVFLGIAVSKQDPMTSLEQKEPWNMKRHEMVDESPGYMCRMCSYVFLFYQRPLARARHKRFFSTSDTEKIR

SEQ ID NO: 5065 - protein, 81 aa, Pongo abelii
MNVMLENYKNLVFLAGIAVSKQDPMTSLEQKEPWNMKRHEMVDESPAMCSYFTKDLWPEQDIKDSFQQVILRRYGKCEHEN

SEQ ID NO: 5066 - protein, 81 aa, Pongo abelii
MNVMLENYKNLVFLGIAVSKQDPMTSLEQKEPWNMKRHEMVDESPAMCSYFTKDLWPEQDIKDSFQQVILRRYGKCEHENL

SEQ ID NO: 5067 - protein, 81 aa, Pongo abelii
SGCPGAERNLLVYSYFEKETLTFRDVAIEFSLEEWECLNPAQQNLYMNVMLENYKNLVFLGIAVSKQDPVTCLEQEKEPWN

SEQ ID NO: 5068 - protein, 81 aa, Pongo abelii
SRVQVILLPQPPELGLQETLTFRDVAIEFSLEEWECLNPAQQNLYMNVMLENYKNLVFLGIAVSKQDPVTCLEQEKEPWNM

SEQ ID NO: 5069 - protein, 81 aa, Pongo abelii
ASGCPGAERNLLVYSYFEKETLTFRDVAIEFSLEEWECLNPAQQNLYMNVMLENYKNLVFLAGIAVSKQDPVTCLEQEKEP

SEQ ID NO: 5070 - protein, 81 aa, Pongo abelii
MGPLTFMDVAIEFSLEEWQCLDTAQQNLYRNVMLENYSNLVFLGIAVSNLDLITCLEQGKEPWNMKRHEMVAKPPAMCSHF

SEQ ID NO: 5071 - protein, 81 aa, Pongo abelii
MGPLTFMDVAIEFSLEEWQCLDTAQQNLYRNVMLENYSNLVFLGIAVSNLDLITCLEQGKEPWNMKRHEMVAKPPVIFLQV

SEQ ID NO: 5072 - protein, 81 aa, Pongo abelii
SGYPGAERNLLEYSYFEKGPLTFRDVVIEFSQEEWQCLDRDQQDLYRKVMLENFRNLVFLGIDVSKPDLITCLEQGKDPWN

SEQ ID NO: 5073 - protein, 81 aa, Pongo abelii
TPGPPESLEMGPLTFRDVAIEFSQEEWQCLDTAQQDLYRKVMLENYRNLVFLAGIAVSKPDLVTCLEQGKDPWNMKRHSMV

SEQ ID NO: 5074 - protein, 81 aa, Pongo abelii
MGPLTFRDVAIEFSQEEWQCLDTAQQDLYRKVMLENYRNLVFLGIAVSKPDLVTCLEQGKDPWNMKRHSMVVKPPVICSHF

SEQ ID NO: 5075 - protein, 81 aa, Pongo abelii
TPGPPESLEMGPLTFRDVAIEFSQEEWQCLDTAQQDLYRKVMLENYRNLVFLGIAVSKPDLVTCLEQGKDPWNMKRHSMVV

SEQ ID NO: 5076 - protein, 81 aa, Pongo abelii
EFSQEEWQCLDTAQQDLYRKVMLENYRNLVFLAGIAVSKPDLVTCLEQGKDPWNMKRHSMVVKPPGGDCSIFPMEHQGDVT

SEQ ID NO: 5077 - protein, 81 aa, Pongo abelii
MGPLTFTDVAIEFSLEEWQCLDTAQQNLYRNVMLENYRNLVFLGIAVSKPDLITCLEKEKESCNMKRHEMVDEPPVVCSHF

SEQ ID NO: 5078 - protein, 81 aa, Pongo abelii
MGPLTFTDVAIEFSLEEWQCLDTAQQNLYRNVMLENYRNLVFLGIAVSKPDLITCLEKEKESCNMKRHEMVDEPPDGVLLL

SEQ ID NO: 5079 - protein, 81 aa, Pongo abelii
RRYDKRGHENLQLRKGYKTVGDCKLYKGGYNGLNQCLTLTQSKMYHCDIYVKVFYAFSNADRYKTRHTGKKPFQCKKCGKS

SEQ ID NO: 5080 - protein, 81 aa, Pongo abelii
ASGCPEAERSLLVQSYFEKGPLTFRDVAIEFSLEEWQCLDTDQQGLYRKVMLENYRNLVFLAGIALTKPDLITCLEQGKEP

SEQ ID NO: 5081 - protein, 81 aa, Pongo abelii
SGCPEAERSLLVQSYFEKGPLTFRDVAIEFSLEEWQCLDTDQQGLYRKVMLENYRNLVFLGIALTKPDLITCLEQGKEPWN

SEQ ID NO: 5082 - protein, 81 aa, Pongo abelii
MDVAIEFCLEEWQCLDTAQQNLYRNVMLENYRNLVFLGIAVSKPDLITCLEQEKETWEPMRRHEMVAKPPVMCSHFTQDFW

SEQ ID NO: 5083 - protein, 81 aa, Pongo abelii
MPGHPGSWEMGPLTFMDVAIEFCLEEWQCLDTAQQNLYRNVMLENYRNLVFLGIAVSKPDLITCLEQEKETWEPMRRHEMV

SEQ ID NO: 5084 - protein, 81 aa, Pongo abelii
MGPLTFMDVAIEFCLEEWQCLDTAQQNLYRNVMLENYRNLVFLGIAVSKPDLITCLEQEKETWEPMRRHEMVAKPPVMCSH

SEQ ID NO: 5085 - protein, 81 aa, Pongo abelii
MPGHPGSWEMGPLTFMDVAIEFCLEEWQCLDTAQQNLYRNVMLENYRNLVFLGIAVSKPDLITCLEQEKETWEPMRRHEML

SEQ ID NO: 5086 - protein, 81 aa, Pongo abelii
FMDVAIEFCLEEWQCLDTAQQNLYRNVMLENYRNLVFLGIAVSKPDLITCLEQEKETWEPMRRHEMLCVLILPKTFGQSSI

SEQ ID NO: 5087 - protein, 81 aa, Pongo abelii
MDVAIEFCLEEWQCLDTAQQNLYRNVMLENYRNLVFLGIAVSKPDLITCLEQEKETWEPMRRHEMVAKPPGGIVSLLNVFF

SEQ ID NO: 5088 - protein, 81 aa, Pongo abelii
IEFCLEEWQCLDTAQQNLYRNVMLENYRNLVFLGIAVSKPDLITCLEQEKETWEPMRRHEMVAKPPGGIVSLLNVFFYVQK

SEQ ID NO: 5089 - protein, 81 aa, Pongo abelii
MGSLTFRDVAIQFSLEEWQCLDSTQQNLYRNVMLENYRNLVFLGIAAFKPDLIIFLEQGKEPWNMKRHKMVEEPPDRVSHC

SEQ ID NO: 5090 - protein, 81 aa, Pongo abelii
MGSLTFRDVAIEFSLEEWQCLDSTQQNLYRNVMLENYRNLVFLGIAAFKPDLIIFLEEGKEPWNMKRHKMVEESPGRQSLA

SEQ ID NO: 5091 - protein, 81 aa, Pongo abelii
MGSLTFRDVAIEFSLEEWQCLDSTQQNLYRNVMLENYRNLVFLGIAAFKPDLIIFLEEGKEPWNMKRHKMVEESPDRVLHC

SEQ ID NO: 5092 - protein, 81 aa, Pongo abelii
MGSLTFRDVAIEFSLEEWQCLDSTQQNLYRNVMLENYRNLVFLGIAAFKPDLIIFLEEGKEPWNMKRHKMVEESPGMVGSS

SEQ ID NO: 5093 - protein, 81 aa, Pongo abelii
MGSLTFRDVAIEFSLEEWQCLDSTQQNLYRNVMLENYRNLVFLGIAAFKPDLIIFLEEGKEPWNMKRHKMVEESPVICSHF

SEQ ID NO: 5094 - protein, 81 aa, Pongo abelii
MGPLTIRDVTVEFSLEEWQCLDTVQQNLYRDVMLENYRNLVFLGIAVSKPDLITCLEQGKEPWNMKRHEMVAKPPGSHSVS

SEQ ID NO: 5095 - protein, 81 aa, Pongo abelii
MGPLTIRDVTVEFSLEEWQCLDTVQQNLYRDVMLENYRNLVFLGIAVSKPDLITCLEQGKEPWNMKRHEMVAKPPDGVSLF

SEQ ID NO: 5096 - protein, 81 aa, Pongo abelii
MGPLTIRDVTVEFSLEEWQCLDTVQQNLYRDVMLENYRNLVFLGIAVSKPDLITCLEQGKEPWNMKRHEMVAKPPVMNSCW

SEQ ID NO: 5097 - protein, 81 aa, Pongo abelii
MGPLTIRDVTVEFSLEEWQCLDTVQQNLYRDVMLENYRNLVFLGIAVSKPDLITCLEQGKEPWNMKRHEMVAKPPAFYLMG

SEQ ID NO: 5098 - protein, 81 aa, Pongo abelii
MLENYRNLVFLGIAAFKPDLIIFLEQGKEPWNMKRHEMVEEPPVICSHFAQDLWPEQDIEDSVQKMILRRYERCGHENLHL

SEQ ID NO: 5099 - protein, 81 aa, Pongo abelii
MGSLTFRDVAIELCLEEWQCLDSTQQNLYRNVMLENYRNLVFLGIAAFKPDLIIFLEQGKEPWNMKRHEMVEEPPVICSHF

SEQ ID NO: 5100 - protein, 81 aa, Pongo abelii
MPGAPGSLEMGPLTFRDVTIEFSLEEWQCLDMAQQNLYRDVMLENYRNLVFLGIAVFKPDLITCLKQGKEPWNMKRHEMVT

SEQ ID NO: 5101 - protein, 81 aa, Pongo abelii
MLENYRNLVFLGIAASKPDLITCLEQGKEPWNVKRHEMVAEPPVVWSYFAQDLWPKQGIKNYFQKVILRRYKKCGRENLQL

SEQ ID NO: 5102 - protein, 81 aa, Pongo abelii
MPGPLGSLEMEVLTFRDVAIEFSLEEWQCQDTAQQNLYRNMMLENYRNLVFLGIAASKPDLITCLEQGKEPWNVKRHEMVA

SEQ ID NO: 5103 - protein, 81 aa, Pongo abelii
GIGRSTAKTLGPPGSLEMEVLTFRDVAIELCLEEWQCLDTAQRNLYRKMMLENYRNLVFLGIAASKPDLITCLEQGKEPWN

SEQ ID NO: 5104 - protein, 81 aa, Pongo abelii
MGSLTFRDVTIEFSLEEWQCLDTAQQNLYRDVMLENYRNMVFLGITVSKLDLITCLKQGKEPWNMKRHEMVTKPPVISSHF

SEQ ID NO: 5105 - protein, 81 aa, Pongo abelii
MGSLTFRDVAIQFSLEEWQCLDTAQQNLYRNVMLENYRNLAFLGIAAPKPDLIIFLEQGKEPWNMKRHEMVEELPVTRSHF

SEQ ID NO: 5106 - protein, 81 aa, Pongo abelii
MGALTFRDVAIEFSLEEWQCLDTEQQNLYRNVMLDNYRNLVFLGIAISKPDLITCLEQGKEPWNVKTHDMVAEPPVICSYI

SEQ ID NO: 5107 - protein, 81 aa, Pongo abelii
MGPLTFMDVAIEFSLEEWQCLDTAQQNLYRNVMLENYRNLVFLGIAVSKPDLITCLEQGKEPWNMERHEMVAKPPGMCCYF

SEQ ID NO: 5108 - protein, 81 aa, Pongo abelii
MDVAIEFSLEEWQCLDTAQQNLYRNVMLENYRNLVFLGIAVSKPDLITCLEQGKEPWNMERHEMVAKPPGMCCYFAQDLWP

SEQ ID NO: 5109 - protein, 81 aa, Pongo abelii
TPGTPGSLEMGLLTFRDVAIEFSLEEWQCLDTAQQNLYRNVMLENYRNLAFLGIAVSKPDLITCLEQGKEPWNMKQHEMVD

SEQ ID NO: 5110 - protein, 81 aa, Pongo abelii
MGLLTFRDVAIEFSLEEWQCLDTAQQNLYRNVMLENYRNLAFLGIAVSKPDLITCLEQGKEPWNMKQHEMVDEPPGICPHF

SEQ ID NO: 5111 - protein, 81 aa, Pongo abelii
MGLLTFRDVAIEFSLEEWQCLDTAQRNLYKNVILENYRNLVFLGIAVSKQDLITCLEQEKEPLTVKRHEMVDEPPVMCSHF

SEQ ID NO: 5112 - protein, 81 aa, Pongo abelii
MGLLTFRDVAIEFSLEEWQCLDTAQRNLYKNVILENYRNLVFLGIAVSKQDLITCLEQEKEPLTVKRHEMVDEPPAIDKHP

SEQ ID NO: 5113 - protein, 81 aa, Pongo abelii
MGLLTFRDVAIEFSLEEWQCLDTAQRNLYKNVILENYRNLVFLGIAVSKQDLITCLEQEKEPLTVKRHEMVDEPPESRPVV

SEQ ID NO: 5114 - protein, 81 aa, Pongo abelii
MEPLKFRDVAIEFSLEEWQCLDTIQQNLYRNVMLENYRNLVFLGIAVSKPDLITCLEQEKEPWTRKRHRMVAEPPVICSHF

SEQ ID NO: 5115 - protein, 81 aa, Pongo abelii
MGLLTFRDVAIEFSLEEWQCLDTAQKNLYRNVMLENYRNLAFLGIAVSKPDLIICLEKEKELWNMKRHEMVDEPPDVSLCH

SEQ ID NO: 5116 - protein, 81 aa, Pongo abelii
MGLLTFRDVAIEFSLEEWQCLDTAQKNLYRNVMLENYRNLAFLGIAVSKPDLIICLEKEKELWNMKRHEMVDEPPGLAVSN

SEQ ID NO: 5117 - protein, 81 aa, Pongo abelii
MGLLTFRDVAIEFSLEEWQCLDTAQKNLYRNVMLENYRNLAFLGIAVSKPDLIICLEKEKELWNMKRHEMVDEPPGICPHF

SEQ ID NO: 5118 - protein, 81 aa, Pongo abelii
MLENYRNLAFLGIAVSKPDLITSLEQGKEPWNMKRHEMVDEPSGIYPHFAQDLWPEQGMEDSFQKAILRRYEKYGHENLQL

SEQ ID NO: 5119 - protein, 81 aa, Pongo abelii
MPGPPRSLEMGLLTFMDVAIEFSLEEWQHLDIAQQNLYRNVMLENYRNLAFLGIAVSKPDLITSLEQGKEPWNMKRHEMVD

SEQ ID NO: 5120 - protein, 81 aa, Pongo abelii
MSQVTFSDVAIDFSHEEWACLDSAQRDLYKDVMVQNYENLVSVAGLSITKPYVIMLLEDGKEPWMMEKKLSKDWESRWENE

SEQ ID NO: 5121 - protein, 81 aa, Pongo abelii
MSQVTFSDVAIDFSHEEWACLDSAQRDLYKDVMVQNYENLVSVAGLSITKPYVIMLLEDGKEPWMMEKKLSKVYPFPLSHS

SEQ ID NO: 5122 - protein, 81 aa, Pongo abelii
MSQVTFSDVAIDFSHEEWACLDSAQRDLYKDVMVQNYENLVSVGLSITKPYVIMLLEDGKEPWMMEKKLSKVYPFPLSHSV

SEQ ID NO: 5123 - protein, 81 aa, Pongo abelii
MSQVTFSDVAIDFSHEEWACLDSAQRDLYKDVMVQNYENLVSVGLSITKPYVIMLLEDGKEPWMMEKKLSKDWESRWENEE

SEQ ID NO: 5124 - protein, 81 aa, Pongo abelii
EELVGQNHGMEGEACTGGDVTFSDVAIDFSHEEWACLDSAQRDLYKDVMVQNYENLVSVGLSITKPYVIMLLEDGKEPWMM

SEQ ID NO: 5125 - protein, 81 aa, Pongo abelii
NEELVGQNHGMEGEACTGGDVTFSDVAIDFSHEEWACLDSAQRDLYKDVMVQNYENLVSVGLSITKPYVIMLLEDGKEPWM

SEQ ID NO: 5126 - protein, 81 aa, Pongo abelii
SNEELVGQNHGMEGEACTGGDVTFSDVAIDFSHEEWACLDSAQRDLYKDVMVQNYENLVSVAGLSITKPYVIMLLEDGKEP

SEQ ID NO: 5127 - protein, 81 aa, Pongo abelii
SNEELVGQNHGMEGEACTGEDVTFSDVAIDFSHEEWGWLNSAQRDLYKDVMVQNYENLVSVAGLSVTKPHVIMLLEDGKEP

SEQ ID NO: 5128 - protein, 81 aa, Pongo abelii
MPQVTFSDVAIDFSHEEWGWLNSAQRDLYKDVMVQNYENLVSVAGLSVTKPHVIMLLEDGKEPWMMEKKLSKGMIPDWESR

SEQ ID NO: 5129 - protein, 81 aa, Pongo abelii
MPQVTFSDVAIDFSHEEWGWLNSAQRDLYKDVMVQNYENLVSVGLSVTKPHVIMLLEDGKEPWMMEKKLSKGMIPDWESRW

SEQ ID NO: 5130 - protein, 81 aa, Pongo abelii
MPQVTFSDVAIDFSHEEWGWLNSAQRDLYKDVMVQNYENLVSVAGLSVTKPHVIMLLEDGKEPWMMEKKLSKDWESRWENK

SEQ ID NO: 5131 - protein, 81 aa, Pongo abelii
MAAPALALVSFEDVVVTFTGEEWGHLDLAQRTLYQEVMLETCRLLVSLGHPVPKPELIYLLEHGQELWTVKRGLSQSTCAG

SEQ ID NO: 5132 - protein, 81 aa, Pongo abelii
MAAPALALVSFEDVVVTFTGEEWGHLDLAQRTLYQEVMLETCRLLVSLGHPVPKPELIYLLEHGQELWTVKRGLSQSTCAA

SEQ ID NO: 5133 - protein, 81 aa, Pongo abelii
MAHKYVGLQFQGSVTFEDVAIAFSQQEWESLDSSQRGLYRDVMLENYRNLVSMAGHSLSKPHVIALLEQWKEPEVTVRKDG

SEQ ID NO: 5134 - protein, 81 aa, Pongo abelii
MAHKYVGLQFQGSVTFEDVAIAFSQQEWESLDSSQRGLYRDVMLENYRNLVSMGHSLSKPHVIALLEQWKEPEVTVRKDGR

SEQ ID NO: 5135 - protein, 81 aa, Pongo abelii
MAHFQGSVTFEDVAIAFSQQEWESLDSSQRGLYRDVMLENYRNLVSMAGHSLSKPHVIALLEQWKEPEVTVRKDGRRWCTD

SEQ ID NO: 5136 - protein, 81 aa, Pongo abelii
MAHFQGSVTFEDVAIAFSQQEWESLDSSQRGLYRDVMLENYRNLVSMGHSLSKPHVIALLEQWKEPEVTVRKDGRRWCTDL

SEQ ID NO: 5137 - protein, 81 aa, Pongo abelii
MAQGLVTFRDVAIEFSLEEWKCLEPAQRDLYREVTLENFGHLASLGLSISKPDVVSLLEQGKEPWMIANDVTGPWYPDLES

SEQ ID NO: 5138 - protein, 81 aa, Pongo abelii
MAHGSVTFRDVAIDFSQEEWEFLDPAQRDLYRDVMWENYSNFISLGPSISKPDVITLLDEERKEPEMVVREGTRRYCPDLE

SEQ ID NO: 5139 - protein, 81 aa, Pongo abelii
MAHGSVTFRDVAIDFSQEEWEFLDPAQRDLYRDVMWENYSNFISLGPSISKPDVITLLDEERKEPEMVVREGTRRYCPVFS

SEQ ID NO: 5140 - protein, 81 aa, Pongo abelii
MAHGSVTFRDVAIDFSQEEWEFLDPAQRDLYRDVMWENYSNFISLAGPSISKPDVITLLDEERKEPEMVVREGTRRYCPGE

SEQ ID NO: 5141 - protein, 81 aa, Pongo abelii
MALRSVMFSDVSIDFSPEEWEYLDLEQKDLYRDVMLENYSNLVSLGCFISKPDVISLLEQGKEPWKVVRKGRRQYPDLETK

SEQ ID NO: 5142 - protein, 81 aa, Pongo abelii
MAQESVMFSDVSVDFSQEEWECLNDDQRDLYRDVMLENYSNLVSMGHSVSKPNVISYLEQGKEPWLVDRELTRGQWPVLES

SEQ ID NO: 5143 - protein, 81 aa, Pongo abelii
MAQESVMFSDVSVDFSQEEWECLNDDQRDLYRDVMLENYSNLVSMAGHSVSKPNVISYLEQGKEPWLVDRELTRGQWPVLE

SEQ ID NO: 5144 - protein, 81 aa, Pongo abelii
MPEVEFPDQFFTVLTMDHELVTLRDVVINFSQEEWEYLDSAQRNLYWDVMMENYSNLLSLDLESRNETKHLSVGKDIIKNT

SEQ ID NO: 5145 - protein, 81 aa, Pongo abelii
MPEVEFPDQFFTVLTMDHELVTLRDVVINFSQEEWEYLDSAQRNLYWDVMMENYSNLLSLGRDTRDFFLSSHTRKNSHVKT

SEQ ID NO: 5146 - protein, 81 aa, Pongo abelii
MMENYSNLLSLDLESRNETKHLSVGKDIIKNTGSQWEVMESSKLHGLESSIFRNDWQSKSKIEVQGPEVGYFSQMKIISEN

SEQ ID NO: 5147 - protein, 81 aa, Pongo abelii
TVLTMDHELVTLRDVVINFSQEEWEYLDSAQRNLYWDVMMENYSNLLSLDLESRNETKHLSVGKDIIKNTGSQWEVMESSK

SEQ ID NO: 5148 - protein, 81 aa, Pongo abelii
MPLQGSVSFKDVTVDFTQEEWQQLDPAQKALYRDVMLENYCHFISVGFHMTKPDMIRKLEQGEELWTQRIFPSYSYLEEDG

SEQ ID NO: 5149 - protein, 81 aa, Pongo abelii
FHMTKPDMIRKLEQGEELWTQRIFPSYSYLEEDGKTEDVLVKFKEYQDRHSRPLIFINHKKLIKERSNIYGKTLTLGKNHI

SEQ ID NO: 5150 - protein, 81 aa, Pongo abelii
MSQGSVSFKDVTVDFTQEEWQQLDPAQKALYRDVMLENYCHFISVGFHMTKPDMIRKLEQGEELWTQRIFPSYSYLEEDGK

SEQ ID NO: 5151 - protein, 81 aa, Pongo abelii
MPLQGSVSFKDVTVDFTQEEWQQLDPAQKALYRDVMLENYCHFISVGFHMTKPDMIRKLEQGEELWTQRIFPSYSYLEDGK

SEQ ID NO: 5152 - protein, 81 aa, Pongo abelii
GFHMTKPDMIRKLEQGEELWTQRIFPSYSYLEDGKTEDVLVKFKEYQDRHSRPLIFINHKKLIKERSNIYGKTLTLGKNHI

SEQ ID NO: 5153 - protein, 81 aa, Pongo abelii
MAQGSVSFNDVTVDFTQEEWQHLDHAQKTLYMDVMLENYCHLISVGCHMTKPDVILKLERGEEPWTSFAGHICLEENWKAE

SEQ ID NO: 5154 - protein, 81 aa, Pongo abelii
MDVMLENYCHLISVGCHMTKPDVILKLERGEEPWTSFAGHICLEENWKAEDFLVKFKEHQEKYSRSVVSINHKKLVKEKSK

SEQ ID NO: 5155 - protein, 81 aa, Pongo abelii
MNMEGLVMFQDLSIDFSQEEWECLDTAQKDLYRDVMMENYSSLVSLGLSISKPDVISLLEQGKEPWMVSRDVLGGWCPDRL

SEQ ID NO: 5156 - protein, 81 aa, Pongo abelii
MNMEGLVMFQDLSIDFSQEEWECLDTAQKDLYRDVMMENYSSLVSLGLSISKPDVISLLEQGKEPWMVSRDVLGGWCPGLE

SEQ ID NO: 5157 - protein, 81 aa, Pongo abelii
MNMEGLVMFQDLSIDFSQEEWECLDTAQKDLYRDVMMENYSSLVSLDSKFRCKTKDSCLPKEIYEVISSQWVRMEKCHSLV

SEQ ID NO: 5158 - protein, 81 aa, Pongo abelii
MNMEGLVMFQDLSIDFSQEEWECLDTAQKDLYRDVMMENYSSLVSLGLSISKPDVISLLEQGKEPWMVSRDVLGGWCPDSK

SEQ ID NO: 5159 - protein, 81 aa, Pongo abelii
MAHLMMFRDVAVDFSQEEWECLDLEQRDLYRDVMLENYSNMVSLGLCIYQPEAFSLLEKGKDPWKILRDETRRPCPDMQSR

SEQ ID NO: 5160 - protein, 81 aa, Pongo abelii
HPEEEERMHDELLQAVSKGPVMFRDVSIDFSQEEWECLDSGQMNLYKEVMLENFSNLVSVGLSNSKPAVISLLEQGKEPWM

SEQ ID NO: 5161 - protein, 81 aa, Pongo abelii
YSQESALSEEEEDTTRPLETVTFKDVAVDLTQEEWEQMKPAQRNLYRDVMLENYSNLVTVGCQVTKPDVIFRLEQEEEPWV

SEQ ID NO: 5162 - protein, 81 aa, Pongo abelii
QEEWEQMKPAQRNLYRDVMLENYSNLVTVGCQVTKPDVIFRLEQEEEPWVMEEEMFGRHCPEPRRNCCASEVMEEMEFCSC

SEQ ID NO: 5163 - protein, 81 aa, Pongo abelii
MKPAQRNLYRDVMLENYSNLVTVGCQVTKPDVIFRLEQEEEPWVMEEEMFGRHCPEVWEVDGQIKKQQETLVRKVTSISKK

SEQ ID NO: 5164 - protein, 81 aa, Pongo abelii
YEKGCNPEENCCASEVMEEGLKFKDVVIYFSQKEWECLHSAQKDLYRDVMLENYGNLVLLGLSDTKPNVISLLEQKKEPWM

SEQ ID NO: 5165 - protein, 81 aa, Pongo abelii
MEEGLKFKDVVIYFSQKEWECLHSAQKDLYRDVMLENYGNLVLLGLSDTKPNVISLLEQKKEPWMIKRKETKEWCPDWEFG

SEQ ID NO: 5166 - protein, 81 aa, Pongo abelii
MARKLVMFRDVAIDFSQEEWECLDSAQRDLYRDVMLENYSNLVSLDLPSRCANKDLSPEKNTYETELSQWEMSDRLENCDL

SEQ ID NO: 5167 - protein, 81 aa, Pongo abelii
FRDVAIDFSQEEWECLDSAQRDLYRDVMLENYSNLVSLDLPSRCANKDLSPEKNTYETELSQWEMSDRLENCDLEESNSKD

SEQ ID NO: 5168 - protein, 81 aa, Pongo abelii
TELSQWEMSDRLENCDLEESNSKDYLEAKGKMEKQQENQKEYFRQGMIIYDKMSIFNQHTYLSQHSRCHSTEKPYKCKECG

SEQ ID NO: 5169 - protein, 81 aa, Pongo abelii
LAPDDHGSSYEGSVSFRDVAIDFSREEWRHLDPSQRNLYRDVMLETYSHLLSVGYQVPEAEVVMLEQGKEPWALQGERPRH

SEQ ID NO: 5170 - protein, 81 aa, Pongo abelii
REEWRHLDPSQRNLYRDVMLETYSHLLSVGYQVPEAEVVMLEQGKEPWALQGERPRHSCPVTHLPFPSTMTKSFLGLTRSQ

SEQ ID NO: 5171 - protein, 81 aa, Pongo abelii
SPQKSSALAPDDHGSSYEGSVSFRDVAINFSREEWQHLDLSQRNLYRDVMLETYSHLLSVGYQVPKPEVVMLEQGKEPWAL

SEQ ID NO: 5172 - protein, 81 aa, Pongo abelii
VAIDFSREEWRHLDPSQRNLYRDVMLETYSHLLSVGYQVPEAEVVMLEQGKEPWALQGERPRHSCPAQCRVNSHHLQESLG

SEQ ID NO: 5173 - protein, 81 aa, Pongo abelii
MQLNEEINKGSVSFRDVAINFSREEWQHLDLSQRNLYRDVMLETYSHLLSVGYQVPKPEVVMLEQGKEPWALQGERPRHSC

SEQ ID NO: 5174 - protein, 81 aa, Pongo abelii
REEWQHLDLSQRNLYRDVMLETYSHLLSVGYQVPKPEVVMLEQGKEPWALQGERPRHSCPGEKLWDHNQHRKIIGYKPASS

SEQ ID NO: 5175 - protein, 81 aa, Pongo abelii
NEEINKGSVSFRDVAINFSREEWQHLDLSQRNLYRDVMLETYSHLLSVGYQVPKPEVVMLEQGKEPWALQGERPRHSCPGE

SEQ ID NO: 5176 - protein, 81 aa, Pongo abelii
MAEGSVMFSDVSIDFSQEEWDCLDPVQRDLYRDVMLENYSNLVSMGKGICTSDSQFSSGMSASSTVNFSAAFEDFTLLSLK

SEQ ID NO: 5177 - protein, 81 aa, Pongo abelii
MLETYNHLVSLEIPSSKPKLIAQLERGEEPWREERKCPLDLCPESKPEIQLCLSRPLIFSSQQALSQHVWLSHLSQLFSSL

SEQ ID NO: 5178 - protein, 81 aa, Pongo abelii
GEEPWREERKCPLDLCPESKPEIQLCLSRPLIFSSQQALSQHVWLSHLSQLFSSLWAGNPLQLGKHYPEDQKQQQDPFCLS

SEQ ID NO: 5179 - protein, 81 aa, Pongo abelii
MLETYNHLVSLEIPSSKPKLIAQLERGEEPWREERKCPLDLCPDRALLCHQAGIQWHGISSLQPLPPGFKQFPCLSLLSSW

SEQ ID NO: 5180 - protein, 81 aa, Pongo abelii
MATGLLRAKKEEEWRLLSPAQRTLHREVMLETYNHLVSLEIPSSKPKLIAQLERGEEPWREERKCPLDLCPAESKPEIQLC

SEQ ID NO: 5181 - protein, 81 aa, Pongo abelii
KLIAQLERGEEPWREERKCPLDLCPAESKPEIQLCLSRPLIFSSQQALSQHVWLSHLSQLFSSLWAGNPLQLGKHYPEDQK

SEQ ID NO: 5182 - protein, 81 aa, Pongo abelii
EEPWREERKCPLDLCPESKPEIQLCLSRPLIFSSQQALSQHVWLSHLSQLFSSLWAGNPLQLGKHYPEDQKQQQDPFCLSG

SEQ ID NO: 5183 - protein, 81 aa, Pongo abelii
EPWREERKCPLDLCPAESKPEIQLCLSRPLIFSSQQALSQHVWLSHLSQLFSSLWAGNPLQLGKHYPEDQKQQQDPFCLSG

SEQ ID NO: 5184 - protein, 81 aa, Pongo abelii
MAVGLCKAMSQGLVTFRDVALDFSQEEWEWLKPSQKDLYRDVMLENYRNLVWLGDGCSCHSTLRTTATAEASSSSSSIQAS

SEQ ID NO: 5185 - protein, 81 aa, Pongo abelii
MTESQGTVTFKDVAIDFTQEEWKRLDPAQRNLYRNVMLENYNNLITVGYPFTKPDVIFKLEQEEEPWVMEEEVLRRHWQGE

SEQ ID NO: 5186 - protein, 81 aa, Pongo abelii
TSAGPIPSQKEEEMTESQGTVTFKDVAIDFTQEEWKRLDPAQRNLYRNVMLENYNNLITVGYPFTKPDVIFKLEQEEEPWV

SEQ ID NO: 5187 - protein, 81 aa, Pongo abelii
EMTESQGTVTFKDVAIDFTQEEWKRLDPAQRNLYRNVMLENYNNLITVGYPFTKPDVIFKLEQEEEPWVMEEEVLRRHWQG

SEQ ID NO: 5188 - protein, 81 aa, Pongo abelii
KSQEEERMAVGLLKAVYQELVTFRDVAVDFSQEEWDCLDSSQRHLYSNVMLENYRILVSLGLCFSKPSVILLLEQGKAPWM

SEQ ID NO: 5189 - protein, 81 aa, Pongo abelii
MAVGLLKAVYQELVTFRDVAVDFSQEEWDCLDSSQRHLYSNVMLENYRILVSLGLCFSKPSVILLLEQGKAPWMVKRELTK

SEQ ID NO: 5190 - protein, 81 aa, Pongo abelii
QGKAPWMVKRELTKGLCSGWEPVCETEELTPKQDFYEEHQSQKIIETLTSYNLEYSSLRKEWKCEGYFERQPGNQKVCFKE

SEQ ID NO: 5191 - protein, 81 aa, Pongo abelii
VVVGFTQEEWHRLSPAQRALYRDVMLETYSNLVSVGYEGTKPDVILRLEQEEAPWIGEAACPGCHCWGISKLWPTDWPPAL

SEQ ID NO: 5192 - protein, 81 aa, Pongo abelii
EWHRLSPAQRALYRDVMLETYSNLVSVGYEGTKPDVILRLEQEEAPWIGEAACPGCHCWEDIWQVNIQRKRRQDMLLRQGA

SEQ ID NO: 5193 - protein, 81 aa, Pongo abelii
EYRCQIFFQEQQKMIEYQIPVSFKDVVVGFTQEEWHRLSPAQRALYRDVMLETYSNLVSVGYEGTKPDVILRLEQEEAPWI

SEQ ID NO: 5194 - protein, 81 aa, Pongo abelii
EWHRLSPAQRALYRDVMLETYSNLVSVGYEGTKPDVILRLEQEEAPWIGEAACPGCHCWVAVPFYIPTSNAQGFQFLHNLT

SEQ ID NO: 5195 - protein, 81 aa, Pongo abelii
SFKDVVVGFTQEEWHRLSPAQRALYRDVMLETYSNLVSVGYEGTKPDVILRLEQEEAPWIGEAACPGCHCWDLTVLRELQP

SEQ ID NO: 5196 - protein, 81 aa, Pongo abelii
FKDVVVGFTQEEWHRLSPAQRALYRDVMLETYSNLVSVGYEGTKPDVILRLEQEEAPWIGEAACPGCHCWDLTVLRELQPR

SEQ ID NO: 5197 - protein, 81 aa, Pongo abelii
MAHALVTFRDVTIDFSQKEWECLDTTQRKLYRDVMLENYNNLVSLGYSGSKPDVITLLEQGKEPCVAARDVTGRQYPGLLS

SEQ ID NO: 5198 - protein, 81 aa, Pongo abelii
MAHALVTFRDVTIDFSQKEWECLDTTQRKLYRDVMLENYNNLVSLGLLSRHKTKKLSSEKDIHDISLSKGSKIEKSKTLHL

SEQ ID NO: 5199 - protein, 81 aa, Pongo abelii
MAHALVTFRDVTIDFSQKEWECLDTTQRKLYRDVMLENYNNLVSLAGYSGSKPDVITLLEQGKEPCVAARDVTGRQYPGLL

SEQ ID NO: 5200 - protein, 81 aa, Pongo abelii
MPHLLVTFRDVAIDFTQEEWECLDPAQRDLYRDVMLENYSNLISLEPARTHEEQHNLPVPKAGSVNLAAGFGHSRSQTGCG

SEQ ID NO: 5201 - protein, 81 aa, Pongo abelii
MPHLLVTFRDVAIDFTQEEWECLDPAQRDLYRDVMLENYSNLISLDLESSCATKKLSPEKEIYEMESLQWENMGNLINHHL

SEQ ID NO: 5202 - protein, 81 aa, Pongo abelii
MDLLFQLLVTFRDVAIDFTQEEWECLDPAQRDLYRDVMLENYSNLISLDLESSCATKKLSPEKEIYEMESLQWENMGNLIN

SEQ ID NO: 5203 - protein, 81 aa, Pongo abelii
LFQLLVTFRDVAIDFTQEEWECLDPAQRDLYRDVMLENYSNLISLDLESSCATKKLSPEKEIYEMESLQWENMGNLINHHL

SEQ ID NO: 5204 - protein, 81 aa, Pongo abelii
MTFRDAAIDFSKEEWECLGPAQRDLYRDVMLENYSNFVSLGLAISKPSVISLLEQGKEPWMAGKTGRYPDMLSRHQRIHKG

SEQ ID NO: 5205 - protein, 81 aa, Pongo abelii
MTFRDAAIDFSKEEWECLGPAQRDLYRDVMLENYSNFVSLGLAISKPSVISLLEQGKEPWMAGKTGRYPDMLSRYETKELR

SEQ ID NO: 5206 - protein, 81 aa, Pongo abelii
MACGSITFRDVAIDFSHQEWEYLNLVQKTLYQEVMMENYDNLVLLAGHSKSKPDLITLLEQGKEPWMIVREETRGECTDLD

SEQ ID NO: 5207 - protein, 81 aa, Pongo abelii
MACGSITFRDVAIDFSHQEWEYLNLVQKTLYQEVMMENYDNLVLLGHSKSKPDLITLLEQGKEPWMIVREETRGECTDLDS

SEQ ID NO: 5208 - protein, 81 aa, Pongo abelii
MACGSITFRDVAIDFSHQEWEYLNLVQKTLYQEVMMENYDNLVLLGHSKSKPDLITLLEQGKEPWMIVREETRGECTELQS

SEQ ID NO: 5209 - protein, 81 aa, Pongo abelii
HRVGLIRSYNSKTMTCFQELVTFRDVAIDFSRQEWEYLDPNQRDLYRDVMLENYRNLVSLGGHSISKPVVVDLLERGKEPW

SEQ ID NO: 5210 - protein, 81 aa, Pongo abelii
MLENYRNLVSLDLDLQCEIISYIEVPTYETDISSTQLQSIYKREKLYECKKCQKKFSSGYQLILHHRFHIIERPYECKECG

SEQ ID NO: 5211 - protein, 81 aa, Pongo abelii
HRVGLIRSYNSKTMTCFQELVTFRDVAIDFSRQEWEYLDPNQRDLYRDVMLENYRNLVSLEMRSRCVAQVGLKLLVSSDPP

SEQ ID NO: 5212 - protein, 81 aa, Pongo abelii
EPHRVGLIRSYNSKTMTCELVTFRDVAIDFSRQEWEYLDPNQRDLYRDVMLENYRNLVSLGGHSISKPVVVDLLERGKEPW

SEQ ID NO: 5213 - protein, 81 aa, Pongo abelii
EETQGELTSSCGSKTMANVSLAFRDVSIDLSQEEWECLDPVQRDLYKDVMLENYSNLVSLGYTIPKPDVITLLEQEKEPWI

SEQ ID NO: 5214 - protein, 81 aa, Pongo abelii
YKDVMLENYSNLVSLGYTIPKPDVITLLEQEKEPWIVMREGTRNWYTDLEYKYITKNLLSEKNVCKIYLSQLQTGEKSKNT

SEQ ID NO: 5215 - protein, 81 aa, Pongo abelii
LYKDVMLENYSNLVSLGYTIPKPDVITLLEQEKEPWIVMREGTRNWYTESRSVTQAGVQWHNLGSLQPPPPGFKQFFCLSL

SEQ ID NO: 5216 - protein, 81 aa, Pongo abelii
MQVDPPLHRPPNDFLIFQIIPLHSLSIMPWFLWILCFSMEETQGELTSSCGSKTMANVSLAFRDVSIDLSQEEWECLDPVQ

SEQ ID NO: 5217 - protein, 81 aa, Pongo abelii
MVHGSVTFRDVAIDFSQEEWECLQPNQRTLYRDVMLENYSHLISLGSSISKPDVITLLEQEKEPWIVVSKETSRWYPDLES

SEQ ID NO: 5218 - protein, 81 aa, Pongo abelii
MVHGSVTFRDVAIDFSQEEWECLQPNQRTLYRDVMLENYSHLISLAGSSISKPDVITLLEQEKEPWIVIWSQNMDLRKYLQ

SEQ ID NO: 5219 - protein, 81 aa, Pongo abelii
MLENYSHLISLGSSISKPDVITLLEQEKEPWMVVRKETSRRYPDLESKYGPEKVSSENDTSEVNLPKQVIKQISTTLGLEA

SEQ ID NO: 5220 - protein, 81 aa, Pongo abelii
GRSLRKIDQFCNSRNMVHGSVTFRDVAIDFSQEEWECLQPDQRTLYRDVMLENYSHLISLGSSISKPDVITLLEQEKEPWM

SEQ ID NO: 5221 - protein, 81 aa, Pongo abelii
KSCSGFSGFCASPIEESHGALISSCNSRTMTDGLVTFRDVAIDFSQEEWECLDPAQRDLYVDVMLENYSNLVSLGKVICLK

SEQ ID NO: 5222 - protein, 81 aa, Pongo abelii
MAQVPLTFSDVAIDFSQEEWEYLNSDQRDLYRDVMLENYTNLVSLDFDFTTESDKLSSEKRNYEVNAYHQETWKRNKTFNL

SEQ ID NO: 5223 - protein, 81 aa, Pongo abelii
FQVPLTFSDVAIDFSQEEWEYLNSDQRDLYRDVMLENYTNLVSLDFDFTTESDKLSSEKRNYEVNAYHQETWKRNKTFNLM

SEQ ID NO: 5224 - protein, 81 aa, Pongo abelii
MTKSKEAVTFKDVAVVFSEEELQLLDLAQRKLYRDVMLENFRNVVSVGHQSTPDGLPQLEREEKLWMMKMATQRDNSSGSK

SEQ ID NO: 5225 - protein, 81 aa, Pongo abelii
MLENFRNVVSVGHQSTPDGLPQLEREEKLWMMKMATQRDNSSGSKNLKEMETLQEVGLRYLPHEELFCSQIWQQITRELIK

SEQ ID NO: 5226 - protein, 81 aa, Pongo abelii
HSGLCKFPEVEGKMTTFKEAVTFKDVAVVFTEEELGLLDPAQRKLYRDVMLENFRNLLSVGNQQFHQDTFHFLRKEKFWMM

SEQ ID NO: 5227 - protein, 81 aa, Pongo abelii
LRKEKFWMMKTTSQREGNSEGKIQIEMETVPEAGPHEEWSCQQIWEQIASDLTRSQNSIRNSSQFFKEGDVPCQIEAGLSI

SEQ ID NO: 5228 - protein, 81 aa, Pongo abelii
AQRKLYRDVMLENFRNLLSVGNQQFHQDTFHFLRKEKFWMMKTTSQREGNSEGKIQIEMETVPEAGPHEEWSCQQIWEQIA

SEQ ID NO: 5229 - protein, 81 aa, Pongo abelii
MTTFKEAVTFKDVAVFFTEEELGLLDPAQRKLYRDVMLENFRNLLSMGHQPFHQDTFHFLKEETFWMMGTATQREGNSGGK

SEQ ID NO: 5230 - protein, 81 aa, Pongo abelii
LKEETFWMMGTATQREGNSGGKIQTELESVPEAGAHEEWSCQQIWEQIAKDLTRSQDSIINNSQFFENGDVPSQVEAGLPT

SEQ ID NO: 5231 - protein, 81 aa, Pongo abelii
MIKRSKVLVFCSKIMEEAVTFKDVAVFFTEEELGLLDPAQRKLYRDVMLENFRNLLSMGHQPFHQDTFHFLKEETFWMMGT

SEQ ID NO: 5232 - protein, 81 aa, Pongo abelii
DVMLENFRNLLSMGHQPFHQDTFHFLKEETFWMMGTATQREGNSGGKIQTELESVPEAGAHEEWSCQQIWEQIAKDLTRSQ

SEQ ID NO: 5233 - protein, 81 aa, Pongo abelii
SQFFEQGDVPSQVEAGLSIIHKGQKPSQNGKCKQSFSDVAIFDFPQQLHSGEKSHTCNECGKSFCYISALRIHQRVHLREK

SEQ ID NO: 5234 - protein, 81 aa, Pongo abelii
MIDSGEKKSGRRTKEAVTFKDVAVVFTEEELGLLDPAQRKLYRDVMLENFRNLLSVGHQPFHGDTFHFLREEKFWVMETTS

SEQ ID NO: 5235 - protein, 81 aa, Pongo abelii
GRRTKEAVTFKDVAVVFTEEELGLLDPAQRKLYRDVMLENFRNLLSVGHQPFHGDTFHFLREEKFWVMETTSQREGNSGPL

SEQ ID NO: 5236 - protein, 81 aa, Pongo abelii
RAKLYEAVTFKDVAVVFTEEELGLLDPAQRKLYRDVMLENFRNLLSVGGKIQTEMETVPEAGTREEFSCKQIWEQIASDLI

SEQ ID NO: 5237 - protein, 81 aa, Pongo abelii
HSGLCKFPKVGGKMTMSKEAVTFKDVAVVFTEEELGLLDLAQRKLYRDVMLENFRNLLSVGHQPFHRDTFYFLREEKFWMM

SEQ ID NO: 5238 - protein, 81 aa, Pongo abelii
MTMSKEAVTFKDVAVVFTEEELGLLDLAQRKLYRDVMLENFRNLLSVGHQPFHRDTFYFLREEKFWMMDIATQREGNSGGK

SEQ ID NO: 5239 - protein, 81 aa, Pongo abelii
MTMSKEAVTFKDVAVVFTEEELGLLDLAQRKLYRDVMLENFRNLLSVGHQPFHRDTFYFLREEKFWMMDIATQREGNSGKK

SEQ ID NO: 5240 - protein, 81 aa, Pongo abelii
TFKDVAVVFTEEELGLLDLAQRKLYRDVMLENFRNLLSVGHQPFHRDTFYFLREEKFWMMDIATQREGNSGKKYATVCPCL

SEQ ID NO: 5241 - protein, 81 aa, Pongo abelii
MTMSKEAVTFKDVAVVFTEEELGLLDLAQRKLYRDVMLENFRNLLSVGHQPFHRDTFYFLREEKFWMMDIATQREGNSGGS

SEQ ID NO: 5242 - protein, 81 aa, Pongo abelii
DVAVVFTEEELGLLDLAQRKLYRDVMLENFRNLLSVGHQPFHRDTFYFLREEKFWMMDIATQREGNSGGSVQASECRNWSK

SEQ ID NO: 5243 - protein, 81 aa, Pongo abelii
MLENFRNLLSVGHQPFHRDTFYFLREEKFWMMDIATQREGNSGGKIQPEMKTFPEAGPHEGWSCQQIWEEIASDLTRPLDS

SEQ ID NO: 5244 - protein, 81 aa, Pongo abelii
MTMFKEAVTFKDVAVVFTEEELGLLDLAQRKLYRDVMLENFRNLLSVGHQTSHRDAFHFRREEKFWMMETATQREGNSGGK

SEQ ID NO: 5245 - protein, 81 aa, Pongo abelii
RREEKFWMMETATQREGNSGGKIQTELESVPETGPHEEWSCQQIWEQTESELTRPQDSISSSQFSTQGDVPSQVDAGLSII

SEQ ID NO: 5246 - protein, 81 aa, Pongo abelii
MTTFKEAMTFKDVAVVFTEEELGLLDLAQRKLYRDVMLENFRNLLSVGHQAFHRDTFHFLKEEKIWMMKTATQREGNSGDK

SEQ ID NO: 5247 - protein, 81 aa, Pongo abelii
FLKEEKIWMMKTATQREGNSGDKIQTEMETVSEAGTNQEWSCQQIWEKIASDLTRSQDLVINSSQFSKEGDFPCQTEAGLS

SEQ ID NO: 5248 - protein, 81 aa, Pongo abelii
LLSVGHQAFHRDTFHFLKEEKIWMMKTATQREGNSGDKIQTEMETVSEAGTNQEWSCQQIWEKIASDLTRSQDLVINSSQF

SEQ ID NO: 5249 - protein, 80 aa, Pongo abelii
MTTFKEAMTFKDVAVVFTEEELGLLDLAQRKLYRDVMLENFRNLLSVGHQAFHRDTFHFLKEEKIWMMKTATQREGNSET

SEQ ID NO: 5250 - protein, 81 aa, Pongo abelii
MATLKEAVTFKDVAVVFTEEELRLLDLAQRKLYQEVMLENFRNLLSVGHQPLHRDTFHFLKEEKFWMMETATQREGNLGGK

SEQ ID NO: 5251 - protein, 81 aa, Pongo abelii
RNLLSVGHQPLHRDTFHFLKEEKFWMMETATQREGNLGGKIQTEMETVPESGAHEGLFSHQTWEQISSDLTRFQDSMVNSF

SEQ ID NO: 5252 - protein, 81 aa, Pongo abelii
MATLKEAVTFKDVAVVFTEEELRLLDLAQRKLYQEVMLENFRNLLSVGHQPLHRDTFHFLKEEKFWMMETATQREGNLGLA

SEQ ID NO: 5253 - protein, 81 aa, Pongo abelii
MTTFKEGLTFKDVAVVFTEEELGLLDPVQRNLYRDVMLENFRNLLSVGHHPFKHDVFPLEKEKKLDIMKTATQRKGKSADK

SEQ ID NO: 5254 - protein, 81 aa, Pongo abelii
MNMFKEAVTFKDVAVAFTEEELGLLGPAQRKLYRDVMVENFRNLLSVGHQPFKQDVSPIERNEQLWIVTTATRRQGNLGEK

SEQ ID NO: 5255 - protein, 81 aa, Pongo abelii
VGHQPFKQDVSPIERNEQLWIVTTATRRQGNLGEKNQSKLITVQDRESEEELSCWQIWQQIANDLTRCQDSMINNYQFHKQ

SEQ ID NO: 5256 - protein, 81 aa, Pongo abelii
MNMFKEAVTFKDVAVAFTEEELGLLGPAQRKLYRDVMVENFRNLLSVGHQPFKQDVSPIERNEQLWIVTTATRRQGNLGKN

SEQ ID NO: 5257 - protein, 81 aa, Pongo abelii
MNMFKEAVTFKDVAVAFTEEELGLLGPAQRKLYRDVMVENFRNLLSVGHQPFKQDVSPIERNEQLWIVTTATRRQGNLDTL

SEQ ID NO: 5258 - protein, 81 aa, Pongo abelii
MVENFRNLLSVGHQPFKQDVSPIERNEQLWIVTTATRRQGNLGEKNQSKLITVQDRESEEELSCWQIWQQIANDLTRCQDS

SEQ ID NO: 5259 - protein, 81 aa, Pongo abelii
TTATRRQGNLGEKNQSKLITVQDRESEEELSCWQIWQQIANDLTRCQDSMINNYQFHKQGDFPCQVGTELSIQISEDENYL

SEQ ID NO: 5260 - protein, 81 aa, Pongo abelii
IERNEQLWIVTTATRRQGNLGEKNQSKLITVQDRESEEELSCWQIWQQIANDLTRCQDSMINNYQFHKQGDFPCQVGTELS

SEQ ID NO: 5261 - protein, 81 aa, Pongo abelii
MNMFKEAVTFKDVAVAFTEEELGLLGPAQRKLYRDVMVENFRNLLSVGHQPFKQDVSPIERNEQLWIVTTATRRQGNLGYF

SEQ ID NO: 5262 - protein, 81 aa, Pongo abelii
SQNYDLPQKEQEKMTKFQEAVTFKDVAVVFSREELRLLDLTQRKLYRDVMVENFKNLVAVGHLPFQPDMVSQLEAEEKLWM

SEQ ID NO: 5263 - protein, 81 aa, Pongo abelii
SQNYDLPQKEQEKMTKFQEAVTFKDVAVVFSREELRLLDLTQRKLYRDVMVENFKNLVAVGSKHQNKMEALQKFALKYLSN

SEQ ID NO: 5264 - protein, 81 aa, Pongo abelii
MPSQNYDLPQKEQEKMTKFQEAVTFKDVAVVFSREELRLLDLTQRKLYRDVMVENFKNLVAVGHLPFQPDMVSQLEAEEKL

SEQ ID NO: 5265 - protein, 81 aa, Pongo abelii
PSQNYDLPQKEQEKMTKFQEAVTFKDVAVVFSREELRLLDLTQRKLYRDVMVENFKNLVAVGHLPFQPDMVSQLEAEEKLW

SEQ ID NO: 5266 - protein, 81 aa, Pongo abelii
MTKFREAVTFKDVAVAFTEEELGLLDSAQKKLYRDVMLENFRNLVSVGHQSFKPDMISQLEMEEKLWMKELQTQRGKDSET

SEQ ID NO: 5267 - protein, 81 aa, Pongo abelii
MTKFREAVTFKDVAVAFTEEELGLLDSAQKKLYRDVMLENFRNLVSVGHQSFKPDMISQLEMEEKLWMKELQTQRGKDSVW

SEQ ID NO: 5268 - protein, 81 aa, Pongo abelii
MTKFREAVTFKDVAVAFTEEELGLLDSAQKKLYRDVMLENFRNLVSVGHQSFKPDMISQLEMEEKLWMKELQTQRGKDSGF

SEQ ID NO: 5269 - protein, 81 aa, Pongo abelii
MTKFREAVTFKDVAVAFTEEELGLLDSAQKKLYRDVMLENFRNLVSVGHQSFKPDMISQLEMEEKLWMKELQTQRGKDSGD

SEQ ID NO: 5270 - protein, 81 aa, Pongo abelii
MTKFREAVTFKDVAVAFTEEELGLLDSAQKKLYRDVMLENFRNLVSVGHQSFKPDMISQLEMEEKLWMKELQTQRGDRNQN

SEQ ID NO: 5271 - protein, 81 aa, Pongo abelii
PRTLPFPRRRRGKMTKFREAVTFKDVAVAFTEEELGLLDSAQKKLYRDVMLENFRNLVSVGHQSFKPDMISQLEMEEKLWM

SEQ ID NO: 5272 - protein, 81 aa, Pongo abelii
MTKFQEMVTFKDVAVVFTREEVGLLDVAQRKLYQDVMLENFRNLLSVGYQPFKLDVVLQLGKEDKLWMMETEIQGDGCSGE

SEQ ID NO: 5273 - protein, 81 aa, Pongo abelii
MTKFQEMVTFKDVAVVFTREEVGLLDVAQRKLYQDVMLENFRNLLSVGYQPFKLDVVLQLGKEDKLWMMETEIQGDGCSGH

SEQ ID NO: 5274 - protein, 81 aa, Pongo abelii
FWRYNHVLPSQDPALPQKEQEKMTKFQEMVTFKDVAVVFTREEVGLLDVAQRKLYQDVMLENFRNLLSVGYQPFKLDVVLQ

SEQ ID NO: 5275 - protein, 81 aa, Pongo abelii
MTKFQEMVTFKDVAVVFTREEVGLLDVAQRKLYQDVMLENFRNLLSVGYQPFKLDVVLQLGKEDKLWMMETEIQGDGCSGL

SEQ ID NO: 5276 - protein, 81 aa, Pongo abelii
MCSCDPSLWTEEKVTFKDMAVVFTKEELALLDKPQINLYQDVMLENFRKLISRQGLTVLPRLVSNSLAQAILPPQPPKMLE

SEQ ID NO: 5277 - protein, 81 aa, Pongo abelii
VLPRLVSNSLAQAILPPQPPKMLEITDGVSSVTQAEVQWRNLSSLQALPFCVNIESFVKKIFFLPRRKVGEIQQKCFWIKT

SEQ ID NO: 5278 - protein, 81 aa, Pongo abelii
HSQASAVSQDREDKIMSQEPLSFKDVAVVFTEEELELLDSTQRQLYQDVMQENFRNLLSVGDKNGKDMEYIQDEELRFFSH

SEQ ID NO: 5279 - protein, 81 aa, Pongo abelii
HSQASAVSQDREDKIMSQEPLSFKDVAVVFTEEELELLDSTQRQLYQDVMQENFRNLLSVGERNPLGDKNGKDMEYIQDEE

SEQ ID NO: 5280 - protein, 81 aa, Pongo abelii
TLTSRHEKRALHSQASAVSQDREDKIMSQEPLSFKDVAVVFTEEELELLDSTQRQLYQDVMQENFRNLLSVGERNPLGNWN

SEQ ID NO: 5281 - protein, 81 aa, Pongo abelii
SMEEQDDKPPEPPKACAQEGVNFKIVTVDFTQEEQGTWNPAQRTLDRDVILENHRDLVSWDLATAVGKKDSTSKQRIFDEE

SEQ ID NO: 5282 - protein, 81 aa, Pongo abelii
MSQDLVTFTDVAVNFTKEEWTLLDPAQRNLYRDVMLENSRNLAFIDWATPCKTKDATPQPDILPKRTFPEANRVCLKSISS

SEQ ID NO: 5283 - protein, 81 aa, Pongo abelii
IRDEIDMGANRHQRNPFGKAFCEDGSFRAHNTHVRDKMCDFTQCENTSRNNSIHAVQMQSYTAETNKKDCQTGATSADAPN

SEQ ID NO: 5284 - protein, 81 aa, Pongo abelii
PSSASQVAKTTGNHPHSRDLVTFTDVAVNFTKEEWTLLDPAQRNLYRDVMLENSRNLAFIDWATPCKTKDATPQPDILPKR

SEQ ID NO: 5285 - protein, 81 aa, Pongo abelii
MAEEFVTLKDVGMDFTLGDWEQLGLEQGDMFWDTALDSCQDLFLLNPPRPNLTSHPDGDEDLEPLAGGSPEATGPDVTETK

SEQ ID NO: 5286 - protein, 81 aa, Pongo abelii
MDFTLGDWEQLGLEQGDMFWDTALDSCQDLFLLNPPRPNLTSHPDGDEDLEPLAGGSPEATGPDVTETKNSPLMEDFFEEG

SEQ ID NO: 5287 - protein, 81 aa, Pongo abelii
LSQKPQVLGPEEQDGSCEASVSFEDVTVDFSREEWQQLDPAQRRLYQDVMLELYSHLFSVGYHIPNPDVIFRMLKEKEPRV

SEQ ID NO: 5288 - protein, 81 aa, Pongo abelii
NATIVMSVRREQGSSSGEGSLSFEDVAVGFTREEWQFLDQSQKVLYKEVMLENYSNLVSVGYQGTKPDSLFKLEQGEPPWI

SEQ ID NO: 5289 - protein, 81 aa, Pongo abelii
NATIVMSVRREQGSSSGEGSLSFEDVAVGFTREEWQFLDQSQKVLYKEVMLENYSNLVSVGTKPDSLFKLEQGEPPWIVEG

SEQ ID NO: 5290 - protein, 81 aa, Pongo abelii
MTKAQESLTLKDVAVDFTWEEWQLLGPAQKRLYRDVMLENYSNLVSVGYQASKPDALTKLEQGEPLWTLEDEIHSPAHPEI

SEQ ID NO: 5291 - protein, 81 aa, Pongo abelii
MLENYSNLVSVGYQASKPDALFKLDQGEPWTVENEIHSQICPEIKKVDNHLQMHSQNQRCLKRVEQCHKHNAFGNIIHQRK

SEQ ID NO: 5292 - protein, 81 aa, Pongo abelii
YSNLVSVGYQASKPDALFKLDQGEPWTVENEIHSQICPEIKKVDNHLQMHSQNQRCLKRVEQCHKHNAFGNIIHQRKSDFP

SEQ ID NO: 5293 - protein, 81 aa, Pongo abelii
MIKSQESLTLEDVAVEFTWEEWQLLGPAQKDLYRDVMLENYSNLVSVGYQASKPDALFKLDQGEPWTVENEIHSQICPEIK

SEQ ID NO: 5294 - protein, 81 aa, Pongo abelii
MIQAQESITLEDVAVDFTWEEWQLLGAAQKDLYRDVMLENYSNLVAVGYQASKPDALFKLEQGEQPWTTEDGIHSGACSDM

SEQ ID NO: 5295 - protein, 81 aa, Pongo abelii
FAYMSCLVKHKRIHTREKQEAARVENPPAERHSSLHTSDVMQEKNSANGVTTQVPSVAPQTSLNISGLLANRNVVLVGQPV

SEQ ID NO: 5296 - protein, 81 aa, Pongo abelii
MLENYSNLVAVGYQASKPDALFKLEQGEQPWTTEDGIHSGACSDMWKVDHVLEHLQSESLVNRRKQCHEHDAFENIVHCSK

SEQ ID NO: 5297 - protein, 81 aa, Pongo abelii
RMQAQESLTLEDVAVDFTWEEWQFLSPAQKDLYRDVMLENYSNLVAVGFQASKQDALSKLERGEETCTTEDEIYSRICFDS

SEQ ID NO: 5298 - protein, 81 aa, Pongo abelii
RMQAQESLTLEDVAVDFTWEEWQFLSPAQKDLYRDVMLENYSNLVAVGFQASKQDALSKLERGEETCTTEDEIYSRICFEI

SEQ ID NO: 5299 - protein, 81 aa, Pongo abelii
MRPEQTKFWEESLTLEDVAVDFTWEEWQFLSPAQKDLYRDVMLENYSNLVAVGFQASKQDALSKLERGEETCTTEDEIYSR

SEQ ID NO: 5300 - protein, 81 aa, Pongo abelii
RMQAQESLTLEDVAVDFTWEEWQFLSPAQKDLYRDVMLENYSNLVAVGFQASKQDALSKLERGEETCTTEDEIYSRICFGR

SEQ ID NO: 5301 - protein, 81 aa, Pongo abelii
MESLTLEDVAVDFTWEEWQFLSPAQKDLYRDVMLENYSNLVAVGFQASKQDALSKLERGEETCTTEDEIYSRICFDSGGAS

SEQ ID NO: 5302 - protein, 81 aa, Pongo abelii
MQAQESLTLEDVAVDFTWEEWQFLSPAQKDLYRDVMLENYSNLVAVGFQASKQDALSKLERGEETCTTEDEIYSRICFDSG

SEQ ID NO: 5303 - protein, 81 aa, Pongo abelii
MINAQELLTLEDVTVEFTWEEWQLLDPFQKDLYRDVTLEIYSNLVSMGYQVSKPDALSKLEQGEEPWTMEDERHSRICPEN

SEQ ID NO: 5304 - protein, 81 aa, Pongo abelii
LVSMGYQVSKPDALSKLEQGEEPWTMEDERHSRICPENNKVDDHLQDHLENQWMLKSVEQYHEHNAFGNTASQTKSLCLFR

SEQ ID NO: 5305 - protein, 81 aa, Pongo abelii
MINAQELLTLEDVTVEFTWEEWQLLDPFQKDLYRDVTLEIYSNLVSMGYQVSKPDALSKLEQGEEPWTMEDERHSRICPGT

SEQ ID NO: 5306 - protein, 81 aa, Pongo abelii
MALPQGFLTFRDVAVEFSQEEWKCLDPVQKALYRDVMLENYRNLGFLGLCLPDLNIISMLEQGKEPWTVVSQVKIARNPNC

SEQ ID NO: 5307 - protein, 81 aa, Pongo abelii
MATQGHLTFKDVAIEFSQEEWKCLEPVQKALYKDVMLENYRNLVFLGISPKCVIKELPPTENSNTGERFQTVALERPQSYD

SEQ ID NO: 5308 - protein, 81 aa, Pongo abelii
MALPQGPLTFRDVAIEFSQEEWKSLDPVQKALYWDVMLENYRNLVFLGILPKCMTKELPPIGNSNTGEKCQTVTLERHECY

SEQ ID NO: 5309 - protein, 81 aa, Pongo abelii
LCIVQGPLTFRDVAIEFSQEEWKSLDPVQKALYWDVMLENYRNLVFLGILPKCMTKELPPIGNSNTGEKCQTVTLERHECY

SEQ ID NO: 5310 - protein, 81 aa, Pongo abelii
MALPQGPLTFRDVAIEFSQEEWKSLDPVQKALYWDVMLENYRNLVFLGKDNFALEVKICPCVFLYFLCCLSWEPFHYLTET

SEQ ID NO: 5311 - protein, 81 aa, Pongo abelii
MAQLRRGHLTFRDVAIEFSQEEWKCLDPVQKALYRDVMLENYRNLVSLGICLPDLSIFSMMKQRTESWTVENEMKVANNPD

SEQ ID NO: 5312 - protein, 81 aa, Pongo abelii
EGEAQKRKAEESGMPLTQGHLTFRDVAIEFSQEEWKCLDPVQKALYRDVMLENYRNLVSLGICLPDLSIFSMMKQRTESWT

SEQ ID NO: 5313 - protein, 81 aa, Pongo abelii
MLENYRNLVSLGICLPDLSIFSMMKQRTESWTVENEMKVANNPDRWEGIKDINTGRSCAVRSKAGNKPVTNQLGLTFQLPL

SEQ ID NO: 5314 - protein, 81 aa, Pongo abelii
MGHLTFRDVAIEFSQEEWKCLDPVQKALYRDVMLENYRNLVSLGICLPDLSIFSMMKQRTESWTVENEMKVANNPDRWEGI

SEQ ID NO: 5315 - protein, 81 aa, Pongo abelii
AQKRRKRKAKKSGMALPQGHLTFRDVAIEFSQAEWKCLDPSQRALYKDVMLENYRNLVSLGISLPDLNINSMLEQRREPWS

SEQ ID NO: 5316 - protein, 81 aa, Pongo abelii
AQKRRKRKAKKSGMALPQGHLTFRDVAIEFSQAEWKCLDPSQRALYKDVMLENYRNLVSLGSSYALGSNAEDKPIKKQLGV

SEQ ID NO: 5317 - protein, 81 aa, Pongo abelii
PWSGESEVKIAKNSDERECIQGVNTVWSAMAQSWLTATSTSWVQAILLTQRPEQLGLQGAAMHWEAMQKTNQLKNNLEYPF

SEQ ID NO: 5318 - protein, 81 aa, Pongo abelii
DEEAQKRKAKESGMALPQGHLTFMDVAIEFSQEEWKSLDPGQRALYRDVMLENYRNLVSLGICLPDRSIISMLRQRREPLV

SEQ ID NO: 5319 - protein, 81 aa, Pongo abelii
DEEAQKRKAKESGMALPQGHLTFMDVAIEFSQEEWKSLDPGQRALYRDVMLENYRNLVSLGRSCILGSNAENKPIKNQLGL

SEQ ID NO: 5320 - protein, 81 aa, Pongo abelii
MLRRGHLTFRDVAIEFSQEEWKCLDPAQRTLYREVMLENYRNLVFLGICLPDLSIISMLEQRRDPRNLQSEMKMANNPGGR

SEQ ID NO: 5321 - protein, 81 aa, Pongo abelii
MLRRGHLTFRDVAIEFSQEEWKCLDPAQRTLYREVMLENYRNLVFLGICLPDLSIISMLEQRRDPRNLQSEMKMANNPGSC

SEQ ID NO: 5322 - protein, 81 aa, Pongo abelii
MALTQGPLKFRDVAIEFSQEEWKCLDPAQRTLYRDVMLENYRNLVSLGICLPDLSVTSMLEQNKDPWTLQSEEKIANNPDG

SEQ ID NO: 5323 - protein, 81 aa, Pongo abelii
RDVAIEFSQEEWKCLDPAQRTLYRDVMLENYRNLVSLGICLPDLSVTSMLEQNKDPWTLQSEEKIANNPDGRECIKGVNTV

SEQ ID NO: 5324 - protein, 81 aa, Pongo abelii
QGSNSEEERKGVRNGPYSGPLKFRDVAIEFSQEEWKCLDPAQRTLYRDVMLENYRNLVSLGICLPDLSVTSMLEQNKDPWT

SEQ ID NO: 5325 - protein, 81 aa, Pongo abelii
LYRDVMLENYRNLVSLGICLPDLSVTSMLEQNKDPWTLQSEEKIANNPDGRECIKGVNTDSPLLQCITSVPCVFCTASMIY

SEQ ID NO: 5326 - protein, 81 aa, Pongo abelii
MALTQGQLSFRDVAIEFSQEEWKCLDPGQKALYRDVMLENYRNLVSLGICLPGLSVTSMLEQKRDPCTLQSEVKIANNPDG

SEQ ID NO: 5327 - protein, 81 aa, Pongo abelii
MALTQGQLSFRDVAIEFSQEEWKCLDPGQKALYRDVMLENYRNLVSLGEDNVPEACICSGICLPGLSVTSMLEQKRDPCTL

SEQ ID NO: 5328 - protein, 81 aa, Pongo abelii
MALTQGQLSFRDVAIEFSQEEWKCLDPGQKALYRDVMLENYRNLVSLDFSLLAWDARVFRVEAWRTSGGAEEPTSPNFGGN

SEQ ID NO: 5329 - protein, 81 aa, Pongo abelii
EEAAQKRKGKEPGMALPQGRLTFRDVAIEFSLAEWKYLNPAQRALYREVMLENYRNLEAVGLHTGEKSYKCEECDKVFSQK

SEQ ID NO: 5330 - protein, 81 aa, Pongo abelii
EEAAQKRKGKEPGMALPQGRLTFRDVAIEFSLSEWKFLNPAQRALYREVMLENYRNLEAVDISSKCMMKEVLSTGQGNSEV

SEQ ID NO: 5331 - protein, 81 aa, Pongo abelii
REEAAQKRKGKEPGMALPQGRLTFRDVAIEFSLSEWKFLNPAQRALYREVMLENYRNLEAVDISSKCMMKEVLSTGQGNSE

SEQ ID NO: 5332 - protein, 81 aa, Pongo abelii
ETWKRKRKAKESGMALPQGLLTFRDVSIEFSQEEWKCLDPAQRTLYRDVMLENYRNLVSLDISSKCMMQMFSSTGQGNTEV

SEQ ID NO: 5333 - protein, 81 aa, Pongo abelii
MALPQGLLTFRDVSIEFSQEEWKCLDPAQRTLYRDVMLENYRNLVSLDISSKCMMQMFSSTGQGNTEVIHTGTLQIHASHH

SEQ ID NO: 5334 - protein, 81 aa, Pongo abelii
TWKRKRKAKESGMALPQGLLTFRDVSIEFSQEEWKCLDPAQRTLYRDVMLENYRNLVSLDISSKCMMQMFSSTGQGNTEVI

SEQ ID NO: 5335 - protein, 81 aa, Pongo abelii
MALPQGLLTFRDVAIEFSQEEWKCLDPAQRTLYRDVMLENYRNLVSLGIFSKCEIKELPPKKESNTGEIFQTVMLERQESH

SEQ ID NO: 5336 - protein, 81 aa, Pongo abelii
DPAQRTLYRDVMLENYRNLVSLGIFSKCEIKELPPKKESNTGEIFQTVMLERQESHDIQDFCFRETQKNVHDSQCQWKHDE

SEQ ID NO: 5337 - protein, 81 aa, Pongo abelii
AIEFSQEEWKCLDPAQRTLYRDVMLENYRNLVSLGIFSKCEIKELPPKKESNTGEIFQTVMLERQESHDIQDFCFRETQKN

SEQ ID NO: 5338 - protein, 81 aa, Pongo abelii
MALPQGLLTFRDVAIEFSQEEWKCLDPAQRTLYRDVMLENYRNLVSLGHDLILILFFFFPSWSFSCCPSWSAMAQSWLTRT

SEQ ID NO: 5339 - protein, 81 aa, Pongo abelii
VSLGHDLILILFFFFPSWSFSCCPSWSAMAQSWLTRTSASRVQVILPPQPLKLELQVFFLNVRSRNYHQKKRVIQEKYSRQ

SEQ ID NO: 5340 - protein, 81 aa, Pongo abelii
MALPQGLLTFRDVAIEFSQEEWKCLDPAQRTLYRDVMLENYRNLVSLVGVSLVAQAGVQWHNLGSPELLPPGFKFSRLSLS

SEQ ID NO: 5341 - protein, 81 aa, Pongo abelii
EEAAQKRKGKEPSMALPQGRLTFRDVAIEFSLAEWKFLNPAQRALYREVMLENYRNLEAVDISSKCMKKEVLSTGQGNTEV

SEQ ID NO: 5342 - protein, 81 aa, Pongo abelii
EEAAQKRKGKEPSMALPQGRLTFRDVAIEFSLAEWKFLNPAQRALYREVMLENYRNLEAVESHFVTQAGVQWCDLGSLQPL

SEQ ID NO: 5343 - protein, 80 aa, Pongo abelii
VLREEAAQKRKGKEPSMALPQGRLTFRDVAIEFSLAEWKFLNPAQRALYREVMLENYRNLEAVETGFHRVSQDGLNLLTL

SEQ ID NO: 5344 - protein, 81 aa, Pongo abelii
EEAAQKRKGNEPGMALPQGRLTFRDVAIEFSLAEWKYLNPAQRALYREVMLENYRNLEAVDISKCMMKEVLSTGQDNTEVF

SEQ ID NO: 5345 - protein, 81 aa, Pongo abelii
MALPQGLLTFRDVAIEFSQEEWKCLDPAQRTLYRDVMLENYRNLVSLDISSKCMMKIFSTGQGNTEVFHTGTLQRQANHHV

SEQ ID NO: 5346 - protein, 81 aa, Pongo abelii
MALPQGLLTFRDVAIEFSQEEWKCLDPAQRTLYRDVMLENYRNLVSLEFRSVTQAKVQWCHLSSLQPPLPRFKQFSCLSLP

SEQ ID NO: 5347 - protein, 81 aa, Pongo abelii
WKCLDPAQRTLYRDVMLENYRNLVSLEFRSVTQAKVQWCHLSSLQPPLPRFKQFSCLSLPSSWDYRYLFQMHDEDILNRAR

SEQ ID NO: 5348 - protein, 81 aa, Pongo abelii
MALPQGLLTFRDVAIEFSQEEWKCLDPAQRTLYRDVMLENYRNLVSLDISSKCMLKTLSSTGQGNTEVFCAPTLHRQASHI

SEQ ID NO: 5349 - protein, 81 aa, Pongo abelii
MALPQGLLTFRDVAIEFSQEEWKCLDPAQRTLYRDVMLENYRNLVSLEFWSVTPAKVQWCHLGSLQPPLPRFKQFSCLSLP

SEQ ID NO: 5350 - protein, 81 aa, Pongo abelii
MALPQGLLTFRDVAIEFSQEEWKCLDPAQRTLYRDVMLENYRNLVSLVRRSEVCCIDIWAEVIVADISSKCMLKTLSSTGQ

SEQ ID NO: 5351 - protein, 81 aa, Pongo abelii
MALPQVLLTFRDVAIEFSQEEWKCLDPAQRTLYRDVMLENYRNLVSLDTSSKCMMNTLIDFQRLMLREEDIKKSKEKEPGM

SEQ ID NO: 5352 - protein, 81 aa, Pongo abelii
LDTSSKCMMNTLIDFQRLMLREEDIKKSKEKEPGMALPQGLLTFRDVAIEFSQEEWKCLDPAQRTLYRDVMLENYRNLVSL

SEQ ID NO: 5353 - protein, 81 aa, Pongo abelii
VLLTFRDVAIEFSQEEWKCLDPAQRTLYRDVMLENYRNLVSLDTSSKCMMNTLSSTGQGNTEVFHKGTLRRQASYHIGAFC

SEQ ID NO: 5354 - protein, 81 aa, Pongo abelii
VLLTFRDVAIEFSQEEWKCLDPAQRTLYRDVMLENYRNLVSLGQGNTEVFHKGTLRRQASYHIGAFCSQEIEKDIHDFVFQ

SEQ ID NO: 5355 - protein, 81 aa, Pongo abelii
MALPQGLLTFRDVAIEFSQEEWKCLDPAQRTLYRDVMLENYKNLVSLDISFKCMVKEFSSIGKGNTEVFHTRTLQRLASHH

SEQ ID NO: 5356 - protein, 81 aa, Pongo abelii
EEATKKNKEKEPGMALPQGCLTFRDVAIEFSLEEWKCLNPAQRALYRAVMLENYRNLEFVDISSKCMMKKFLSTGQGNAEV

SEQ ID NO: 5357 - protein, 81 aa, Pongo abelii
STDRHDQRHAGNKPIKNQLGLSFHLHLSELHVLQPEWKIGNQVEKSINNASLISTSQRISCRPKTHISNNYGNNSLYSSLL

SEQ ID NO: 5358 - protein, 81 aa, Pongo abelii
EEATKKNKEKEPGMALPQGCLTFRDVAIEFSLEEWKCLNPAQRALYRAVMLENYRNLEFVDSSLKSMMEFLSTGHGNTGGE

SEQ ID NO: 5359 - protein, 81 aa, Pongo abelii
EEATKKNKEKEPGMALPQGCLTFRDVAIEFSLEEWKCLNPAQRALYRAVMLENYRNLEFVGEENVPPDIRNLPLSILALPG

SEQ ID NO: 5360 - protein, 81 aa, Pongo abelii
MLENYWNLVSLGLCHFDMNIISMLEEGKEPWTVKSCVKIARKPRMRECVKGVVTDNPPKCTIKDLLPKEKSSTEAVFHTVV

SEQ ID NO: 5361 - protein, 81 aa, Pongo abelii
MALTQLTFRDVAIEFSQDEWKCLNSTQRTLYRDVMLENYRNLVSLDLSRNCVIKELAPQQESNTGEVFQTVTLEQHEKHDI

SEQ ID NO: 5362 - protein, 81 aa, Pongo abelii
MALTQLTFRDVAIEFSQDEWKCLNSTQRTLYRDVMLENYRNLVSLVYYPMWEHRKEPWTIESQVQIARKLKGWEWIKGVKT

SEQ ID NO: 5363 - protein, 81 aa, Pongo abelii
MDGDGLTFRDVAIEFSQDEWKCLNSTQRTLYRDVMLENYRNLVSLDLSRNCVIKELAPQQESNTGEVFQTVTLEQHEKHDI

SEQ ID NO: 5364 - protein, 81 aa, Pongo abelii
HEEETQKRRAKESGMALTQLTFRDVAIEFSQDEWKCLNSTQRTLYRDVMLENYRNLVSLDLSRNCVIKELAPQQESNTGEV

SEQ ID NO: 5365 - protein, 81 aa, Pongo abelii
TQRTLYRDVMLENYRNLVSLDLSRNCVIKELAPQQESNTGEVFQTVTLEQHEKHDIEEFCFREIKKKIHDFDCQWRDDERN

SEQ ID NO: 5366 - protein, 81 aa, Pongo abelii
MDGDGLTFRDVAIEFSQDEWKCLNSTQRTLYRDVMLENYRNLVSLVYYPMWEHRKEPWTIESQVQIARKLKGWEWIKGVKT

SEQ ID NO: 5367 - protein, 81 aa, Pongo abelii
MLENYRNLASLGISCFDLSIISMLEQGKEPFTVESQVQIARNPDGWEWIKAVITALSSEFVMKDLPHKGKSNTGEVFQTLM

SEQ ID NO: 5368 - protein, 81 aa, Pongo abelii
MALRQGQLTFRDVAIEFSQEEWTCLNPAQKTLYRDVMLENYRNLVSLDISCKCINKDLPPKGKNNMGEAFYTVKLERLESH

SEQ ID NO: 5369 - protein, 81 aa, Pongo abelii
ALYRDVMLENYRNLLSLDEDNIPPENDISVGFTSKGLSPKENNKEELYHLVILERKESHGINNFDLKEIWENMPQFDSLWD

SEQ ID NO: 5370 - protein, 81 aa, Pongo abelii
LYRDVMLENYRNLLSLDEDNIPPENDISVGFTSKGLSPKENNKEELYHLVILERKESHGINNFDLKEIWENMPQFDSLWDY

SEQ ID NO: 5371 - protein, 80 aa, Pongo abelii
MALSQGLFTFKDVAIEFSQEEWECLDPAQRALYRDVMLENYRNLLSLDEDNIPPENAFYSVQELRETLVFLISYSSKICL

SEQ ID NO: 5372 - protein, 81 aa, Pongo abelii
MALSQGLLTFRDVAIEFSQEEWKCLDPAQRTLYRDVMLENYRNLVSLDISSKCTMKEFSSTAQGNREVFHAGTLQRHESHH

SEQ ID NO: 5373 - protein, 81 aa, Pongo abelii
MALSQSLLTFRDVAIEFSQEEWKCLDPTQRMLYRDVMVENYRNLVSVGSCVSEDNGKAYNYSSLLRKHQLIHLGKKQYKCD

SEQ ID NO: 5374 - protein, 81 aa, Pongo abelii
MALPQGLLTFRDVAIEFSQEEWKCLDPAQRTLYRDVMLENYRNLVSLDISSKCMMKEVSSTAQGNTEVIHTGTLQRHERHH

SEQ ID NO: 5375 - protein, 81 aa, Pongo abelii
MAFSQGLLTFRDVAIEFSQEEWKCLDPAQRTLYRDVMLENYRNLVSLDMSSKCTMKEFLSTAQGNREVFHAGTLQRHESHH

SEQ ID NO: 5376 - protein, 81 aa, Pongo abelii
WACLNSAQRDLYWDVMLENYSNLVSLDLESAYENKSLPTEKNIHEIRASKRNSDRRSKSLGRNWICEGMLERPQRSRGRYV

SEQ ID NO: 5377 - protein, 81 aa, Pongo abelii
SAQRDLYWDVMLENYSNLVSLDLESAYENKSLPTEKNIHEIRASKRNSDRRSKSLGRNWICEGMLERPQRSRGRYVNQMII

SEQ ID NO: 5378 - protein, 81 aa, Pongo abelii
EEWACLNSAQRDLYWDVMLENYSNLVSLDLESAYENKSLPTEKNIHEIRASKRNSDRRSKSLGRNWICEGMLERPQRSRGR

SEQ ID NO: 5379 - protein, 81 aa, Pongo abelii
MSQGSVTFQDVAIDFSKEEWGFLNPAQRDLYTTVMLENYQNLVWLGLSISKSVISLLEKRKLPWIMGREEIRGPLPGMEEM

SEQ ID NO: 5380 - protein, 81 aa, Pongo abelii
DTKELSPKQHVYEVESPQWEIMESLTSYGLECSSFQDDWECRNQFDRQQGNPDRHFHQMIIRHEEMPTFDQHASLTFYQKI

SEQ ID NO: 5381 - protein, 81 aa, Pongo abelii
MSKDLVTFGDVAVSFSQEEWEWLNPAQRNLYRKVMLENYRSLVSLGVSVSKPDVISLLEQGKEPWMVKKEGTRGPCPDWEY

SEQ ID NO: 5382 - protein, 81 aa, Pongo abelii
ITHKEILPEVQNKEYNKSWQTFHQDTIFDIRQSFPTKEKAHKHEPQKKSYRKKSVEMKHRKIYVEKKLLKCNDCEKVFNQS

SEQ ID NO: 5383 - protein, 81 aa, Pongo abelii
MPSARGKSKSKAPVTFGDLAIYFSQEEWEWLSPIQKDLYEDVMLENYRNLVSLGLSFRRPNVITLLEKGKAPWMVEPVRRR

SEQ ID NO: 5384 - protein, 81 aa, Pongo abelii
MNVEVVKVMPQDLVTFKDVAIDFSQEEWQWMNPAQKCLYRSMMLENYQSLVSLGLCISKPYVISLLEQGREPWEMTSEMTR

SEQ ID NO: 5385 - protein, 81 aa, Pongo abelii
NKKTEAVGTRIEPKAMSQGLVTFGDVAVDFSQEEWEWLNPIQRNLYRKVMLENYRNLASLGLCVSKPDVISSLEQGKEPWT

SEQ ID NO: 5386 - protein, 81 aa, Pongo abelii
LEYSLLGEHWDYDAVFETQPGLVTIKNLAVDFPQKLHPAQKNFCKNGIWENHSDLGSAGHCVAKPDLVSLLEQKKESWMVK

SEQ ID NO: 5387 - protein, 81 aa, Pongo abelii
MAAQLLTDEALESVTFRDVTVDFTQEEWQQLEPAQKDLYRDVMLENYRNLVSLDWETRPEMKELDPKNDISEDKPSVVGVA

SEQ ID NO: 5388 - protein, 81 aa, Pongo abelii
RDSRAYESRSQDAESYQNVVDLAEDRKPHNTIQDNMENYRKLLSLGFLAQDSVPAEKRNTEMLDNLPSAASQFLDFKHLGT

SEQ ID NO: 5389 - protein, 81 aa, Pongo abelii
AASQFLDFKHLGTFLVFEELVTFEDVFVDFSPEELSSLSAAQRNLYREVMLENYWNLVSLGYQFSKPDIISRLEEEESRAM

SEQ ID NO: 5390 - protein, 81 aa, Pongo abelii
MNNSQGRVTFEDVTVNFTQGEWQRLNPEQRNLYRDVMLENYSNLISVGQEETTKPDVILRLEQGKEPWSVEEEVLRNGRPE

SEQ ID NO: 5391 - protein, 81 aa, Pongo abelii
MAAAVLTDRAQVSVTFDDVAVTFTKEEWGQLDLAQRTLYQEVMLENCGLLVSLGCPVPRPELIYHLEHEQEPWTRKEDLSQ

SEQ ID NO: 5392 - protein, 81 aa, Pongo abelii
MAMALTDPAQVSVTFDDVAVTFTQEEWGQLDLAQRTLYQEVMLENCGLLVSLGCPVPRPELIYHLEHEQETWTRKEDLSQG

SEQ ID NO: 5393 - protein, 81 aa, Pongo abelii
MAASAQVSVTFEDVAVTFTQEEWGQLDAAQRTLYQEVMLETCGLLVSLGCPLFKPELIYQLDHRQELWMVTKDLSQSSYPG

SEQ ID NO: 5394 - protein, 81 aa, Pongo abelii
MAAAVLMDRVQSCVTFEDVFVYFSREEWELLEEAQRFLYRDVMLENFALVATLGFWCEAENEAPSEQSVSVEGVSQVRTAE

SEQ ID NO: 5395 - protein, 81 aa, Pongo abelii
MAAAVLMDRVQSCVTFEDVFVYFSREEWELLEEAQRFLYRDVMLENFALVATLAFIFPVPCSGAVGGGRKPWVPDRAHITA

SEQ ID NO: 5396 - protein, 81 aa, Pongo abelii
MAEMNPAQGCVVFEDVAIYFSQEEWGHLDEAQRLLYRDVMLENLALLSSLGCCHGAEDEEAPLEPGVSVGVSQVMAPKPCL

SEQ ID NO: 5397 - protein, 81 aa, Pongo abelii
MYSSFPIWQGCVVFEDVAIYFSQEEWGHLDEAQRLLYRDVMLENLALLSSLGCCHGAEDEEAPLEPGVSVGVSQVMAPKPC

SEQ ID NO: 5398 - protein, 81 aa, Pongo abelii
VSVGVSQVMAPKPCLSTQKTQPCETCSSLLKDILRLAEHDGTHPEQGLYTCPAHLHQHQKEQIREKLSRGDGGRPTYVKNH

SEQ ID NO: 5399 - protein, 81 aa, Pongo abelii
MAEMNPAQGCVVFEDVAIYFSQEEWGHLDEAQRLLYRDVMLENLALLSSLGSWHGAEDEEAPSQQGFSVGVSEVTTSRPCL

SEQ ID NO: 5400 - protein, 81 aa, Pongo abelii
MNLTEARVVFEDVAIYFSQEEWGHLDEAQRLLYRDVMLENLALLSSLGSWHGAEDEEAPSQQGFSVGVSEVTTSRPCLSSQ

SEQ ID NO: 5401 - protein, 81 aa, Pongo abelii
MNLTEGPVMAEMDPTHARVVFEDVAIYFSQEEWGHLDEAQRLLYRDVMLENLALLSSLGSWHGAEDEEAPSQQGFSVGVSE

SEQ ID NO: 5402 - protein, 81 aa, Pongo abelii
MNLTEGPVMAEMDPTHARVVFEDVAIYFSQEEWGHLDEAQRLLYRDVMLENLALLSSLGKALTLAQCPGLGCVTPFYPKAA

SEQ ID NO: 5403 - protein, 81 aa, Pongo abelii
MAEMDPTHARVVFEDVAIYFSQEEWGHLDEAQRLLYRDVMLENLALLSSLGSWHGAEDEEAPSQQGFSVGVSEVTTSRPCL

SEQ ID NO: 5404 - protein, 81 aa, Pongo abelii
MNLTEGPVMAEMDPTHARVVFEDVAIYFSQEEWGHLDEAQRLLYRDVMLENLALLSSLGFIAVAAMLMDAGQDCMVFEDVA

SEQ ID NO: 5405 - protein, 81 aa, Pongo abelii
AIYFSQEEWGHLDEAQRLLYRDVMLENLALLSSLGFIAVAAMLMDAGQDCMVFEDVAIHFSQEEWGILNHVQRHLHSDVML

SEQ ID NO: 5406 - protein, 81 aa, Pongo abelii
MNLTEGPVMAEMDPTHDCMVFEDVAIHFSQEEWGILNHVQRHLHSDVMLENFALLSSVGCWHGAKDEEAPSKQCVSVGVSQ

SEQ ID NO: 5407 - protein, 81 aa, Pongo abelii
MLMDAGQDCMVFEDVAIHFSQEEWGILNHVQRHLHSDVMLENFALLSSVGCWHGAKDEEAPSKQCVSVGVSQVKTLKPALS

SEQ ID NO: 5408 - protein, 81 aa, Pongo abelii
MNLTEDCMVFEDVAIHFSQEEWGILNHVQRHLHSDVMLENFALLSSVGCWHGAKDEEAPSKQCVSVGVSQVKTLKPALSTQ

SEQ ID NO: 5409 - protein, 81 aa, Pongo abelii
MNLIEDCMVFEDVAIYFSQEEWGILNDAQRHLHSNVMLENFALLSSVGCWHGAKDEEVPSKQCVSVRVLQVTTPKPALSTL

SEQ ID NO: 5410 - protein, 81 aa, Pongo abelii
MGPAQVPMNSEVIVDPIQGQVNFEDVFVYFSQEEWVLLDEAQRLLYRDVMLENFALMASLGIPQTMAAFGLKYFLNDTGYT

SEQ ID NO: 5411 - protein, 81 aa, Pongo abelii
EHCSEVPMNSEVIVDPIQGQVNFEDVFVYFSQEEWVLLDEAQRLLYRDVMLENFALMASLGASLVMGSEPWVPDWVDMILA

SEQ ID NO: 5412 - protein, 81 aa, Pongo abelii
MGPAQVPMNSEVIVDPIQGQVNFEDVFVYFSQEEWVLLDEAQRLLYRDVMLENFALMASLGHTSFMSHIGASLVMGSEPWV

SEQ ID NO: 5413 - protein, 81 aa, Pongo abelii
MNSEVIVDPIQGQVNFEDVFVYFSQEEWVLLDEAQRLLYRDVMLENFALMASLGHTSFMSHIGASLVMGSEPWVPDWVDMI

SEQ ID NO: 5414 - protein, 81 aa, Pongo abelii
MAAAALRDPAQQGYVTFEDVAVYFSQEEWRLLDEAQRLLYCNVMLENFSLLASLGLASSKTHEITQLESWEEPFMPAWDVV

SEQ ID NO: 5415 - protein, 81 aa, Pongo abelii
DPAQVPVAAELLTDHEEQGYVTFEDVAVYFSQEEWRLLDEAQRLLYCNVMLENFSLLASLGLASSKTHEITQLESWEEPFM

SEQ ID NO: 5416 - protein, 81 aa, Pongo abelii
DPAQVPVAAELLTDHEEQGYVTFEDVAVYFSQEEWRLLDEAQRLLYCNVMLENFSLLASLGKVLTPHPSILSWARLFLLFL

SEQ ID NO: 5417 - protein, 81 aa, Pongo abelii
MAAAALRDPAQGYVTFEDVAVYFSQEEWRLLDEAQRLLYCNVMLENFSLLASLGKVLTPHPSILSWARLFLLFLGRGLFFP

SEQ ID NO: 5418 - protein, 81 aa, Pongo abelii
DPAQVPVAAELLTDHEEQGYVTFEDVAVYFSQEEWRLLDEAQRLLYCNVMLENFSLLASLGCWHGAEAKEAPEQSASVEVP

SEQ ID NO: 5419 - protein, 81 aa, Pongo abelii
RDPAQVPVAAELLTDHEEGYVTFEDVAVYFSQEEWRLLDEAQRLLYCNVMLENFSLLASLGKVLTPHPSILSWARLFLLFL

SEQ ID NO: 5420 - protein, 81 aa, Pongo abelii
MAAAALRDPAQQGYVTFEDVAVYFSQEEWRLLDEAQRLLYCNVMLENFSLLASLGCWHGAEAKEAPEQSASVEVPSSNVQQ

SEQ ID NO: 5421 - protein, 81 aa, Pongo abelii
RDPAQVPVAAELLTDHEEGYVTFEDVAVYFSQEEWRLLDEAQRLLYCNVMLENFSLLASLGLASSKTHEITQLESWEEPFM

SEQ ID NO: 5422 - protein, 81 aa, Pongo abelii
RDPAQVPVAAELLTDHEEGYVTFEDVAVYFSQEEWRLLDEAQRLLYCNVMLENFSLLASLGCWHGAEAKEAPEQSASVEVP

SEQ ID NO: 5423 - protein, 81 aa, Pongo abelii
MAAAALRDPAQGYVTFEDVAVYFSQEEWRLLDEAQRLLYCNVMLENFTLLASLGLASSKTHEITQLESWEKPFMPTWEVVT

SEQ ID NO: 5424 - protein, 81 aa, Pongo abelii
VYFSQEEWRLLDEAQRLLYCNVMLENFTLLASLGLASSKTHEITQLESWEKPFMPTWEVVTSATWRVPNRQPQLVPEQGRE

SEQ ID NO: 5425 - protein, 81 aa, Pongo abelii
MAAAALRDPAQQGYVTFEDVAVYFSQEEWRLLDEAQRLLYCNVMLENFTLLASLGLASSKTHEITQLESWEKPFMPTWEVV

SEQ ID NO: 5426 - protein, 81 aa, Pongo abelii
MAAAALVNTPQGHVTFEDIAVYFSQEEWGLLDEAQRCLYHDVMLENFLLMASVGCLHGIEAEEAPSEQTISAQGVSQARTP

SEQ ID NO: 5427 - protein, 81 aa, Pongo abelii
VNTPQIPMVTEEFVKPSQGHVTFEDIAVYFSQEEWGLLDEAQRCLYHDVMLENFLLMASVGCLHGIEAEEAPSEQTISAQG

SEQ ID NO: 5428 - protein, 81 aa, Pongo abelii
LVNTPQIPMVTEEFVKPSQGHVTFEDIAVYFSQEEWGLLDEAQRCLYHDVMLENFLLMASVAGLSQSNHKDSCSQQKVPVS

SEQ ID NO: 5429 - protein, 81 aa, Pongo abelii
MAETKDAPQMLVTFKDVAVTFTREEWRQLDLAQRTLYREVMLETCGLLVSLGHRVPKPELVHLLEHGQELWTVKRGLSHPT

SEQ ID NO: 5430 - protein, 81 aa, Pongo abelii
MLVTFKDVAVTFTREEWRQLDLAQRTLYREVMLETCGLLVSLGHRVPKPELVHLLEHGQELWTVKRGLSHPTCAGDRAQVH

SEQ ID NO: 5431 - protein, 81 aa, Pongo abelii
MAAALRAPTQQGFVAFEDVAIYFSQEEWELLDEMQRLLYRDVMLENFAVMASLGCWCGAEDEGAPSADSISVEELSQGRTP

SEQ ID NO: 5432 - protein, 81 aa, Pongo abelii
SPASASQAGTTGVRHHAQGSVTFEDVAVYFSWEEWDLLDETQKHLYFNVMLENFALTSSLGCWRGVEHEETPSEQRISVER

SEQ ID NO: 5433 - protein, 81 aa, Pongo abelii
DRGAQVPIATEVLFRLTQGSVTFEDVAVYFSWEEWDLLDETQKHLYFNVMLENFALTSSLGLTSSWSHVVAQLGLGEVPSV

SEQ ID NO: 5434 - protein, 81 aa, Pongo abelii
RDPASVPIATEVLFRLTQGSVTFEDVAVYFSWEEWDLLDETQKHLYFNVMLENFALTSSLGCWRGVEHEETPSEQRISVER

SEQ ID NO: 5435 - protein, 81 aa, Pongo abelii
MATVLRDPASGSVTFEDVAVYFSWEEWDLLDETQKHLYFNVMLENFALTSSLGCWRGVEHEETPSEQRISVERVPQFRTSK

SEQ ID NO: 5436 - protein, 81 aa, Pongo abelii
MTFEDVAIYFSQEEWELLDESQRFLYCDVMLENFAHVTSLGYCHGTENEAIASEQSVSIQVRTSKGNTLTQKTHLSEIKMC

SEQ ID NO: 5437 - protein, 81 aa, Pongo abelii
SPPSPRSSMAAVALRDSAQGMTFEDVAIYFSQEEWELLDESQRFLYCDVMLENFAHVTSLGYCHGTENEAIASEQSVSIQV

SEQ ID NO: 5438 - protein, 81 aa, Pongo abelii
MAAATLRTPAQGTVTFEDVAVHFSWEEWGLLDEAQRCLYRDVMLENLALLTSLDVHHQKQHLGEKHFRSNVGRAMFVKTCT

SEQ ID NO: 5439 - protein, 81 aa, Pongo abelii
PAAVRAHGPMAELTDSARGCVVFEDVFVYFSQEEWELLDDAQRLLYHDVMLENFALLASLGIAFSRSRAVMQLERGEEPWV

SEQ ID NO: 5440 - protein, 81 aa, Pongo abelii
MAAAALRPPAQGTVTFEDVAVNFSQEEWSLLSEAQRCLYHDVMLENLTLISSLGCWYGAKDETPSKQTLSIQQESPLRTHW

SEQ ID NO: 5441 - protein, 81 aa, Pongo abelii
MAAAAALRAPAQSSVTFEDVAVNFSLKEWSLLNEAQGCLYHDVMLETLTLISSLGGVPPHRLFPTGACGPQVPSSRIHPSP

SEQ ID NO: 5442 - protein, 81 aa, Pongo abelii
MAKAALRFPVQGTVTFEDVAVKFTQEEWNLLSEAQRCLYHDVTLENLALISSLGCWCGVEDEEAPSKQTIYIREIQVRTPM

SEQ ID NO: 5443 - protein, 81 aa, Pongo abelii
MAVAAPRRPAQGTVTFEDVAVKFTQEEWNLLSEAQRCLYRDVTLENLALMSSLGCWCGVEDEAAPSKRTIYIQREIQVRSP

SEQ ID NO: 5444 - protein, 81 aa, Pongo abelii
MAMAATLRLSAQGTVTFEDVAVKFTQEEWNLLSEAQRCLYRDVTLENLALMSSLGCWCGVEDEAAPSKRTIYIQREIQVRS

SEQ ID NO: 5445 - protein, 81 aa, Pongo abelii
MAVAAPRRPAQGTVTFEDVAVNFSQEEWSLLSEAQRCLYRDVMLENLALISSLSCWCGSKDEEVPCKQRISLQRESQSRTP

SEQ ID NO: 5446 - protein, 81 aa, Pongo abelii
MAVAAPRRPAQQGTVTFEDVAVNFSQEEWSLLSEAQRCLYRDVMLENLALISSLSCWCGSKDEEVPCKQRISLQRESQSRT

SEQ ID NO: 5447 - protein, 81 aa, Pongo abelii
MAAAATLRLSAQGTVTFEDVAVNFTWEEWNLLSEAQRCLYRDVTLENLALISSLDPALDGSADNTQTGNLGQSVLPAHPEQ

SEQ ID NO: 5448 - protein, 81 aa, Pongo abelii
WCDHGSPQPPPTGDILIQGTVTFEDVAVNFTWEEWNLLSEAQRCLYRDVTLENLALISSLDPALDGSADNTQTGNLGQSVL

SEQ ID NO: 5449 - protein, 81 aa, Pongo abelii
MAAAATLRLSAQGTVTFEDVAVNFTWEEWNLLSEAQRCLYRDVTLENLALISSLGMRFLHVCQALVSLPQVIHPPWPPKVL

SEQ ID NO: 5450 - protein, 81 aa, Pongo abelii
ATLRLSAQGTVTFEDVAVNFTWEEWNLLSEAQRCLYRDVTLENLALISSLGMRFLHVCQALVSLPQVIHPPWPPKVLGLQV

SEQ ID NO: 5451 - protein, 81 aa, Pongo abelii
LSAQGTVTFEDVAVNFTWEEWNLLSEAQRCLYRDVTLENLALISSLGMRFLHVCQALVSLPQVIPTLASQSAGITESHSVV

SEQ ID NO: 5452 - protein, 81 aa, Pongo abelii
DVAVNFTWEEWNLLSEAQRCLYRDVTLENLALISSLGMRFLHVCQALVSLPQVIPTLASQSAGITESHSVVQVRVRWHHLG

SEQ ID NO: 5453 - protein, 81 aa, Pongo abelii
MAAAATLRLSAQGTVTFEDVAVNFTWEEWNLLSEAQRCLYRDVTLENLALISSLGCWCGVEDEEAPSKQTIYIQRETQVRT

SEQ ID NO: 5454 - protein, 81 aa, Pongo abelii
MAASAPRHPTQQGTVTFEDVAVNFSQEEWSLLSEAQRCLYRDVMLENLALISSLSCWCGSKDEEVPCKQRISLQRESQSRT

SEQ ID NO: 5455 - protein, 81 aa, Pongo abelii
MAASAPRHPTQGTVTFEDVAVNFSQEEWSLLSEAQRCLYRDVMLENLALISSLSCWCGSKDEEVPCKQRISLQRESQSRTP

SEQ ID NO: 5456 - protein, 81 aa, Pongo abelii
VAVNFSQEEWCLLSEAQRCLYRDVMLENLALISSLDCPLYLCQFLDLSPCWRVCLDKPYLFLRPAALRCIKEWNVCALAKA

SEQ ID NO: 5457 - protein, 81 aa, Pongo abelii
MAAAARRHPTQQGTVTFEDVAVNFSQEEWCLLSEAQRCLYRDVMLENLALISSLGCWCGSKDEEAPCKQRISLQRESQSRT

SEQ ID NO: 5458 - protein, 81 aa, Pongo abelii
MAAAARRHPTQGTVTFEDVAVNFSQEEWCLLSEAQRCLYRDVMLENLALISSLGCWCGSKDEEAPCKQRISLQRESQSRTP

SEQ ID NO: 5459 - protein, 81 aa, Pongo abelii
MTWDCIAIGSHENSVQGTVAFEDVAVNFSQEEWSLLSEVQRCLYHDVMLENWVLISSLGCWCGSEDEEAPSKKSISIQRVS

SEQ ID NO: 5460 - protein, 81 aa, Pongo abelii
MQGTVAFEDVAVNFSQEEWSLLSEVQRCLYHDVMLENWVLISSLGCWCGSEDEEAPSKKSISIQRVSQSLRLSAQAGVARS

SEQ ID NO: 5461 - protein, 81 aa, Pongo abelii
GLHRMTWDCIAIGSHENSGTVAFEDVAVNFSQEEWSLLSEVQRCLYHDVMLENWVLISSLGCWCGSEDEEAPSKKSISIQR

SEQ ID NO: 5462 - protein, 81 aa, Pongo abelii
MAAAELRAPAQGIVTFEDVAVYFSWKEWGLLDEAQKCLYHDVMLENLTLTTSLGGSGAGDEEACYQQSTSPQRMSQVRIPK

SEQ ID NO: 5463 - protein, 81 aa, Pongo abelii
RRGSVGCRCRGLCLAVRREQVTFEDVVVDFSQEEWGQLKPAQRTLYRDVMLDTFRLLVSVGHWLPKPNVISLLEQEAELWA

SEQ ID NO: 5464 - protein, 81 aa, Pongo abelii
RFLWDGLWYCRGEDTEGHWECSCESLESLAVPVAFTPVKTPVQEQWQRNGFGENVSLNPDLSHQPMTPERQGPHTWGTCGK

SEQ ID NO: 5465 - protein, 81 aa, Pongo abelii
MTPGLRVSTDPEQVTFEDVVVDFSQEEWGQLKPAQRTLYRDVMLDTFRLLVSVGHWLPKPNVISLLEQEAELWAVDSGLPQ

SEQ ID NO: 5466 - protein, 81 aa, Pongo abelii
EEKQKEDAAICPVTVLSEEPVTFQDVAVDFSREEWGLLGPTQRTEYRDVMLETFGHLVSVGWETTLENKELAPNSDIPEEE

SEQ ID NO: 5467 - protein, 81 aa, Pongo abelii
MEARSTLVPPQASVCFEDVAMAFTQEEWEQLDLAQRTLYREVTLETWEHIVSLGLFLSKSDVISQLEQEEDLCRAEQEAPR

SEQ ID NO: 5468 - protein, 81 aa, Pongo abelii
FEDVAMAFTQEEWEQLDLAQRTLYREVTLETWEHIVSLGLFLSKSDVISQLEQEEDLCRAEQEAPRDGVSLLFPRLECNGT

SEQ ID NO: 5469 - protein, 81 aa, Pongo abelii
EDVAMAFTQEEWEQLDLAQRTLYREVTLETWEHIVSLGLFLSKSDVISQLEQEEDLCRAEQEAPRGTRPRKEQRGYRARRI

SEQ ID NO: 5470 - protein, 81 aa, Pongo abelii
QEEWEQLDLAQRTLYREVTLETWEHIVSLGLFLSKSDVISQLEQEEDLCRAEQEAPRGTGLSQVTGVVVDGSFRFQVWDFT

SEQ ID NO: 5471 - protein, 81 aa, Pongo abelii
DEGAAGVMSVGPPAARLQEPVTFRDVAVDFTQEEWGQLDPNQRILYRDVMLETFGHLLSIGPELPKPEVISQLEQGTELWV

SEQ ID NO: 5472 - protein, 81 aa, Pongo abelii
MAGEAEAQLDPSLQGLVMFEDVTVYFSRDEWGLLNVTQKGLYRDVMLENFALVSSLGLASSRSPVFTQLEDDEQSWVPSWV

SEQ ID NO: 5473 - protein, 81 aa, Pongo abelii
MAGEAEGLVMFEDVTVYFSRDEWGLLNVTQKGLYRDVMLENFALVSSLGLASSRSPVFTQLEDDEQSWVPSWVDVTPVSRA

SEQ ID NO: 5474 - protein, 81 aa, Pongo abelii
GPAQHTCWPCGSAVPTLKSLVTFEDVAVYFSQEEWELLDAAQRHLYHRVMLENLELVTSLGCWHGVEGEEAHPKQNVSVEV

SEQ ID NO: 5475 - protein, 81 aa, Pongo abelii
PTLKSLVTFEDVAVYFSQEEWELLDAAQRHLYHRVMLENLELVTSLGNALSQHVFTCSVGADLPNCFPNWLHHFTSLSAVY

SEQ ID NO: 5476 - protein, 81 aa, Pongo abelii
PLAAQSAEGHHGHQEPASTSFHPPRIQEEWGLLDRSQKELYWDAMLEKYGTVVSLGLPPHQPEAQAQSELGMLLTGTGVCR

SEQ ID NO: 5477 - protein, 81 aa, Pongo abelii
MGPQGARRQAFLAFGDVTVDFTQKEWRLLSPTQRALYREVTLENYSHLVSLGILHSKPELIRRLEQGEAPWGEERRRRPGP

SEQ ID NO: 5478 - protein, 81 aa, Pongo abelii
LPSNDTDWPQKKEGKAQIVVPVTFRDVTVIFTEAEWKRLSPEQRNLYKEVMLENYRNLLSLAEPKPEIYTCSSCLLAFSCQ

SEQ ID NO: 5479 - protein, 81 aa, Pongo abelii
AKGLPSNDTDWPQKKEGKAQIVVPVTFRDVTVIFTEAEWKRLSPEQRNLYKEVMLENYRNLLSLGQEIETILANIVKSRLY

SEQ ID NO: 5480 - protein, 81 aa, Pongo abelii
PSNDTDWPQKKEGKAQIVVPVTFRDVTVIFTEAEWKRLSPEQRNLYKEVMLENYRNLLSLDGVSLLLPRLECNGAISAHHN

SEQ ID NO: 5481 - protein, 81 aa, Pongo abelii
KNRENVETMKKLTQNHKAKGLPSNDTDWPQKKEGKAQIVVPVTFRDVTVIFTEAEWKRLSPEQRNLYKEVMLENYRNLLSL

SEQ ID NO: 5482 - protein, 81 aa, Pongo abelii
TQNHKAKGLPSNDTDWPQKKEGKAQIVVPVTFRDVTVIFTEAEWKRLSPEQRNLYKEVMLENYRNLLSLDGGQEQQDAAAY

SEQ ID NO: 5483 - protein, 81 aa, Pongo abelii
IENEKERPVSFQDLTVNFTQEEWQQLDPAQRLLYRDVMLENYSNLVSVGYHVSKPDVIFKLEQGEAPWIVEEFSNQNYPEV

SEQ ID NO: 5484 - protein, 81 aa, Pongo abelii
LKMKKFQRPVSFQDLTVNFTQEEWQQLDPAQRLLYRDVMLENYSNLVSVGYHVSKPDVIFKLEQGEAPWIVEEFSNQNYPE

SEQ ID NO: 5485 - protein, 81 aa, Pongo abelii
MLENYSNLVSVGYHVSKPDVIFKLEQGEAPWIVEEFSNQNYPEVDAALEKNKEIQDKHLTQTVFFSNKTLITERENVFGKT

SEQ ID NO: 5486 - protein, 81 aa, Pongo abelii
MEIPAPEPEKTESVSFKDVAVDFTQEEWGQLDSPQRALYRDVMLENYQNLLALGPPLHKPDVISHLERGEEPWSMQREVPG

SEQ ID NO: 5487 - protein, 81 aa, Pongo abelii
MEIPAPEPEKTESVSFKDVAVDFTQEEWGQLDSPQRALYRDVMLENYQNLLALEWELKAVPSQQQGICKEEPAQEPIMERP

SEQ ID NO: 5488 - protein, 81 aa, Pongo abelii
MTFEDVAVEFTQWEWGQLNPAQKDLYREVMLENFRNLAFLGLLVSKPYVICQLEERGEPFMVEREISTGAHSDWERRSKSK

SEQ ID NO: 5489 - protein, 81 aa, Pongo abelii
MAAVSPTTRCQESVTFEDVAVVFTDEEWSHLVPTQRDLYKEVMLENYNSIVSLDWETKPEIHDASNEKSEGSLRECLGRQS

SEQ ID NO: 5490 - protein, 81 aa, Pongo abelii
MAAVSPTTRCQESVTFEDVAVVFTDEEWSHLVPTQRDLYKEVMLENYNSIVSLGLPVPQPDVIFQLKRGDKPWMVDLHGSE

SEQ ID NO: 5491 - protein, 80 aa, Pongo abelii
MWAPREQLLGWATEALPAKDSAWPWEEKPRYLGPVTFEDVAVLFNEAEWKRLSLEQRNLYKEVMLENLRNLVSLVLFYQI

SEQ ID NO: 5492 - protein, 81 aa, Pongo abelii
EALPAKDSAWPWEEKPRYLGPVTFEDVAVLFNEAEWKRLSLEQRNLYKEVMLENLRNLVSLVLELGSPRLGLLPLDLNLDL

SEQ ID NO: 5493 - protein, 81 aa, Pongo abelii
EALPAKDSAWPWEEKPRYLGPVTFEDVAVLFNEAEWKRLSLEQRNLYKEVMLENLRNLVSLAESKPEVHTCPSCPLAFGSQ

SEQ ID NO: 5494 - protein, 81 aa, Pongo abelii
ALPAKDSAWPWEEKPRYLGPVTFEDVAVLFNEAEWKRLSLEQRNLYKEVMLENLRNLVSLESKPEVHTCPSCPLAFGSQQF

SEQ ID NO: 5495 - protein, 81 aa, Pongo abelii
MTRENWAHNALRQEGLVKGKDDTWKWATSFQGSSSSVWETSHLHFRQLRYHETSGPQEALSRLRELCRRWLRPEARTKAQI

SEQ ID NO: 5496 - protein, 81 aa, Pongo abelii
TLPQVGNSGDQAGATVLRMVRPQDTVVYEDLSVDYTQKKWKGLTLSQRALQWNMMPENDHSMASLDGETGTEEELIPKHHS

SEQ ID NO: 5497 - protein, 81 aa, Pongo abelii
DFAQCTSPVPTLPQVGNSGDQAGATVLRMVRPQDTVVYEDLSVDYTQKKWKGLTLSQRALQWNMMPENDHSMASLGWSTMA

SEQ ID NO: 5498 - protein, 81 aa, Pongo abelii
GNSGDQAGATVLRMVRPQDTVVYEDLSVDYTQKKWKGLTLSQRALQWNMMPENDHSMASLGENMMKGSELTPKQKIFKGSE

SEQ ID NO: 5499 - protein, 81 aa, Pongo abelii
VGNSGDQAGATVLRMVRPQDTVVYEDLSVDYTQKKWKGLTLSQRALQWNMMPENDHSMASLAGENMMKGSELTPKQKIFKG

SEQ ID NO: 5500 - protein, 81 aa, Pongo abelii
MVRPQDTVAYEDLSEDYTQKKWKGVALSQRALHWNMMLENDRSMTSLGRNMMESSELTPKQEIFKVSESSNSTSGGFFGVV

SEQ ID NO: 5501 - protein, 81 aa, Pongo abelii
MVRPQDTVAYEDLSEDYTQKKWKGVALSQRALHWNMMLENDRSMTSLAGRNMMESSELTPKQEIFKVSESSNSTSGGFFGV

SEQ ID NO: 5502 - protein, 81 aa, Pongo abelii
SQILELLVLEQFLSILPGELRVWVQLHNPESGEEAVALLEELQRDLDGTSWRDPGPAQSPDVHWMGTGALRSAQIWSLASP

SEQ ID NO: 5503 - protein, 81 aa, Pongo abelii
LAGQSDTPAAQMPALFQREGCPGDQVTPTRSLTAQLQETMTFKDVEVTFSQDEWGWLDSAQRNLYRDVMLENYRNMASLGK

SEQ ID NO: 5504 - protein, 81 aa, Pongo abelii
MMTAVSLTTRPQESVAFEDVAVYFTTKEWAIMVPAERALYRDVMLENYEAVAFVVSPTSKPALVSHLEQGKESCFTRPQGV

SEQ ID NO: 5505 - protein, 81 aa, Pongo abelii
MLQTVWFQGLSRNLLFQEPVTFEDVAVYFTQNEWASLHPTQRALYRGVMLENYANVTSLSAFPFPKPDLIFQLEQGEAAWG

SEQ ID NO: 5506 - protein, 81 aa, Pongo abelii
MLQTVWFQGLSRNLLFQEPVTFEDVAVYFTQNEWASLHPTQRALYRGVMLENYANVTSLYPTAGGFPLGTERTEKVPGALS

SEQ ID NO: 5507 - protein, 81 aa, Pongo abelii
EEAAQKRKEKEPGMALPQGHLTFRDVAIEFSLEEWKCLDTAQRALYRAVMLENYRNLHSVDISSKCMMKKFSSTGQGNIEV

SEQ ID NO: 5508 - protein, 81 aa, Pongo abelii
MELLTFRDVAIEFSPEEWKCLDPAQQNLYRDVMLENYRNLVSLAICSPFSQDLSPVQGVEDSFHKLILRRYEKCGHENLQL

SEQ ID NO: 5509 - protein, 81 aa, Pongo abelii
MELLTFRDVAIEFSPEEWKCLDPAQQNLYRDVMLENYRNLVSLGFVISNPDLVTCLEQIKEPCDLKIHETAAKPPAICSPF

SEQ ID NO: 5510 - protein, 81 aa, Pongo abelii
MELLTFRDVAIEFSPEEWKCLDPSQQNLYRDVMLENYRNLVSLGVTISNPDLVTCLEQRKEPYNVKINETAARPPAVCSHF

SEQ ID NO: 5511 - protein, 81 aa, Pongo abelii
RIHSGQKHYKCEECGKAFKWSSSLNEHKRIHAGEKPFSCEECGCVFTTSSDFAKHKRIHTGEKPYRCEECGKSFNRSTTLT

SEQ ID NO: 5512 - protein, 81 aa, Pongo abelii
MELLTFRDVAIEFSPEEWKCLDPSQQNLYRDVMLENYRNLVSLGVTISNPDLVTCLEQRKEPYNVKINETAARPPGHYRKR

SEQ ID NO: 5513 - protein, 81 aa, Pongo abelii
MLENYRNLVSLGVTISNPDLVTCLEQRKEPYNVKINETAARPPAVCSHFTQNLWTVQGIEDSFHKLIPKGHEKRGHENLRK

SEQ ID NO: 5514 - protein, 81 aa, Pongo abelii
IHSGQKHYKCEECGKAFKWSSSLNEHKRIHAGEKPFSCEECGCVFTTSSDFAKHKRIHTGEKPYRCEECGKSFNRSTTLTT

SEQ ID NO: 5515 - protein, 81 aa, Pongo abelii
MELLTFRDVAVEFSPEEWKCLDPAQQNLYRDVMLENYRNLVSLGVAISNPDLVIYLEQRKEPYKMKIHETVAKHPAMCSHF

SEQ ID NO: 5516 - protein, 81 aa, Pongo abelii
ELLTFRDVAVEFSPEEWKCLDPAQQNLYRDVMLENYRNLVSLGVAISNPDLVIYLEQRKEPYKMKIHETVAKHPAMCSHFT

SEQ ID NO: 5517 - protein, 81 aa, Pongo abelii
MELLTFRDVAVEFSPEEWKCLDPAQQNLYRDVMLENYRNLVSLGIAISNPDLVTCLEQRKEPYNVKIHKIVARPPAVCSHF

SEQ ID NO: 5518 - protein, 81 aa, Pongo abelii
SLGIAISNPDLVTCLEQRKEPYNVKIHKIVARPPAVCSHFTQDHWPVQGIEDSFHKLILRRYEKCGHDNLQLRKGCKSLNE

SEQ ID NO: 5519 - protein, 81 aa, Pongo abelii
LGIAISNPDLVTCLEQRKEPYNVKIHKIVARPPAVCSHFTQDHWPVQGIEDSFHKLILRRYEKCGHDNLQLRKGCKSLNEC

SEQ ID NO: 5520 - protein, 81 aa, Pongo abelii
MELLTFRDVAVEFSPEEWKCLDPAQQNLYRDVMLENYRNLVSLGIAISNPDLVTCLEQRKEPYNVKIHKIVARPPEFFHLY

SEQ ID NO: 5521 - protein, 81 aa, Pongo abelii
MEPLTFRDVAIEFSPEEWKCLDPAQQNLYRDVMLENYRNLVSLVSLLVSSCCVISHGLPRRNRATEKNDLLTTEEPVVKHR

SEQ ID NO: 5522 - protein, 81 aa, Pongo abelii
MLENYRNLVSLVISSSSSFAKHKRIHTGEKPFKCLECGKAFNISTTLTKHRRIHTGEKPYTCEVCGKAFRQSANLYVHRRI

SEQ ID NO: 5523 - protein, 81 aa, Pongo abelii
SQEESPEDDTERTERKPTVKDAFKDISIYFTKEEWAEMGDWEKTRYRNVKRNYNALITIGLRATRPAFMCHRRQAIKLQVD

SEQ ID NO: 5524 - protein, 81 aa, Pongo abelii
RKPTVKDAFKDISIYFTKEEWAEMGDWEKTRYRNVKRNYNALITIGLRATRPAFMCHRRQAIKLQVDDTEDSDEEWTPRQQ

SEQ ID NO: 5525 - protein, 81 aa, Pongo abelii
MMKSQGLVSFKDVAVDFTQEEWQQLDPSQRTLYRDVMLENYSHLVSMGYPVSKPDVISRLEQGEEPWIIKGDISNWIYPDD

SEQ ID NO: 5526 - protein, 81 aa, Pongo abelii
MLENYSHLVSMGYPVSKPDVISRLEQGEEPWIIKGDISNWIYPDDYQADGRQDRKSNLHNSQSCILGTVSFHHKILKGVTR

SEQ ID NO: 5527 - protein, 81 aa, Pongo abelii
ADPSSSGLLEEQKMMKSQGLVSFKDVAVDFTQEEWQQLDPSQRTLYRDVMLENYSHLVSMGYPVSKPDVISRLEQGEEPWI

SEQ ID NO: 5528 - protein, 81 aa, Pongo abelii
MLPIVQLYPQGLVSFKDVAVDFTQEEWQQLDPSQRTLYRDVMLENYSHLVSMGYPVSKPDVISRLEQGEEPWIIKGDISNW

SEQ ID NO: 5529 - protein, 81 aa, Pongo abelii
MAAGQREARPQVSLTFDDVAVLFTRDEWRKLAPSQRNLYRDVMLENYRNLVSLGLSFTKPKVISLLQQGEDPWKVEKDSSG

SEQ ID NO: 5530 - protein, 81 aa, Pongo abelii
MAAGQREARPQVSLTFEDVAVLFTWDEWRKLAPSQRNLYRDVMLENYRNLVSLGLSFTKPKVISLLQQGEDPWKVEKDSSG

SEQ ID NO: 5531 - protein, 81 aa, Pongo abelii
MAAWPLPLGARFQESVTFKDVSIDFSWEEWIQADSAQRMTVYEEVMLENYRNLVSLAGNHLSKPSGTSQLEREELSLTQKE

SEQ ID NO: 5532 - protein, 81 aa, Pongo abelii
SAQRMTVYEEVMLENYRNLVSLAGNHLSKPSGTSQLEREELSLTQKEPPEGGFRDFLGYCCQINLTFSPLIILSQSRGESI

SEQ ID NO: 5533 - protein, 81 aa, Pongo abelii
MAVSHLPMMVQELVTFKDVAVLFTQEEWGQLSPAQRALYRDVMLENYSNLVSLGLLGPKPDMFSQLEKREVWMPEDTPGGF

SEQ ID NO: 5534 - protein, 81 aa, Pongo abelii
MARRLLPAHVQESVTFRDVAVFFSQDEWLHLDSAQRALYREVMLENYSILVSLGILFSKPKVISQLEQGEDAWMVESGVPQ

SEQ ID NO: 5535 - protein, 81 aa, Pongo abelii
MAVDLLPAQEPVMFRDVAVFFSQDEWLHLDSAQRALYREVMLENYSSLVSLGIPFSMPKLIHQLQQGEDPCMMEREVPADT

SEQ ID NO: 5536 - protein, 81 aa, Pongo abelii
GSSGDQEMAATLLTAGFQTLEKIEDMAVSLIREEWLLDPSQKDLSRDNRPENFRNVFSLGGETRSENRELASKQVICTGIQ

SEQ ID NO: 5537 - protein, 81 aa, Pongo abelii
GGCCREDAVVASRLTPESQGLLKVEDVALTLTPEWTQQDSSQGNLCRNEKQENHGSLVSLGDEKQIKSRDLPPAEKLPEKE

SEQ ID NO: 5538 - protein, 81 aa, Pongo abelii
GSQGDLPQADITLMSQAQESVSFEDVAVNFTNREWQCLTYAQRHLYKDVMLENYGNMVSLGFPFPKPPLISHLEREVDPCV

SEQ ID NO: 5539 - protein, 81 aa, Pongo abelii
ATLQEAMKRDCWREAWVKKKPVTFEDVAVNFTQEEWDCLDASQRVLYQDVMSETFKNLTSVARIFLHKPELITKLEQEEEQ

SEQ ID NO: 5540 - protein, 81 aa, Pongo abelii
EQLKPIEPRDCWREAWVKKKPVTFEDVAVNFTQEEWDCLDASQRVLYQDVMSETFKNLTSVARIFLHKPELITKLEQEEEQ

SEQ ID NO: 5541 - protein, 81 aa, Pongo abelii
EEEEEDEDEDDLLMAGSQGLVTFEDVAVYFSLEEWERLEADQRGLYQEVMQENYGILVSLGYPIPKPDLIFRLEQGEEPWV

SEQ ID NO: 5542 - protein, 81 aa, Pongo abelii
MLENYSNLVSVGYHIIKPDVISKLEQGEEPWIVEGEFLLQSYPDEVWQTDDLKERIQEEENKPLRQTVFIETLIEEREYIS

SEQ ID NO: 5543 - protein, 81 aa, Pongo abelii
MFPPARGKELLSFEDVAMYFTREEWGHLSWGQKDLYRDVMLENYRNMVLLGFQFPKPEVICQLENWDEQWILDLPRAGNRK

SEQ ID NO: 5544 - protein, 81 aa, Pongo abelii
MELLSFEDVAMYFTREEWGHLSWGQKDLYRDVMLENYRNMVLLGFQFPKPEVICQLENWDEQWILDLPRAGNRKASGSACP

SEQ ID NO: 5545 - protein, 81 aa, Pongo abelii
EEAVAVVRALQRALDGTSPQGMVTFEDMAVSLTWEEWERLDPARRDFCRESVQKDSGSTVPPSPVKMKGRGCLLSSTRGSH

SEQ ID NO: 5546 - protein, 81 aa, Pongo abelii
EEAVAVVRALQRALDGTSPQGMVTFEDMAVSLTWEEWERLDPARRDFCRESVQKDSGSTVPPSLESRVENKELIPMQQILE

SEQ ID NO: 5547 - protein, 81 aa, Pongo abelii
LAGAPPVPQVPALPREGSPGDQAAALLTARYQEFVTFEDVAVHLTREEWGYLDPVQRDLYREVMLENYGNVVSLGTVGSWD

SEQ ID NO: 5548 - protein, 81 aa, Pongo abelii
MASALFTADSQAMVKIEDMAVSLILEEWGCQNLARRNLSRDNKQENYGSAFPQGGENRNENEESTSKAETAEDSASHGETA

SEQ ID NO: 5549 - protein, 81 aa, Pongo abelii
EGSPRDQAMASALFTADSQAMVKIEDMAVSLILEEWGCQNLARRNLSRDNKQENYGSAFPQGGENRNENEESTSKAETAED

SEQ ID NO: 5550 - protein, 81 aa, Pongo abelii
DSLGDEMLAAALLKAKSQELVTFEDVAVYFIRKEWKRLEPAQRDLYRDVMLENYGNVFSLDWTHVSLTTQKVMLAWLTGTL

SEQ ID NO: 5551 - protein, 81 aa, Pongo abelii
DSLGDEMLAAALLKAKSQELVTFEDVAVYFIRKEWKRLEPAQRDLYRDVMLENYGNVFSLDHETRTENDQEICEDTRSHGV

SEQ ID NO: 5552 - protein, 81 aa, Pongo abelii
MLAAALLKAKSQELVTFEDVAVYFIRKEWKRLEPAQRDLYRDVMLENYGNVFSLDHETRTENDQEICEDTRSHGVLLGRFQ

SEQ ID NO: 5553 - protein, 81 aa, Pongo abelii
VPAFSDKDSLGDEMLAAALLKAKSQELVTFEDVAVYFIRKEWKRLEPAQRDLYRDVMLENYGNVFSLDHETRTENDQEICE

SEQ ID NO: 5554 - protein, 81 aa, Pongo abelii
FIFLSVFDFVVLWCVLFQGPVSFKDAAVDFTQEEWRQLDPDEKITYGDVMLENYSHLVSMGYDITKPNVIIKLEQGEEPWI

SEQ ID NO: 5555 - protein, 81 aa, Pongo abelii
MAKRPGPPGSREMGLLTFRDIAIEFSLAEWQCLDHAQRNLYRDVMLENYRNLVSLGIAVSKPDLITCLEQNKEPRNIKRNE

SEQ ID NO: 5556 - protein, 81 aa, Pongo abelii
MAEPASVTVTFDDVALYFSEQEWEILEKWQKQMYKQEMKTNYETLDSLGYAFSKPDLITWMEQGRMLLISEHGCLAKTRRT

SEQ ID NO: 5557 - protein, 81 aa, Pongo abelii
KKLASCEKTVTELGNQLDGKWAVLGTLLQEYGLLQRRLENLENLLRNRNFWILRLPPGIKGDIPKVPVAFDDVSIYFSTPE

SEQ ID NO: 5558 - protein, 81 aa, Pongo abelii
RNFWVLRLPPGSKGEAPKVPVTFVDIAVYFSEDEWKNLDEWQKELYNNLVKENYKTLMSLDAEGSVPKPDAPAQAEPREEP

SEQ ID NO: 5559 - protein, 81 aa, Pongo abelii
KKLADCEKMAVEFGNQLEGKWALLGTLLQEYGLLQRRLENVENLLRNRNFWILRLPPGSKGEAPKVSRSLENDGVCFTEQE

SEQ ID NO: 5560 - protein, 81 aa, Pongo abelii
RNFWILRLPPGSKGEAPKVSRSLENDGVCFTEQEWENLEDWQKELYRNVMESNYETLVSLKRVLLCCPGWSAVTRSWLTAT

SEQ ID NO: 5561 - protein, 81 aa, Pongo abelii
RNFWILRLPPGSKGEAPKVSRSLENDGVCFTEQEWENLEDWQKELYRNVMESNYETLVSLKVLGQTEGEAELGTQMLGDLE

SEQ ID NO: 5562 - protein, 81 aa, Pongo abelii
PGGAHPAGGVMIKQELQYTQEGPADLPGEFSCIAEEQAFLSPEQTELWGGQGSSVLLETGPGDSTLEEPVGCRDPSSSRTV

SEQ ID NO: 5563 - protein, 81 aa, Pongo abelii
LEEEGPGGAHPAGGVMIKQELQYTQEGPADLPGEFSCIAEEQAFLSPEQTELWGGQGSSVLLETGPGDSTLEEPVGCRDPS

SEQ ID NO: 5564 - protein, 81 aa, Pongo abelii
MRENYETLVSVGTAELLPLSAFLSPSEPGRAVGGGSHADEGQEPAGCGGPQGGQPRHSLHLTALVQLVKEIPEFLFGEVKG

SEQ ID NO: 5565 - protein, 81 aa, Pongo abelii
MEPRESGKAPVTFDDITVYLLQEEWVLLSQQQKELCGSDKLVAPLGPTVANPELFCKFGRGPEPWLGSVQGQRSLLEHHPG

SEQ ID NO: 5566 - protein, 81 aa, Pongo abelii
QDPSAEGLSEEVPVVFEELPVVFEDVAVYFTREEWGMLDKWQKELYRDVMRMNYELLASLGPAAAKPDLISKLERRAAPWI

SEQ ID NO: 5567 - protein, 81 aa, Pongo abelii
MPSPDSMTFEDIVVDFTQEEWALLDTSQRKLFQDVMLENISHLVSIGKQLCKSVVLSHLEQVEKLSTQRISLLQGRQVDIK

SEQ ID NO: 5568 - protein, 81 aa, Pongo abelii
DFTQEEWALLDTSQRKLFQDVMLENISHLVSIGKQLCKSVVLSHLEQVEKLSTQRISLLQGRQVDIKHQEIPFIQHIYQKG

SEQ ID NO: 5569 - protein, 81 aa, Pongo abelii
TQRISLLQGRQVDIKHQEIPFIQHIYQKGTSTISTMRSHTQEDPFLCNDLGEDFTQHIALTQNVITYVRKKHFVSKKFGKT

SEQ ID NO: 5570 - protein, 81 aa, Pongo abelii
DIKHQEIPFIQHIYQKGTSTISTMRSHTQEDPFLCNDLGEDFTQHIALTQNVITYVRKKHFESGRSSEDRSVVTATSIKTL

SEQ ID NO: 5571 - protein, 81 aa, Pongo abelii
VVLSHLEQVEKLSTQRISLLQGRQVDIKHQEIPFIQHIYQKGTSTISTMRSHTQEDPFLCNDLGEDFTQHIALTQNVITYV

SEQ ID NO: 5572 - protein, 81 aa, Pongo abelii
MDVAQEPVTFRDVAIYFSREEWACLEPSQRALYRDVMLDNFSSVAALGFCSPRPDLVSRLEQWEEPWVEDRERPELQAVQR

SEQ ID NO: 5573 - protein, 81 aa, Pongo abelii
MDVAQEPVTFRDVAIYFSREEWACLEPSQRALYRDVMLDNFSSVAALAPDQTSSLAWNSGKSRGLKTGRDLSSRQCREGPS

SEQ ID NO: 5574 - protein, 81 aa, Pongo abelii
MDVAQEPVTFRDVAIYFSREEWACLEPSQRALYRDVMLDNFSSVAALEGFCSPRPDLVSRLEQWEEPWVEDRERPELQAVQ

SEQ ID NO: 5575 - protein, 81 aa, Pongo abelii
MAATLQFPGYQEMPLTFQDVAVYFSQAEGQQLGPQQRALYRDVMLENYGNVASLGFPIPKPELISQLEQGKELWVLNLLGA

SEQ ID NO: 5576 - protein, 81 aa, Pongo abelii
AAHAHRMAATLQFPGYQEMPLTFQDVAVYFSQAEGQQLGPQQRALYRDVMLENYGNVASLGFPIPKPELISQLEQGKELWV

SEQ ID NO: 5577 - protein, 81 aa, Pongo abelii
RKPNPQAMAALFLSAPPQAEVTFEDVAVYLSQEEWGRLGPAQRGLYRDVMLETYGNLVSLGVGPAGPKPGVISQLERGDEP

SEQ ID NO: 5578 - protein, 81 aa, Pongo abelii
MAALFLSAPPQAEVTFEDVAVYLSQEEWGRLGPAQRGLYRDVMLETYGNLVSLGVGPAGPKPGVISQLERGDEPWVLDVQG

SEQ ID NO: 5579 - protein, 81 aa, Pongo abelii
TTSPLWTTPGLQQSLSFQAEVTFEDVAVYLSQEEWGRLGPAQRGLYRDVMLETYGNLVSLGVGPAGPKPGVISQLERGDEP

SEQ ID NO: 5580 - protein, 81 aa, Pongo abelii
MAALFLSAPPQAEVTFEDVAVYLSQEEWGRLGPAQRGLYRDVMLETYGNLVSLALGTRTEYKELTSRETFGEEDPQGSEPV

SEQ ID NO: 5581 - protein, 81 aa, Pongo abelii
LRKPNPQAMAALFLSAPPQAEVTFEDVAVYLSQEEWGRLGPAQRGLYRDVMLETYGNLVSLALGTRTEYKELTSRETFGEE

SEQ ID NO: 5582 - protein, 81 aa, Pongo abelii
MAMALPKPGPQEAVVFEDVAVYFTRIEWSCLAPDQQALYRDVMLENYGNLASLGFLVAKPALISLLEQGEEPGALILQGAE

SEQ ID NO: 5583 - protein, 81 aa, Pongo abelii
MAMALPKPGPQEAVVFEDVAVYFTRIEWSCLAPDQQALYRDVMLENYGNLASLALISLLEQGEEPGALILQGAEQSVAKAS

SEQ ID NO: 5584 - protein, 81 aa, Pongo abelii
VMLENYGNLASLALISLLEQGEEPGALILQGAEQSVAKASLCTDSRMEAGIMESPLQRKLSTQAGLPGTVWGCLPPAPPHP

SEQ ID NO: 5585 - protein, 81 aa, Pongo abelii
MAAARLLPVPAGPQAKLTFEDVAVLLSDEWDRLCPAQRGLYRNVMMETYGNVVSLGLPGSKPDIISQLERGEDPWVLDRKG

SEQ ID NO: 5586 - protein, 81 aa, Pongo abelii
MAAARLLPVPAGPQPLSFQAKLTFEDVAVLLSDEWDRLCPAQRGLYRNVMMETYGNVVSLGLPGSKPDIISQLERGEDPWV

SEQ ID NO: 5587 - protein, 81 aa, Pongo abelii
MVSFEDVAVPLSQEEWDCLIPAQRGLYKDVMMETYGNLVSLGLQASKPDVISRLEQGDEPWTPHILRTWGSWSWRHKREDA

SEQ ID NO: 5588 - protein, 81 aa, Pongo abelii
MNMYQASVSFQDVTVEFTQEEWQHLGPVERTLYRDVMLENYSHLISVGYCITKPKVISKLEKGEEPWSLEDEFLNQRYPGY

SEQ ID NO: 5589 - protein, 81 aa, Pongo abelii
MLENYSHLISVGYCITKPKVISKLEKGEEPWSLEDEFLNQRYPGYFKVDHIKGIQEKQEKPLWQEIFINDADKTLSKEGQK

SEQ ID NO: 5590 - protein, 81 aa, Pongo abelii
MTKSLESVSFKDVTVDFSRDEWQQLDLAQKSLYREVMLENYFNLISVGCQVPKPEVIFSLEQEEPCMLDGEIPSQSLPDGD

SEQ ID NO: 5591 - protein, 81 aa, Pongo abelii
MSVVSPPESVSFKDVTVDFSRDEWQQLDLAQKSLYREVMLENYFNLISVGCQVPKPEVIFSLEQEEPCMLDGEIPSQSLPD

SEQ ID NO: 5592 - protein, 81 aa, Pongo abelii
MAPGLLTTRKEALMAFRDVAVAFTQKEWKLLSSAQRTLYREVMLENYSHLVSLGIAFSKPKLIEQLEQGDEPWREENEHLL

SEQ ID NO: 5593 - protein, 81 aa, Pongo abelii
ENYSHLVSLGIAFSKPKLIEQLEQGDEPWREENEHLLDLCPGEWEALGRQGCRAVRSSAGKEGGAVFEVLGGSSSSGLLGH

SEQ ID NO: 5594 - protein, 81 aa, Pongo abelii
PLRFSTLFQEQQKMNMSQASVSFKDVTIEFTQEEWQQMAPVQKNLYRDVMLENYSNLVSVGYCHFKPEVIFKLEQGEEPWF

SEQ ID NO: 5595 - protein, 81 aa, Pongo abelii
EFTQEEWQQMAPVQKNLYRDVMLENYSNLVSVGYCHFKPEVIFKLEQGEEPWFSEEEFSNQSHPSELLSSSRYNSAGVVRL

SEQ ID NO: 5596 - protein, 81 aa, Pongo abelii
MNTFQASVSFQDVTVEFSQEEWQHMGPVERTLYRDVMLENYSHLVSVGYCFTKPELIFTLEQGEDPWLLEKEKGFLSRNSP

SEQ ID NO: 5597 - protein, 81 aa, Pongo abelii
MASPSPPPESKEEWDYLDPAQRSLYKDVMMENYGNLVSLGLTLLPRLVCSDANTACCSLNLLGLNDQSSHLSYLGSWDYRC

SEQ ID NO: 5598 - protein, 81 aa, Pongo abelii
ENSKEDKMVAVCPNTESCESITLKDVSVNFSRGEWKKLEPFQKELYKEVLLENLRNLEFLDFPVSKLELISQLKWVELPWL

SEQ ID NO: 5599 - protein, 81 aa, Pongo abelii
DRRRSAGTTKEAGRPLEMAVSEPEASAAEWKQLDPAQRNLYNDVMLENYSNQASMGCQAPKPDMISKLEKGEAPWLGKGKR

SEQ ID NO: 5600 - protein, 81 aa, Pongo abelii
RRRSAGTTKEAGRPLEMAVSEPEASAAKEWKQLDPAQRNLYNDVMLENYSNQASMGCQAPKPDMISKLEKGEAPWLGKGKR

SEQ ID NO: 5601 - protein, 81 aa, Pongo abelii
EAGRPLEMAVSEPEASAAVSVTFKHVTMAFTQKEWKQLDPAQRNLYNDVMLENYSNQASMGCQAPKPDMISKLEKGEAPWL

SEQ ID NO: 5602 - protein, 81 aa, Pongo abelii
MAAGLLTAGPRGSTFFSSVTVAFAQEGWRCLVSTPQDRFKEGIPGKSRNLVLLGLPVSQPGMNSQLEQREGAWMLEGEDLR

SEQ ID NO: 5603 - protein, 81 aa, Pongo abelii
ENTGEEGMAAGLLTAGPRGSTFFSSVTVAFAQEGWRCLVSTPQDRFKEGIPGKSRNLVLLGLPVSQPGMNSQLEQREGAWM

SEQ ID NO: 5604 - protein, 81 aa, Pongo abelii
MSAVEQKFQGSVSFKDVTVGFTQEEWQHLDPSQRALYRDVMLENYSNLVSVGYCAHKPEVIFRLEQGEEPWRLEEEFPSWS

SEQ ID NO: 5605 - protein, 81 aa, Pongo abelii
MNKVEQKFQGSVSFKDVTVGFTQEEWQHLDPSQRALYRDVMLENYSNLVSVGYCAHKPEVIFRLEQGEEPWRLEEEFPSWS

SEQ ID NO: 5606 - protein, 81 aa, Pongo abelii
HLDPSQRALYRDVMLENYSNLVSVGYCAHKPEVIFRLEQGEEPWRLEEEFPSWSFPEVWTADHLKERSQENQSKHLWEVVF

SEQ ID NO: 5607 - protein, 81 aa, Pongo abelii
MANAIRKESKVEQKFQGSVSFKDVTVGFTQEEWQHLDPSQRALYRDVMLENYSNLVSVGYCAHKPEVIFRLEQGEEPWRLE

SEQ ID NO: 5608 - protein, 81 aa, Pongo abelii
MNTLQGPVSFKDVAVDFTQEEWQQLDPDEKITYRDVMLENYSHLVSVGYDITKPNVIIKLEQGEEPWIMEGEFPCQHSPEV

SEQ ID NO: 5609 - protein, 81 aa, Pongo abelii
MNTLQGPVSFKDVAVDFTQEEWQQLDPDEKITYRDVKVWKVDDLIERIQENEDKHSSRPARRPCGPCCCCCCCCSRSPRSP

SEQ ID NO: 5610 - protein, 81 aa, Pongo abelii
MNTLQGPVSFKDVAVDFTQEEWQQLDPDEKITYRDVKVWKVDDLIERIQENEDKHSRQAACINSKTLTEEKQNTFSQIYME

SEQ ID NO: 5611 - protein, 81 aa, Pongo abelii
GLLTFRDIAIEFSLEEWQCLDCAQQNLYRDVILENYRNLVSLGIAVSKPDLITCLGQNKESQHIKRNEMVAKHPVTRSHFT

SEQ ID NO: 5612 - protein, 81 aa, Pongo abelii
MEEKEMNDGSQMVRSQESLTFQDVAVDFTREEWDQLYPAQKNLYRDVMLENYRNLVALGYQLYKPEVIAQLELEEEWVIER

SEQ ID NO: 5613 - protein, 81 aa, Pongo abelii
GNMEEKEMNDGSQMVRSQESLTFQDVAVDFTREEWDQLYPAQKNLYRDVMLENYRNLVALGYQLYKPEVIAQLELEEEWVI

SEQ ID NO: 5614 - protein, 81 aa, Pongo abelii
MAKRPGSPGSREMRLLTFRDIAIEFSLVEWQYLDHAQQNLYRDVMLENYRNLVSLGIADSKPDLITFLEQNKESWNIKRNE

SEQ ID NO: 5615 - protein, 81 aa, Pongo abelii
MGVLTFRDVAVEFSPEEWECLDSAQQHLYRDVMLENYGNLFSLGLAIFKPDLMTCLEQRKEPWNVKRQKTVAKHPAGSLHF

SEQ ID NO: 5616 - protein, 81 aa, Pongo abelii
MAKRPGPPGSREMELLTFRDIAIEFSLEEWQCLDHAQQNLYRDVMLENYRNLVSLGITVSKPDLITCLEQNKEPRNIKRNE

SEQ ID NO: 5617 - protein, 81 aa, Pongo abelii
MAKRPGSPGSREMGLLTFRDVVIEFSLKEWQCLDHAQQNLYRDVMLENYRNLVSLGIAVSKPDLITCLEQNKEPWNIKRDE

SEQ ID NO: 5618 - protein, 81 aa, Pongo abelii
MGVLTFRDVAVEFSPEEWECLDSAQQRLYRDVMLENYGNLVSLGLAIFKPDLMTCLEQRKEPWNVKRQKTVAKHPAGSFHF

SEQ ID NO: 5619 - protein, 81 aa, Pongo abelii
MPGPPGSLEMGPLTFRDVAIEFSLEEWQCLDTAQRNLYRKVMFENYRNLVFLGIAVSKPHLITCLERGKEPWNRKRQEMVA

SEQ ID NO: 5620 - protein, 81 aa, Pongo abelii
MEPLTFKDVAIEFSLEEWQCLDTAQRDLYRNVLLENYRNLVFLVMSFHLAQDLWPEQNIKDSFQKVTLRRYGKCGYENLQL

SEQ ID NO: 5621 - protein, 81 aa, Pongo abelii
MEPLTFKDVAIEFSLEEWQCLDTAQRDLYRNVLLENYRNLVFLGIAVSKPYLITCLEQKKEPWNIKRHEMVAKPPVMSFHL

SEQ ID NO: 5622 - protein, 81 aa, Pongo abelii
MEPLTFKDVAIEFSLEEWQCLDTAQRDLYRNVLLENYRNLVFLGIAVSKPYLITCLEQKKEPWNIKRHEMVAKPPGASSVL

SEQ ID NO: 5623 - protein, 81 aa, Pongo abelii
MGPLTFMDVAIEFSLEEWQCLDTSQQNLYRHVMLENYRNLVFLDLITCLEQGKEPWNMKRHEMVVAKHSALCSHFAQDLWL

SEQ ID NO: 5624 - protein, 81 aa, Pongo abelii
MGPLTFMDVAIEFSLEEWQCLDTSQQNLYRHVMLENYRNLVFLAVAFTFDLSGLNILSFQSILPFISALYVMGNRNQCLQK

SEQ ID NO: 5625 - protein, 81 aa, Pongo abelii
MGPLTFMDVAIEFSLEEWQCLDTSQQNLYRHVMLENYRNLVFLALCSHFAQDLWLEQNIKDSFQKVTLSRYGKYGHKNLQL

SEQ ID NO: 5626 - protein, 81 aa, Pongo abelii
MGPLTFMDVAIEFSLEEWQCLDTSQQNLYRHVMLENYRNLVFLDLITCLEQGKEPWNMKRHEMVVAKHSAVAFTFDLSGLN

SEQ ID NO: 5627 - protein, 81 aa, Pongo abelii
MDVAIEFSLEEWQCLDTSQQNLYRHVMLENYRNLVFLALCSHFAQDLWLEQNIKDSFQKVTLSRYGKYGHKNLQLRNGCKS

SEQ ID NO: 5628 - protein, 81 aa, Pongo abelii
MGPLTFMDVAIEFSLEEWQCLDTSQQNLYRHVMLENYRNLVFLGIAISKPDLITCLEQGKEPWNMKRHEMVVAKHSDTLPF

SEQ ID NO: 5629 - protein, 81 aa, Pongo abelii
GIGRPTAKTPGLPGSLEMGPLTFRDVAIEFSLEEWQCLDTAQQNLYRNVMLENYRNLVFLGIAVSKPDLITCLEQGKEPCN

SEQ ID NO: 5630 - protein, 81 aa, Pongo abelii
MGPLTFMDVAIEFSLEEWQCLDTAQQNLYRHVMLENYRNLVFLAGIAVSKPDLITCLEQGKEPWNMKRHEMVAKHLVICLQ

SEQ ID NO: 5631 - protein, 81 aa, Pongo abelii
FSLEEWQCLDTAQQNLYRHVMLENYRNLVFLAGIAVSKPDLITCLEQGKEPWNMKRHEMVAKHLVICLQFHSESQRPLHGI

SEQ ID NO: 5632 - protein, 81 aa, Pongo abelii
MGPLTFRDVKIEFSLEEWQCLDTAQRNLYRDVMLENYRNLVFLGIAVSKPDLITWLEQGKEPWNMKRHEMVDKTPVMCSHF

SEQ ID NO: 5633 - protein, 81 aa, Pongo abelii
MAMSQESLTFKDVFVDFTLEEWQQLDSAQKNLYRDVMLENYSHLVSVGYLVAKPDVIFRLGPGEESWMADGGTPLRTCAEV

SEQ ID NO: 5634 - protein, 81 aa, Pongo abelii
MAMSQESLTFKDVFVDFTLEEWQQLDSAQKNLYRDVMLENYSHLVSVGYLVAKPDVIFRLGPGEESWMADGGTPLRTCAGE

SEQ ID NO: 5635 - protein, 81 aa, Pongo abelii
VAKPDVIFRLGPGEESWMADGGTPLRTCAGEDRPGESGRGKETRFVGEILASGMCSGALLRASDLWTCLGSDERNCCHVQM

SEQ ID NO: 5636 - protein, 81 aa, Pongo abelii
MAMSQESLTFKDVFVDFTLEEWQQLDSAQKNLYRDVMLENYSHLVSVGYLVAKPDVIFRLGPGEESWMADGGTPLRTCAGT

SEQ ID NO: 5637 - protein, 81 aa, Pongo abelii
MAMSQESLTFKDVFVDFTLEEWQQLDSAQKNLYRDVMLENYSHLVSVGYLVAKPDVIFRLGPGEESWMADGGTPVRTCAVW

SEQ ID NO: 5638 - protein, 81 aa, Pongo abelii
MAMSQESLTFKDVFVDFTLEEWQQLDSAQKNLYRDVMLENYSHLVSVGYLVAKPDVIFRLGPGEESWMADGGTPVRTCAEN

SEQ ID NO: 5639 - protein, 81 aa, Pongo abelii
MAMSQESLTFKDVFVDFTLEEWQQLDSAQKNLYRDVMLENYSHLVSVGYLVAKPDVIFRLGPGEESWMADGGTPVRTCAVE

SEQ ID NO: 5640 - protein, 81 aa, Pongo abelii
MNKDPIIVHLKGSVSFEDVAVDFTRQEWHRLDPAQRTMHKDVMLETYSNLASVGLCVAKPEMIFKLERGEELWILEEESSG

SEQ ID NO: 5641 - protein, 81 aa, Pongo abelii
SPPWSPALAAEGRGSSCEASVSFEDVTVDFSREEWQHLDPAQRRLYWDVTLENYSHLLSVGYQVPKSEAAFKLEQGEGPWT

SEQ ID NO: 5642 - protein, 81 aa, Pongo abelii
YPDLSPGPRGRRRIVSLQASVSFEDVTVDFSREEWQHLDPAQRRLYWDVTLENYSHLLSVGYQVPKSEAAFKLEQGEGPWT

SEQ ID NO: 5643 - protein, 81 aa, Pongo abelii
TLEGKAPHQSCSGEAIGKMQQQGIPGGIFFHCERFDQSIGEDSLCSILEELWQDNDQLEQCQENQNNLLSHVKEVLMVYLF

SEQ ID NO: 5644 - protein, 81 aa, Pongo abelii
AAHVSADHAALNRIVSLQASVSFEDVTVDFSREEWQHLDPAQRRLYWDVTLENYSHLLSVGYQVPKSEAAFKLEQGEGPWT

SEQ ID NO: 5645 - protein, 81 aa, Pongo abelii
LEGKAPHQSCSGEAIGKMQQQGIPGGIFFHCERFDQSIGEDSLCSILEELWQDNDQLEQCQENQNNLLSHVKVLIKERGYE

SEQ ID NO: 5646 - protein, 81 aa, Pongo abelii
MIESQEPVTFEDVAVDFTQEEWQQLNPAQKTLHRDVMLETYNHLVSMGCSGIKPDVIFKLEHGKDPWIIESELSRWTYPDR

SEQ ID NO: 5647 - protein, 81 aa, Pongo abelii
MVEGEEEWQQLNPAQKTLHRDVMLETYNHLVSMGCSGIKPDVIFKLEHGKDPWIIESELSRWTYPDRVKGLESSQEIISGE

SEQ ID NO: 5648 - protein, 80 aa, Pongo abelii
MIESQEPVTFEDVAVDFTQEEWQQLNPAQKTLHRDVMLETYNHLVSMGCSGIKPDVIFKLEHGKDPWIIESELSRWTYPE

SEQ ID NO: 5649 - protein, 81 aa, Pongo abelii
MIESQEEWQQLNPAQKTLHRDVMLETYNHLVSMGCSGIKPDVIFKLEHGKDPWIIESELSRWTYPDRVKGLESSQEIISGE

SEQ ID NO: 5650 - protein, 81 aa, Pongo abelii
NGDDAFAKRPRDDAKTSEKRSKAFDDIATYFSKKEWEKMKYSEKINYVYMKRNYETMTKLGFNVTLPPFMHNKQATDFQGN

SEQ ID NO: 5651 - protein, 81 aa, Pongo abelii
GDDAFARRPRAGAQIPEKIQKSFDDIAKYFSKKEWEKMKSSEKIIYVYMKRKYEAMTKLGFKATLPPFMCNTGATDLQGND

SEQ ID NO: 5652 - protein, 81 aa, Pongo abelii
GDDAFARRPTVGAQIPEKMQKAFDDIAKYFSKEEWEKMKASEKIIYVYMKRNYEAMTKLGFKATLPPFMRNKRAEDFQGND

SEQ ID NO: 5653 - protein, 81 aa, Pongo abelii
GDDAFARRPTVGAQIPEKMQKAFDDIAKYFSKEEWEKDESLEKIIYVYMKRNYEAMTKLGFKATLPPFMRNKRAEDFQGND

SEQ ID NO: 5654 - protein, 81 aa, Pongo abelii
KRTKHWKMASKLILPESLSLLTFEDVAVYFSEEEWQLLNPLEKTLYNDVMQDIYETVISLGLKLKNDTGNDHPISVSTSEI

SEQ ID NO: 5655 - protein, 81 aa, Hylobates moloch
MIESQEPVTFEDVAVDFTQEEWQQLNPAQKTLHRDVMLETYNHLVSVGCSGIKPDVIFKLEHGEDPWIIESELSRWIYPDR

SEQ ID NO: 5656 - protein, 80 aa, Hylobates moloch
MIESQEPVTFEDVAVDFTQEEWQQLNPAQKTLHRDVMLETYNHLVSVGCSGIKPDVIFKLEHGEDPWIIESELSRWIYPE

SEQ ID NO: 5657 - protein, 81 aa, Hylobates moloch
MVEGEEEWQQLNPAQKTLHRDVMLETYNHLVSVGCSGIKPDVIFKLEHGEDPWIIESELSRWIYPDRVKGLESSQQIISGE

SEQ ID NO: 5658 - protein, 81 aa, Hylobates moloch
MAAGQREARPQVSLTFEDVAVLFTRDEWRKLAPSQRNLYRDVMLENYRNLVSLGLPFTKPKVISLLQQGEDPWKVEKDSSG

SEQ ID NO: 5659 - protein, 81 aa, Hylobates moloch
VLPSGSRGFRAADSRAGKQKGFFLAPFFFSDLPSGDCTVLTESQKEDMAAGQREARPQVSLTFEDVAVLFTRDEWRKLAPS

SEQ ID NO: 5660 - protein, 81 aa, Hylobates moloch
TESQKEDMAAGQREARPQVSLTFEDVAVLFTRDEWRKLAPSQRNLYRDVMLENYRNLVSLGLPFTKPKVISLLQQGEDPWK

SEQ ID NO: 5661 - protein, 81 aa, Hylobates moloch
GEDTLARRPTVGAQIPEKVQKASDDIAKYFSKKEWEKMKATEKITYVYMKRKYEVMAKLGLKPTFPPFMRNTGATDLQGND

SEQ ID NO: 5662 - protein, 81 aa, Hylobates moloch
GHTEGGELVNKLLTSWLQGLVTFEDVAVEFTQEEWALLDPAQRTLYRDVMLENFRNLASSLGNQVDKPSLISQLEQEDKVM

SEQ ID NO: 5663 - protein, 81 aa, Hylobates moloch
MAKRPEPPGSREMGLLTFRDIAIEFSLEEWQCLDCAQRNLYRDVMLENYRNLVSLGIAVSKPDLITCLEQNKESQNIKRNE

SEQ ID NO: 5664 - protein, 81 aa, Hylobates moloch
MLENYRNLVSLGLVVSKPDLITFLEQRKEPWNVKSEETVAIQPDVFSHYNKDLLTEHCTEASFQKVISRRHGNCDLENLHL

SEQ ID NO: 5665 - protein, 81 aa, Hylobates moloch
PLAAQSPEGHHGHQEPASTSFHPPRMQEEWGLLDRSQKELYWDAMLEKYGTVVSLGLPPHQPEAQAQSELGMLLTGTGVCR

SEQ ID NO: 5666 - protein, 81 aa, Hylobates moloch
GPAQHTCWPCGSAVHTLKSLVTFEDVAVYFSQEEWELLDAAQRHLYHTVMLENLELVTSLGCWHGVEGEEAHPEQNVSVEV

SEQ ID NO: 5667 - protein, 81 aa, Hylobates moloch
HTLKSLVTFEDVAVYFSQEEWELLDAAQRHLYHTVMLENLELVTSLGNALSQHDVTCFVGADLPNCFPNWLHHFTSLSAVY

SEQ ID NO: 5668 - protein, 81 aa, Hylobates moloch
MAGEAEAQLDPSLQGLVMFEDVTVYFSREEWGLLNVTQKGLYRDVMLENFALVSSLGLAPSRSPVFTQLEDDEQSWVPNWV

SEQ ID NO: 5669 - protein, 81 aa, Hylobates moloch
MAGEAEGLVMFEDVTVYFSREEWGLLNVTQKGLYRDVMLENFALVSSLGLAPSRSPVFTQLEDDEQSWVPNWVDVTPVSRA

SEQ ID NO: 5670 - protein, 81 aa, Hylobates moloch
DEWAAGVMSVGPPAARLQEPVTFRDVAVDFTQEEWGQLDPTQRILYRDVMLETFGHLLSVGPELPKPEVISQLEQGTELWV

SEQ ID NO: 5671 - protein, 81 aa, Hylobates moloch
MEARSTLVPPQASVCFEDVAMAFTQEEWEQLDLAQRTLYREVTLETWEHIVSLGLFLSKSDVISQLEQEEGLCRAEQVAPR

SEQ ID NO: 5672 - protein, 81 aa, Hylobates moloch
EWEQLDLAQRTLYREVTLETWEHIVSLGLFLSKSDVISQLEQEEGLCRAEQVAPREKGMLPGTFLGLAIEDRFSLLEGCLI

SEQ ID NO: 5673 - protein, 81 aa, Hylobates moloch
EDVAMAFTQEEWEQLDLAQRTLYREVTLETWEHIVSLGLFLSKSDVISQLEQEEGLCRAEQVAPRGARPSKEQRGYRARRI

SEQ ID NO: 5674 - protein, 81 aa, Hylobates moloch
MEARSTLVPPQASVCFEDVAMAFTQEEWEQLDLAQRTLYREVTLETWEHIVSLDWKATLEENRLNSEKDRAREEVSHHVEV

SEQ ID NO: 5675 - protein, 81 aa, Hylobates moloch
EDVAMAFTQEEWEQLDLAQRTLYREVTLETWEHIVSLGLFLSKSDVISQLEQEEGLCRAEQVAPRDGVSPLLPRLECNGTI

SEQ ID NO: 5676 - protein, 81 aa, Hylobates moloch
EEKQKEDAAICPVTVLPEEPVTFQDVAVDFSREEWGLLGPTQRTEYRDVMLETFGHLVSVGWETTLENKELAPNSDIPEEE

SEQ ID NO: 5677 - protein, 81 aa, Hylobates moloch
MASRLPTAWSCEPVIFEDVTLGFTPEEWGLLDLKQKSLYREVMLENYRNLVSVEHQLSKPDVVSQLEEAEDFWPVERGIPQ

SEQ ID NO: 5678 - protein, 81 aa, Hylobates moloch
MASRLPTAWSCEPVIFEDVTLGFTPEEWGLLDLKQKSLYREVMLENYRNLVSVEYPELQLDPKLDPLPAESPLMNIEVVEV

SEQ ID NO: 5679 - protein, 81 aa, Hylobates moloch
ARRRSVGCRCCGLCLAVRREQVTFEDVVVEFSQEEWGQLKPAQRTLYRDVMLDTFRLLVSVAHWLLKLNVISLLEQEAELQ

SEQ ID NO: 5680 - protein, 81 aa, Hylobates moloch
MTPGLRVSTDPEQVTFEDVVVEFSQEEWGQLKPAQRTLYRDVMLDTFRLLVSVAHWLLKLNVISLLEQEAELQAVDSGLPQ

SEQ ID NO: 5681 - protein, 81 aa, Hylobates moloch
GRLEEGRRATGLPAAQVQEPVTFKDVAVDFTQEEWGQLDLVQRTLYRDVMLETYGHLLSVGNQIAKPEVISLLEQGEEPWS

SEQ ID NO: 5682 - protein, 81 aa, Hylobates moloch
MAAAELTAPARGIVTFEDVAVYFSWKEWGLLDEAQKCLYHDVMLENLALTTSLGGCGAGDEEAPYQQSTSPQRVSQVRIPN

SEQ ID NO: 5683 - protein, 81 aa, Hylobates moloch
MQHGTVAFEDVAVNFSQEEWSLLSEVQRCLYHDVMLENWVLISSLGCWCRSEDEEAPSKRSISIQRVSQVSTPRAGVSPKK

SEQ ID NO: 5684 - protein, 81 aa, Hylobates moloch
HRMTWDCIAIGSHENSVHGTVAFEDVAVNFSQEEWSLLSEVQRCLYHDVMLENWVLISSLGCWCRSEDEEAPSKRSISIQR

SEQ ID NO: 5685 - protein, 81 aa, Hylobates moloch
MQGTVAFEDVAVNFSQEEWSLLSEVQRCLYHDVMLENWVLISSLGCWCRSEDEEAPSKRSISIQRVSQVSTPRAGVSPKKA

SEQ ID NO: 5686 - protein, 81 aa, Hylobates moloch
MQGTVAFEDVAVNFSQEEWSLLSEVQRCLYHDVMLENWVLISSLGCWCRSEDEEAPSKRSISIQRVSQSLRLSAQAGVARS

SEQ ID NO: 5687 - protein, 81 aa, Hylobates moloch
ASTSRVAGTTGACHHAQHGTVAFEDVAVNFSQEEWSLLSEVQRCLYHDVMLENWVLISSLGCWCRSEDEEAPSKRSISIQR

SEQ ID NO: 5688 - protein, 81 aa, Hylobates moloch
MAAAAPRHPTQGTVTFEDVAVNFSQEEWCLLSEAQRCLYRDVMLENLALISSLGCWCGSKDEEAPCKQIISVQRESQSRTP

SEQ ID NO: 5689 - protein, 81 aa, Hylobates moloch
MAAAATLRLSAQGTVTFEDVAVNFTWEEWNLLSEAQRCLYRDVTLENLALISSLGCWCGVEDEAAPSKQNIYIQRETQVRT

SEQ ID NO: 5690 - protein, 81 aa, Hylobates moloch
MAAAATLRLSAQGTVTFEDVAVNFTWEEWNLLSEAQRCLYRDVTLENLALISSLDPALDGSADNTQTGNLQSVLPSHPEQK

SEQ ID NO: 5691 - protein, 81 aa, Hylobates moloch
MAAAATLRLSAQGTVTFEDVAVNFTWEEWNLLSEAQRCLYRDVTLENLALISSLGCWCGVEDEAAPSKQNIYIQRETQFLH

SEQ ID NO: 5692 - protein, 81 aa, Hylobates moloch
MAAAATLRLSAQGTVTFEDVAVNFTWEEWNLLSEAQRCLYRDVTLENLALISSLGMKFLHVCQALDLPQVIPTSASQSAGI

SEQ ID NO: 5693 - protein, 81 aa, Hylobates moloch
MAAAATLRLSAQGTVTFEDVAVNFTWEEWNLLSEAQRCLYRDVTLENLALISSLGCWCGVEDEAAPSKQNIYIQRETQDGV

SEQ ID NO: 5694 - protein, 81 aa, Hylobates moloch
MAAAAPRPQAQQGTVTFEDVAVNFSQEEWSLLSEAQRCLYRDVMLENLALISSLGCWCGSKDEEAPWDVFHFADHQETHHK

SEQ ID NO: 5695 - protein, 81 aa, Hylobates moloch
MAAAAPRPQAQQGTVTFEDVAVNFSQEEWSLLSEAQRCLYRDVMLENLALISSLGCWCGSKDEEAPCKQIISVQRESQSRT

SEQ ID NO: 5696 - protein, 81 aa, Hylobates moloch
MAAAAPRPQAQGTVTFEDVAVNFSQEEWSLLSEAQRCLYRDVMLENLALISSLGCWCGSKDEEAPWDVFHFADHQETHHKQ

SEQ ID NO: 5697 - protein, 81 aa, Hylobates moloch
MAAAAPRPQAQGTVTFEDVAVNFSQEEWSLLSEAQRCLYRDVMLENLALISSLGCWCGSKDEEAPCKQIISVQRESQSRTP

SEQ ID NO: 5698 - protein, 81 aa, Hylobates moloch
MAAAAPRCPAQGTVTFEDVAVNFTQEEWNLLSEAQRCLYRDVTLENLALMSSLGCWCGVEDEAAPSKQNIYIQRETQVRTP

SEQ ID NO: 5699 - protein, 81 aa, Hylobates moloch
MAAAAALRAHAQSSVTFEDVAVNFSLEEWSLNEAGCLYHDVMLQTLTLISSLGGVTPHTLFPTGACGPQVPSSRIRPSPGH

SEQ ID NO: 5700 - protein, 81 aa, Hylobates moloch
MAAAAALRAHAQSSVTFEDVAVNFSMEEWSLLNEAQRCLYRDVMLETLTLISSLGCWHGGEDEAAPSKQSTCIYIYKEQGG

SEQ ID NO: 5701 - protein, 81 aa, Hylobates moloch
MAAAALRFPVQGTVTFEDVAVNFTQEEWNLLSEAQRCLYRDVMLENLALISSLSCWCGVEDEAAPSKRSIYIQRETQVRTP

SEQ ID NO: 5702 - protein, 81 aa, Hylobates moloch
MAAAALRPPAQGTVTFEDVAVNFSQEEWSLLSEAQRCLYHDVMLENLTLISSLGCWYGAKDETPSKQTLSIQQESPLRTRQ

SEQ ID NO: 5703 - protein, 81 aa, Hylobates moloch
MAAVALRDSARGTVTFEDVAVNFSQEEWSLLSEAQRCLYHDVMLENLTLISSLGCWYGAKDETPSKQTLSIQQESPLRTRQ

SEQ ID NO: 5704 - protein, 81 aa, Hylobates moloch
PAAVRTHGPMAELTDSARGCVVFEDVFVYFSWEEWELLDDAQRLLYHDVMLENFALLASLGIAFSRSRAVMKLEQGEEPWV

SEQ ID NO: 5705 - protein, 81 aa, Hylobates moloch
SPPSPRSSMAAVALRDSARGMTFEDVAIYFSQEEWELLDESQRFLYCDVMLENFAHVTSLGYCHGAENEAIASEQSVSIQV

SEQ ID NO: 5706 - protein, 81 aa, Hylobates moloch
MTFEDVAIYFSQEEWELLDESQRFLYCDVMLENFAHVTSLGYCHGAENEAIASEQSVSIQVRTSKGNTPTQKTHLSEIKMG

SEQ ID NO: 5707 - protein, 81 aa, Hylobates moloch
RDPAPVPIATEVLFKLTGSVTFEDVAVYFSWEEWDLLDESQKHLYFDVMLENFALTSSLGCWRGVEHEETPSEQRISVERV

SEQ ID NO: 5708 - protein, 81 aa, Hylobates moloch
VQLRPQTRMATALRDPAPGSVTFEDVAVYFSWEEWDLLDESQKHLYFDVMLENFALTSSLGCWRGVEHEETPSEQRISVER

SEQ ID NO: 5709 - protein, 81 aa, Hylobates moloch
VQLRPQTRMATALRDPAPGSVTFEDVAVYFSWEEWDLLDESQKHLYFDVMLENFALTSSLGLTSSWCHVVAQLGLGEVPSV

SEQ ID NO: 5710 - protein, 81 aa, Hylobates moloch
MATALRDPAPGSVTFEDVAVYFSWEEWDLLDESQKHLYFDVMLENFALTSSLGCWRGVEHEETPSEQRISVERVPQFRTSK

SEQ ID NO: 5711 - protein, 81 aa, Hylobates moloch
RDPAPVPIATEVLFKLTGSVTFEDVAVYFSWEEWDLLDESQKHLYFDVMLENFALTSSLGLTSSWCHVVAQLGLGEVPSVL

SEQ ID NO: 5712 - protein, 81 aa, Hylobates moloch
MAAALRALTQQGFVAFEDVAIYFSQEEWELLDEMQRLLYRDVMLENFAVMASLGCWCGAEDEGAPSAESVSVEELSQGRTP

SEQ ID NO: 5713 - protein, 81 aa, Hylobates moloch
RAPTQVTVSPETHMDLTKGCVNFEDIAIYFSQDEWGLLDEAQRLLYLEVMLENFALVASLGCGHGTEDEETPSDQNVSVGV

SEQ ID NO: 5714 - protein, 81 aa, Hylobates moloch
MAAAALRAPTQGCVNFEDIAIYFSQDEWGLLDEAQRLLYLEVMLENFALVASLGCGHGTEDEETPSDQNVSVGVSQSKAGS

SEQ ID NO: 5715 - protein, 81 aa, Hylobates moloch
MAAAALRAPTQVTVSPETHMDLTKDEWGLLDEAQRLLYLEVMLENFALVASLGCGHGTEDEETPSDQNVSVGVSQSKAGSS

SEQ ID NO: 5716 - protein, 81 aa, Hylobates moloch
MDLTKGCVNFEDIAIYFSQDEWGLLDEAQRLLYLEVMLENFALVASLGCGHGTEDEETPSDQNVSVGVSQSKAGSSTQKTQ

SEQ ID NO: 5717 - protein, 81 aa, Hylobates moloch
MAETKDAAQMVTFKDVAVTFTREEWRQLDLAQRTLYREVMLETCGLLVSLGHQVPKPELVHLLEHGQELWTVKRGLSHPTC

SEQ ID NO: 5718 - protein, 81 aa, Hylobates moloch
MVTFKDVAVTFTREEWRQLDLAQRTLYREVMLETCGLLVSLGHQVPKPELVHLLEHGQELWTVKRGLSHPTCAGDRAQVHT

SEQ ID NO: 5719 - protein, 81 aa, Hylobates moloch
LVNTPQIPVVAEEFVKPSQGHVTFEDIAVYFSQEEWGLLDEAQRCLYHDVMLENFSLMASVAGLSQSNHKDSCLQQKVPVS

SEQ ID NO: 5720 - protein, 81 aa, Hylobates moloch
MAAAALVNTPQGHVTFEDIAVYFSQEEWGLLDEAQRCLYHDVMLENFSLMASVGCLHGIEAEEAPSEQTVSAQGASQARTP

SEQ ID NO: 5721 - protein, 81 aa, Hylobates moloch
VNTPQIPVVAEEFVKPSQGHVTFEDIAVYFSQEEWGLLDEAQRCLYHDVMLENFSLMASVGCLHGIEAEEAPSEQTVSAQG

SEQ ID NO: 5722 - protein, 81 aa, Hylobates moloch
MAAAALRDPAQQGYVTFEDVAVYFSQEEWRLLDEAQKLLYRNVMLENFSLLASLGLASSKTHEITQLESWEEPFMPAWEVV

SEQ ID NO: 5723 - protein, 81 aa, Hylobates moloch
MAAAALRDPAQGYVTFEDVAVYFSQEEWRLLDEAQKLLYRNVMLENFSLLASLGLASSKTHEITQLESWEEPFMPAWEVVT

SEQ ID NO: 5724 - protein, 81 aa, Hylobates moloch
MAAAALRDPAQGYVTFEDVAVYFSQEEWRLLDEAQKLLYRNVMLENFSLLASLGLASSKTHEITQLESWEEPFMPAWEAVT

SEQ ID NO: 5725 - protein, 81 aa, Hylobates moloch
RDPAQVPVTAELLTDHEDGYVTFEDVAVYFSQEEWRLLDEAQKLLYRNVMLENFSLLASLGLASSKTHEITQLESWEEPFM

SEQ ID NO: 5726 - protein, 81 aa, Hylobates moloch
MAAAALRDPAQGYVTFEDVAVYFSQEEWRLLDEAQKLLYRNVMLENFSLLASLGCWHGAEAEEAPEQSASVGLLSSNIQQH

SEQ ID NO: 5727 - protein, 81 aa, Hylobates moloch
MAAAALRDPAQQGYVTFEDVAVYFSQEEWRLLDEAQKLLYRNVMLENFSLLASLGLASSKTHEITQLESWEEPFMPAWEAV

SEQ ID NO: 5728 - protein, 81 aa, Hylobates moloch
RDPAQVPVTAELLTDHEQGYVTFEDVAVYFSQEEWRLLDEAQKLLYRNVMLENFSLLASLGLASSKTHEITQLESWEEPFM

SEQ ID NO: 5729 - protein, 81 aa, Hylobates moloch
LRDPAQVPVTAELLTDHEGYVTFEDVAVYFSQEEWRLLDEAQKLLYRNVMLENFSLLASLGCWHGAEAEEAPEQSASVGLL

SEQ ID NO: 5730 - protein, 81 aa, Hylobates moloch
MAAAALRDPAQQGYVTFEDVAVYFSQEEWRLLDEAQKLLYRNVMLENFSLLASLGCWHGAEAEEAPEQSASVGLLSSNIQQ

SEQ ID NO: 5731 - protein, 81 aa, Hylobates moloch
MAAAALRDPAQGYVTFEDVAVYFSQEEWRLLDEAQKLLYRNVMLENFSLLASLGKVLTPHPSILSWARLFFLLLGRCLFFP

SEQ ID NO: 5732 - protein, 81 aa, Hylobates moloch
MGPAQVPMNSEVIVDPIQGQVNFEDVFVYFSQEEWVLLDEAQRLLYRDVMLENFALMASLGHASFMSHIVASLVMGSEPWV

SEQ ID NO: 5733 - protein, 81 aa, Hylobates moloch
MNSEVIVDPIQGQVNFEDVFVYFSQEEWVLLDEAQRLLYRDVMLENFALMASLGHASFMSHIVASLVMGSEPWVPDWVDMT

SEQ ID NO: 5734 - protein, 81 aa, Hylobates moloch
MAAAEPMGPAQVPMNSEVIVDPIQGQVNFEDVFVYFSQEEWVLLDEAQRLLYRDVMLENFALMASLERQAMSTRTVLRHPT

SEQ ID NO: 5735 - protein, 81 aa, Hylobates moloch
AAAEPMGPAQVPMNSEVIVDPIQGQVNFEDVFVYFSQEEWVLLDEAQRLLYRDVMLENFALMASLERQAMSTRTVLRHPTG

SEQ ID NO: 5736 - protein, 81 aa, Hylobates moloch
MNLTEDCMVFEDVAIYFSQEEWEILNDAQRHLHSNVMLENLALLSSVGCWHGAKDEEVPSKQCVSVRVLQVTTPKPALSTL

SEQ ID NO: 5737 - protein, 81 aa, Hylobates moloch
MNLTESQGAALQDCMVFEDVAIYFSQEEWEILNDAQRHLHSNVMLENLALLSSVGCWHGAKDEEVPSKQCVSVRVLQVTTP

SEQ ID NO: 5738 - protein, 81 aa, Hylobates moloch
MLMDAGQDCMVFEDVAIHFSQEEWGILNDVQRHLHSDVMLENFALLSSVGCWHGAKDEEAPSKQCVSVGVSQVTTLKPALS

SEQ ID NO: 5739 - protein, 81 aa, Hylobates moloch
MNLTEDCMVFEDVAIHFSQEEWGILNDVQRHLHSDVMLENFALLSSVGCWHGAKDEEAPSKQCVSVGVSQVTTLKPALSTQ

SEQ ID NO: 5740 - protein, 81 aa, Hylobates moloch
MNLTEGPVMAEMDPTQDCMVFEDVAIHFSQEEWGILNDVQRHLHSDVMLENFALLSSVGCWHGAKDEEAPSKQCVSVGVSQ

SEQ ID NO: 5741 - protein, 81 aa, Hylobates moloch
MNLTEGPVMAEMDPTQGRVVFEDVAIYFSQEEWGHLDEAQRLLYRDVMLENLALLSSLGFIAVAAMLMDAGQDCMVFEDVA

SEQ ID NO: 5742 - protein, 81 aa, Hylobates moloch
AIYFSQEEWGHLDEAQRLLYRDVMLENLALLSSLGFIAVAAMLMDAGQDCMVFEDVAIHFSQEEWGILNDVQRHLHSDVML

SEQ ID NO: 5743 - protein, 81 aa, Hylobates moloch
QAGGHKGSPVMAEMDPTQGRVVFEDVAIYFSQEEWGHLDEAQRLLYRDVMLENLALLSSLGSWHGAEDEEAPSQQGFSVGV

SEQ ID NO: 5744 - protein, 81 aa, Hylobates moloch
LDFGHDDSQMSQDGYVTQAGGHKGSPVMAEMDPTQGRVVFEDVAIYFSQEEWGHLDEAQRLLYRDVMLENLALLSSLAFLF

SEQ ID NO: 5745 - protein, 81 aa, Hylobates moloch
LLYRDVMLENLALLSSLGSWHGAEDEEAPSQQGFSVGVSEVTTSKPCLSSQKVHPSETCGPTFKDILCLVEHDGIHPEQDI

SEQ ID NO: 5746 - protein, 81 aa, Hylobates moloch
QAGGHKGSPVMAEMDPTQGRVVFEDVAIYFSQEEWGHLDEAQRLLYRDVMLENLALLSSLGKALTLAQYPGLGCVTPFYPK

SEQ ID NO: 5747 - protein, 81 aa, Hylobates moloch
MAEMNPAQGRVVFEDVAIYFSQEEWGHLDEDQRLLYRDVMLENLALLSSLGSWHGAEDEEAPSQQGFSVGVSEVTTSKPCL

SEQ ID NO: 5748 - protein, 81 aa, Hylobates moloch
QEEWGHLDEDQRLLYRDVMLENLALLSSLGSWHGAEDEEAPSQQGFSVGVSEVTTSKPCLSSQKVHPSETCGPTFKDILCL

SEQ ID NO: 5749 - protein, 81 aa, Hylobates moloch
MAEMNPAQGRVVFEDVAIYFSQEEWGHLDEDQRLLYRDVMLENLALLSSLGCCHGAEDEEAPLEPGVSVGVSQVMAPKPCL

SEQ ID NO: 5750 - protein, 81 aa, Hylobates moloch
MYSSFPIWQGRVVFEDVAIYFSQEEWGHLDEDQRLLYRDVMLENLALLSSLGCCHGAEDEEAPLEPGVSVGVSQVMAPKPC

SEQ ID NO: 5751 - protein, 81 aa, Hylobates moloch
VSVGVSQVMAPKPCLSTWKTQPCETCSSLLKDILRLAEHDGTHPEQGLYTCPAHLHQHQKEQIREKLSRADGGRPTFVKNH

SEQ ID NO: 5752 - protein, 81 aa, Hylobates moloch
MAAAVLMDRVQSCVTFEDVFVYFSREEWELLEEAQRFLYRDVMLENFALVATLAFIFPVPCSCAVGGGRPWVPDRADITAA

SEQ ID NO: 5753 - protein, 81 aa, Hylobates moloch
MADSAQVSVTFEDVAVTFTQEEWGQLDAAQRTLYQEVMLETCGLLVSLGCPLFKPELIYQLDHRQELWMVIKDLSQSSYPG

SEQ ID NO: 5754 - protein, 81 aa, Hylobates moloch
MADSAQVSVTFEDVAVTFTQEEWGQLDAAQRTLYQEVMLETCGLLVSLGDNTKPKTTEPTFSHLALPEEVLLQERLTQGAS

SEQ ID NO: 5755 - protein, 81 aa, Hylobates moloch
MAMALTDPVQVSVTFDDVAVTFTQEEWGQLDLAQRTLYQEVMLENCGLLVSLGCPVPRPELIYHLEHGQEPWTRKEDLSQG

SEQ ID NO: 5756 - protein, 81 aa, Hylobates moloch
MAAAVLTDRAQVSVTFDDVAVTFTKEEWGQLDLAQRTLYQEVMQENCGLLVSLGCPVPRPELIYHLEHGQEPWTRKEDLSQ

SEQ ID NO: 5757 - protein, 81 aa, Hylobates moloch
MAAAVLTDRAQVSVTFDDVAVTFTKEEWGQLDLAQRTLYQEVMQENCGLLVSLGDKGKPKTTEPTTCESALSEGISLQGQV

SEQ ID NO: 5758 - protein, 81 aa, Hylobates moloch
MAAAVLTDRAQVSVTFDDVAVTFTKEEWGQLDLAQRTLYQEVMQENCGLLVSLAPSQTHPGSIRCILQSNQVDTLIKIPEH

SEQ ID NO: 5759 - protein, 81 aa, Hylobates moloch
MNNSQGRVTFKDVTVNFTHGEWQRLNPKQRNLYRDVMLENYSNLVSVGREETTKPDVILRLEQGKEPWSVEEEVLGSGRPE

SEQ ID NO: 5760 - protein, 81 aa, Hylobates moloch
AGSQFLDFKHLGTFLVFEELVTFEDVFVDFSPEELSSLSAAQRNLYRKVMLENYRNLVCLGYQFSKPDIISRLEEEESRAM

SEQ ID NO: 5761 - protein, 81 aa, Hylobates moloch
NKQPEAVGTGIEPKAMSQGLVTFGDVAIDFSQEEWEWLNPIQRNLYRKVMLENYRNLASLGLCVSKPDVISSLEQGKEPWT

SEQ ID NO: 5762 - protein, 81 aa, Hylobates moloch
LEYALLGEHWDYDALFETQPGLVTIKNLAVDFPQQLHPAQKNFCKNGIWENYSDLGSAGHCVAKPDLVSLLEQEKEPWMVK

SEQ ID NO: 5763 - protein, 81 aa, Hylobates moloch
MNVEVVKVIPQDLVTFKDVAIDFSQEEWQWMNPAQKRLYRSMMLENYQSLVSLGLCISKPYVISLLEQGREPWEMTSEMTR

SEQ ID NO: 5764 - protein, 81 aa, Hylobates moloch
ITHKEILPEVQNKEYNKSWQTFHQDTIFDIQQNFPTKEKAHKHEPQKKSYRKKSVEMKHRKVYVEKKLLKCNDCEKVFNQS

SEQ ID NO: 5765 - protein, 81 aa, Hylobates moloch
MSLGSELFRDVAIVFSQEEWQWLAPAQRDLYRDVMLETYSNLVSLGLAISKPDVISFLEQGKEPWMVERVVSRGLCPVLES

SEQ ID NO: 5766 - protein, 81 aa, Hylobates moloch
DTKELSPKQHVYEVESPQWEIMESLTSYGLECSSFQDDWECRNQFDRQQGNPDGHFHQMIIRHEEMPTFDQHASLTFYQKI

SEQ ID NO: 5767 - protein, 81 aa, Hylobates moloch
MALSQGLLTFRDVAIEFSQEEWKCLDPAQRTLYRDVMLENYRNLASLDISSKCTMKEVLSTAQGNREVFHAGTLQRHESHH

SEQ ID NO: 5768 - protein, 81 aa, Hylobates moloch
MALPQGLLTFRDVAIEFSQEEWKCLDPAQRTLYRDVMLENYRNLVSLDISSKCMVKEFLSAAQGKREEFHTGTLERHESHH

SEQ ID NO: 5769 - protein, 81 aa, Hylobates moloch
MALSQSLLTFRDVAIEFSQEEWKCLDPAQRTLYRDVMLENYRNLVSLGISSKCTLKEFSSTAQGNREVIHTGTLERHESHH

SEQ ID NO: 5770 - protein, 81 aa, Hylobates moloch
MALPQGLLTFRDVAIEFSQEEWKCLDPAQRTLYRDVMLENYRNLASLDISSKCTMKEVLSTAQGNREVFHAGTLQRHESHH

SEQ ID NO: 5771 - protein, 81 aa, Hylobates moloch
MALPQGLLTFRDVAIEFSQEEWKCLDPAQRTLYRDVMLENYRNLVSLDISSKCTLKEVSSTAQGNTEVIHTGTLQRHERHH

SEQ ID NO: 5772 - protein, 81 aa, Hylobates moloch
SWTSAWTLAGLAMETAGSEGRLTFRDVAIEFSLAEWKCLNPAQRALYREVMLENYRNLEAVVMTLLSVMDGFLETLLWSAF

SEQ ID NO: 5773 - protein, 81 aa, Hylobates moloch
MALSQGLFTFKDVAVEFSQEEWECLDPAQRALYRDVMLENYRNLLSLDEDNIPPENDISVGFTSKGLSPKENNKEELYHLV

SEQ ID NO: 5774 - protein, 81 aa, Hylobates moloch
MPLQGSVSFKDVTVDFTQEEWQQLDPAQKALYRDVMLENYCHFVSVGFHMTKPDMIRKLEQGEELWTQRIFPSYSYLEADG

SEQ ID NO: 5775 - protein, 81 aa, Hylobates moloch
FHMTKPDMIRKLEQGEELWTQRIFPSYSYLEADGKTEDVLVKFKEYQDRHSRPLIFINHKKLIKERSNIYGKTLTLGKNHI

SEQ ID NO: 5776 - protein, 81 aa, Hylobates moloch
MSQGSVSFKDVTVDFTQEEWQQLDPAQKALYRDVMLENYCHFVSVGFHMTKPDMIRKLEQGEELWTQRIFPSYSYLEADGK

SEQ ID NO: 5777 - protein, 81 aa, Hylobates moloch
MPLQGSVSFKDVTVDFTQEEWQQLDPAQKALYRDVMLENYCHFVSVGFHMTKPDMIRKLEQGEELWTQRIFPSYSYLADGK

SEQ ID NO: 5778 - protein, 81 aa, Hylobates moloch
GFHMTKPDMIRKLEQGEELWTQRIFPSYSYLADGKTEDVLVKFKEYQDRHSRPLIFINHKKLIKERSNIYGKTLTLGKNHI

SEQ ID NO: 5779 - protein, 81 aa, Hylobates moloch
MMENYSNLLSLDLESRNETKHLSIGKDIIKNTGSQCEVMENSKLHGLESSILKNDWQSKSKIEVQGPEVGYFSQMKIISEN

SEQ ID NO: 5780 - protein, 81 aa, Hylobates moloch
MPEVEFPDQFFTILTMDHELVTLRDVVINFSQEEWEYLDSAQRNLYWDVMMENYSNLLSLDLESRNETKHLSIGKDIIKNT

SEQ ID NO: 5781 - protein, 81 aa, Hylobates moloch
MALRSVMFSDVSIDFSPEEWEYLDLEQKDLYRDVMLENYSNLVSLGCFISKPDVISLLEQGKEPWKVVRKGRRQYPDLETR

SEQ ID NO: 5782 - protein, 81 aa, Hylobates moloch
MAHGSVTFRDVAIDFSQEEWEFLDPAQRDLYRDVMWENYSNFISLGPSISKPDLITLLDEEGKEPGMVVREGTRRYCPDLE

SEQ ID NO: 5783 - protein, 81 aa, Hylobates moloch
MAHGSVTFRDVAIDFSQEEWEFLDPAQRDLYRDVMWENYSNFISLAGPSISKPDLITLLDEEGKEPGMVVREGTRRYCPGE

SEQ ID NO: 5784 - protein, 81 aa, Hylobates moloch
EESREIRAGQIVLKAMAQGLVTFRDVAIEFSLEEWKCLEPAQRDLYREVTLENFGHLASLGLSISKPDVVCLLEQGKEPWM

SEQ ID NO: 5785 - protein, 81 aa, Hylobates moloch
MAQGLVTFRDVAIEFSLEEWKCLEPAQRDLYREVTLENFGHLASLGLSISKPDVVCLLEQGKEPWMIANDVTGPWCPDLES

SEQ ID NO: 5786 - protein, 81 aa, Hylobates moloch
MAAAALRDPSQSCVTFEDVTIYFSQEEWVLLDEAQRLLYCDVMLENFALIASLGLISFRSHIVSQLEMGKEPWVPDSVDMT

SEQ ID NO: 5787 - protein, 81 aa, Hylobates moloch
MAAAALRDPSQEEWVLLDEAQRLLYCDVMLENFALIASLGLISFRSHIVSQLEMGKEPWVPDSVDMTSAMARGAYGRPGSD

SEQ ID NO: 5788 - protein, 81 aa, Hylobates moloch
MAHKYVGLQFQGSVTFEDVAIAFSQQEWERLDSSQRGLYRDVMLENYRNLVSMAGHSLSKPHVIALLEQWKEPEVTVRKDG

SEQ ID NO: 5789 - protein, 81 aa, Hylobates moloch
MAHKYVGLQFQGSVTFEDVAIAFSQQEWERLDSSQRGLYRDVMLENYRNLVSMGHSLSKPHVIALLEQWKEPEVTVRKDGR

SEQ ID NO: 5790 - protein, 81 aa, Hylobates moloch
MPQVTFNDVAIDFSHEEWGWLNSAQRDLYKDVMVQNYENLVSVAGLSVTKPYVITLLEDGKEPWIMEKKLSKGMIPDWESR

SEQ ID NO: 5791 - protein, 81 aa, Hylobates moloch
MPQVTFNDVAIDFSHEEWGWLNSAQRDLYKDVMVQNYENLVSVGLSVTKPYVITLLEDGKEPWIMEKKLSKGMIPDWESRW

SEQ ID NO: 5792 - protein, 81 aa, Hylobates moloch
MPQVTFNDVAIDFSHEEWGWLNSAQRDLYKDVMVQNYENLVSVAGLSVTKPYVITLLEDGKEPWIMEKKLSKDWESRWENK

SEQ ID NO: 5793 - protein, 81 aa, Hylobates moloch
MSQVTFSDVAIDFSHEEWACLDSAQRDLYKDVMVQNYENLVSVAGLSITKPYVIMLLEDGKEPWTVEKKLSKVYPFPLSHS

SEQ ID NO: 5794 - protein, 81 aa, Hylobates moloch
MSQVTFSDVAIDFSHEEWACLDSAQRDLYKDVMVQNYENLVSVGLSITKPYVIMLLEDGKEPWTVEKKLSKDWESRWENKE

SEQ ID NO: 5795 - protein, 81 aa, Hylobates moloch
MSQVTFSDVAIDFSHEEWACLDSAQRDLYKDVMVQNYENLVSVGLSITKPYVIMLLEDGKEPWTVEKKLSKVYPFPLSHSV

SEQ ID NO: 5796 - protein, 81 aa, Hylobates moloch
MSQVTFSDVAIDFSHEEWACLDSAQRDLYKDVMVQNYENLVSVAGLSITKPYVIMLLEDGKEPWTVEKKLSKDWESRWENK

SEQ ID NO: 5797 - protein, 81 aa, Hylobates moloch
NEELVGNHGMEGEACTEGDVTFSDVAIDFSHEEWACLDSAQRDLYKDVMVQNYENLVSVGLSITKPYVIMLLEDGKEPWTV

SEQ ID NO: 5798 - protein, 81 aa, Hylobates moloch
MSQVTFSDVAIDFSHEEWACLDSAQRDLYKDVMVQNYENLVSVGLSITKPYVIMLLEDGKEPWTVEKKLSKGMIPDWESRW

SEQ ID NO: 5799 - protein, 81 aa, Hylobates moloch
MSQVTFSDVAIDFSHEEWACLDSAQRDLYKDVMVQNYENLVSVAGLSITKPYVIMLLEDGKEPWTVEKKLSKGMIPDWESR

SEQ ID NO: 5800 - protein, 81 aa, Hylobates moloch
MLENYRNLAFLGIAVSKPDLITCLEQGKKPWNMKRHEMVDEPPGICPHFAQDLWPEQGMEDSFQKAILRRYEKYGHENLQL

SEQ ID NO: 5801 - protein, 81 aa, Hylobates moloch
IPGPPRSLEMELLTFRDVAIEFSLEEWQHLDVAQQNLYRNVMLENYRNLAFLGIAVSKPDLITCLEQGKKPWNMKRHEMVD

SEQ ID NO: 5802 - protein, 81 aa, Hylobates moloch
MGLLTFRDVAIEFSLEEWQCLDTAQKNLYRNVMLENYRNLAFLGIAVSKPDLIICLEKEKEPWNMKRHEMVDEPPGLAVSN

SEQ ID NO: 5803 - protein, 81 aa, Hylobates moloch
MGLLTFRDVAIEFSLEEWQCLDTAQKNLYRNVMLENYRNLAFLGIAVSKPDLIICLEKEKEPWNMKRHEMVDEPPDGVSLC

SEQ ID NO: 5804 - protein, 81 aa, Hylobates moloch
MGLLTFRDVAIEFSLEEWQCLDTAQKNLYRNVMLENYRNLAFLGIAVSKPDLIICLEKEKEPWNMKRHEMVDEPPVGQTGL

SEQ ID NO: 5805 - protein, 81 aa, Hylobates moloch
MEPLKFRDVAIEFSLEEWQCLDSIQQNLYRNVMLENYRNLVFLGIAASKPDLIICLEQEKEPWSRKRRRMVAELPVICSHF

SEQ ID NO: 5806 - protein, 81 aa, Hylobates moloch
MGLLTFRDVAIEFSLEEWQCLDTAQRNLYKNVILENYRNLVFLGIAVSKQDLITCLKQEKEPLTMKRHEMVDEPPVMCSHF

SEQ ID NO: 5807 - protein, 81 aa, Hylobates moloch
MGLLTFRDVAIEFSLEEWQCLDTAQRNLYKNVILENYRNLVFLGIAVSKQDLITCLKQEKEPLTMKRHEMVDEPPGSVGQT

SEQ ID NO: 5808 - protein, 81 aa, Hylobates moloch
MGLLTFRDVAIEFSLEEWQCLDTAQRNLYKNVILENYRNLVFLGIAVSKQDLITCLKQEKEPLTMKRHEMVDEPPESCSVA

SEQ ID NO: 5809 - protein, 81 aa, Hylobates moloch
MGLLTFRDVAIEFSLEEWQCLDTAQRNLYKNVILENYRNLVFLGIAVSKQDLITCLKQEKEPLTMKRHEMVDEPPALDKNP

SEQ ID NO: 5810 - protein, 81 aa, Hylobates moloch
MGLLTFRDVAIEFSLEEWQCLDTAQQNLYRNVMLENYRNLAFLGIAVSKPDLITCLEQGKEPWNMKRHEMVDEPPGVCPHF

SEQ ID NO: 5811 - protein, 81 aa, Hylobates moloch
TPRTPGSLEMGLLTFRDVAIEFSLEEWQCLDTAQQNLYRNVMLENYRNLAFLGIAVSKPDLITCLEQGKEPWNMKRHEMVD

SEQ ID NO: 5812 - protein, 81 aa, Hylobates moloch
MDVAIEFSVEEWQCLDTAQQNLYRNVMLENYRNLVFLGIAISKPDLITCLEQGKEPWNMERHEMVAKPPGMCCYFAQDLWP

SEQ ID NO: 5813 - protein, 81 aa, Hylobates moloch
MGPLTFMDVAIEFSVEEWQCLDTAQQNLYRNVMLENYRNLVFLGIAISKPDLITCLEQGKEPWNMERHEMVAKPPGMCCYF

SEQ ID NO: 5814 - protein, 81 aa, Hylobates moloch
MGALTFRDVAIEFSLEEWQCLDTEQQNLYRNVMLDNYRNLVFLGIAVSKPDLITCLEQEKEPWNVKTHDMVAEPPVICSHI

SEQ ID NO: 5815 - protein, 81 aa, Hylobates moloch
MGPLTFMDVAIKFSLEEWQFLDTAQQNLYRDVMLENYSNLVFLGVDVSKPDLITCLEQGKEPWNMKRHKMVAKPPVVCSHF

SEQ ID NO: 5816 - protein, 81 aa, Hylobates moloch
RTPGPPGSLEMGSLTFRDVTIEFSLEEWQCLDTAQQNLYRDVMLENYRNLVFLGIAVSKLHLITCLKQGKEPWNMKRHEMA

SEQ ID NO: 5817 - protein, 81 aa, Hylobates moloch
SEKCTRLSLYDLKIALKNGSLTFRDVTIEFSLEEWQCLDTAQQNLYRDVMLENYRNLVFLGIAVSKLHLITCLKQGKEPWN

SEQ ID NO: 5818 - protein, 81 aa, Hylobates moloch
MSGPPGSLEMEPLQFRDVAVEFSLEEWHCLDTAQQNLYRDVMLENYRHLVFLGIVVSKPDLITCLEQGKKPLTMKRHEMIA

SEQ ID NO: 5819 - protein, 81 aa, Hylobates moloch
MELLTFRDVTIEFSLEEWEFLKPAQQNLYRKVMLENYRNLVSLGLTVSKPELISCLEQRQEPWNVKRHETIAKPPGYITAL

SEQ ID NO: 5820 - protein, 81 aa, Hylobates moloch
MLENYRNLVSLGLTVSKPELISCLEQRQEPWNVKRHETIAKPPAISSHYPEDFLPEQGMKDSFQKVILRRYGSCGLEDLHL

SEQ ID NO: 5821 - protein, 81 aa, Hylobates moloch
MGPLQFRDVAIEFSLEEWHCLDTAQRNLYRNVMLENYSNLVFLGIVVSKPDLITRLEQGKKPLTMKRHEMVANPSGTCLLL

SEQ ID NO: 5822 - protein, 81 aa, Hylobates moloch
MGPLQFRDVAIEFSLEEWHCLDTAQRNLYRNVMLENYSNLVFLGIVVSKPDLITRLEQGKKPLTMKRHEMVANPSGPGVFV

SEQ ID NO: 5823 - protein, 81 aa, Hylobates moloch
MEPLQFRDVAIEFSLEEWHCLDTAQRNLYRDVMLENYRHLIFLGIVVSKPDLITSLEYGKKPLTMRRHEMIAKPPDLWPER

SEQ ID NO: 5824 - protein, 81 aa, Hylobates moloch
MGPLQFRDVAIEFSLEEWHCLDTAQRDLYRDVMLENYRHLVFLGIVVSKPDLITCLEQGKKPLTMKRHEMIAKPPVMCSHF

SEQ ID NO: 5825 - protein, 81 aa, Hylobates moloch
LRRYEKCRHDNLHLKKGCESVDECPVHKRSYNGLKQCLTTTQRKIFQCDEYVKFLHKFSNSNKHKIRDTGKRPFKCIEYGK

SEQ ID NO: 5826 - protein, 81 aa, Hylobates moloch
MGPLQFRDVAIEFSLEEWHCLDTAQRDLYRDVMLENYRHLVFLGIVVSKPDLITCLEQGKKPLTMKRHEMIAKPPETGFHR

SEQ ID NO: 5827 - protein, 81 aa, Hylobates moloch
SENEFQRRRRKKKIAFLQGPLQFRDVAIEFSLEEWHCLDTAQRDLYRDVMLENYRHLVFLGIVVSKPDLITCLEQGKKPLT

SEQ ID NO: 5828 - protein, 81 aa, Hylobates moloch
GPLQFRDVAIEFSLEEWHCLDTAQRDLYRDVMLENYRHLVFLGIVVSKPDLITCLEQGKKPLTMKRHEMIAKPPGQAQWLM

SEQ ID NO: 5829 - protein, 81 aa, Hylobates moloch
GPLQFRDVAIEFSLEEWHCLDTAQRDLYRDVMLENYRHLVFLGIVVSKPDLITCLEQGKKPLTMKRHEMIAKPPDGVSLFH

SEQ ID NO: 5830 - protein, 81 aa, Hylobates moloch
GPLQFRDVAIEFSLEEWHCLDTAQRDLYRDVMLENYRHLVFLGIVVSKPDLITCLEQGKKPLTMKRHEMIAKPPVMCSHFA

SEQ ID NO: 5831 - protein, 81 aa, Hylobates moloch
MDSVAFEDVAVNFTQEEWALLSPSQKNLYRDVMLETFRNLASVGIQWKDQNIENLYQNLGIKLRSLVERLCGPQEGSEHRE

SEQ ID NO: 5832 - protein, 81 aa, Hylobates moloch
MESVTFEDVAVEFIQEWALLDSARRSLCRYRMLDQCRTLASRGTPPCKPSCTSQLGPTAEPRATERGIFHATGVAWESQLK

SEQ ID NO: 5833 - protein, 81 aa, Hylobates moloch
EDKMEEEAMAPGLPTTCSQEPVTFADVAVVFTPEEWVFLDSTQRSLYRDVMLENYRNLASVADQPCKPSALSYLEERGEQW

SEQ ID NO: 5834 - protein, 81 aa, Hylobates moloch
MESVTFEDVAVEFIQEWALLDSARRSLCRYRMLDQCRTLASRGTGAVPEDAAGTLHRREGDTIDSRGPASSPGAALVSGMH

SEQ ID NO: 5835 - protein, 81 aa, Hylobates moloch
VLQMQNSEHHGQSIKTQTDSISLEDVAVNFTLEEWALLDPGQRNIYRDVMRATFKNLACIGEKWKDQDIEDDYKNQGRNLR

SEQ ID NO: 5836 - protein, 81 aa, Hylobates moloch
MDSISLEDVAVNFTLEEWALLDPGQRNIYRDVMRATFKNLACIGEKWKDQDIEDDYKNQGRNLRSPMVEALCENKEDRPCG

SEQ ID NO: 5837 - protein, 81 aa, Hylobates moloch
MDSVAFEDVSVSFSQEEWALLAPSQKKLYRDVMQETFKNLASIGEKWEDPSVEDQHKNQGRNLRSHMGERLCEGKEGSQCA

SEQ ID NO: 5838 - protein, 81 aa, Hylobates moloch
MDSVASEDVAVNFTLEEWALLDPSQKKLYRDVMRETFRNLACVGKKWEDQSIEDWYKNQGRILSNHMEEGLSESKEYDQCG

SEQ ID NO: 5839 - protein, 81 aa, Hylobates moloch
SDQRRRSKEARTPGSRDVDSVVFEDVAVNFTQEEWALLGPSQKKLYRDVMQETFVNLASIGENWEEKNIEDHKNQGRKLRS

SEQ ID NO: 5840 - protein, 81 aa, Hylobates moloch
MSSVALEDVAVNFTREEWALLGPCQKNLYKDVMQETIRNLDCVGMKWKDQNIEDQYRYPRKNLRCRMLERFVVSKGGSQCG

SEQ ID NO: 5841 - protein, 81 aa, Hylobates moloch
SSVALEDVAVNFTREEWALLGPCQKNLYKDVMQETIRNLDCVGMKWKDQNIEDQYRYPRKNLRCRMLERFVVSKGGSQCGE

SEQ ID NO: 5842 - protein, 81 aa, Hylobates moloch
MSSVALEDVAVNFTREEWALLGPCQKNLYKDVMQETIRNLDCVGMKWKDQNIEDQYRYPRKNLRCHMLERFVESKDGSQCG

SEQ ID NO: 5843 - protein, 81 aa, Hylobates moloch
RNDFFLPDSQTSEERKQYDSVAFEDVAVNFTREEWALLGPSQKSLYRDVMWETIRNLDCIGMKWEDTNIEDQHKNPRRNLR

SEQ ID NO: 5844 - protein, 81 aa, Hylobates moloch
MDAVDFEDVAVNFTQEEWALLGPSQKNLYRYVMQETIRNLDCIRMIWEDQNTEDQYKNPRRSLRCHMVERFSESKDSSQYG

SEQ ID NO: 5845 - protein, 81 aa, Hylobates moloch
HTHKQRGKAFSYHHSLQSHGRPHTGKKRYECKECGKTFSSRRNLRRHMVVQGGNRPYKFPIDMRECTLGRNRMNVSSVLKP

SEQ ID NO: 5846 - protein, 81 aa, Hylobates moloch
MDSVAFEDVAVNFTHEEWALLGPSQKNLYRDVMQETIRNLNCIGMKWETQNIDDQYQNLRRNPRCDMVERFGKSKDGSQCG

SEQ ID NO: 5847 - protein, 81 aa, Hylobates moloch
TLPRGQPEVLGWGLPKDQDSVAFEDVAVNFTHEEWALLGPSQKNLYRDVMQETIRNLNCIGMKWETQNIDDQYQNLRRNPR

SEQ ID NO: 5848 - protein, 81 aa, Hylobates moloch
KNLYRDVMQETIRNLNCIGMKWETQNIDDQYQNLRRNPRLSETWLQNFILIHYGHLVALSDGGSLRFSTGQGLPVTQAGVQ

SEQ ID NO: 5849 - protein, 81 aa, Hylobates moloch
MDSVAFEDVDVNFTQDEWALLDPSQKNLYRDVMQETFRNLASVGKKWKDQKIEDEYKNPRRNLRGLMGERLLEGKKDHQHG

SEQ ID NO: 5850 - protein, 81 aa, Hylobates moloch
DSVAFEDVDVNFTQDEWALLDPSQKNLYRDVMQETFRNLASVGKKWKDQKIEDEYKNPRRNLSLRKWSWLYPRQTLGLDSP

SEQ ID NO: 5851 - protein, 81 aa, Hylobates moloch
MDSVAFEDVDVNFTQDEWALLDPSQKNLYRDVMQETFRNLASVGKKWKDQKIEDEYKNPRRNLSLRKWSWLYPRQTLGLDS

SEQ ID NO: 5852 - protein, 81 aa, Hylobates moloch
MMFQDSVAFEDVAVSFTQEEWALLDPSQKNLYRDVMQETFKNLTSVGKTWKVQSIEEYKNPRRNLSLMREKLCESKESHHC

SEQ ID NO: 5853 - protein, 81 aa, Hylobates moloch
MDSVAFEDVAVSFTQEEWALLDPSQKNLYRDVMQETFKNLTSVGKTWKVQSIEEYKNPRRNLRRSFTPVTQAGVQWRDLGS

SEQ ID NO: 5854 - protein, 81 aa, Hylobates moloch
MDSVAFEDVAVSFTQEEWALLDPSQKNLYRDVMQETFKNLTSVGKTWKVQSIEEYKNPRRNLSLMREKLCESKESHHCGES

SEQ ID NO: 5855 - protein, 81 aa, Hylobates moloch
MDSVAFKDVAVNFTQEESLLDPSQKNLYREVMHETLRNLASVGEKWKDQNIEDQYKNPRNNLRSLLGERVDENTEENHCGE

SEQ ID NO: 5856 - protein, 81 aa, Hylobates moloch
MDSVAFEDVAVNFTQEEWALLDPSQKNLYREVMQETVRNLASIGKKWNNQYIEDEHQNPRKNLRRLIGERLSESKESHQHG

SEQ ID NO: 5857 - protein, 81 aa, Hylobates moloch
MMFQDSVAFEDVAVTFTQEEWALLDPSQKNLYRDVMQETFKNLASIGKKWKAQNIYVEYKNLRRNLRIVGERLFESKEGHQ

SEQ ID NO: 5858 - protein, 81 aa, Hylobates moloch
MDSVAFEDVAVTFTQEEWALLDPSQKNLYRDVMQETFKNLASIGKKWKAQNIYVEYKNLRRNLRIVGERLFESKEGHQHGE

SEQ ID NO: 5859 - protein, 81 aa, Hylobates moloch
LLVLSILLYTCEMFQDSVAFEDVAVTFTQEEWALLDPSQKNLYRDVMQETFKNLASIGKKWKAQNIYVEYKNLRRNLRIVG

SEQ ID NO: 5860 - protein, 81 aa, Hylobates moloch
MDPVAFEDVAVNFTQEEWALLDISQRKLYREVMLETFRNLTSIGKKWKDQNIEYEYQNPRRNFRSIIEGNVNEIKEDRHCG

SEQ ID NO: 5861 - protein, 81 aa, Hylobates moloch
MMFQDPVAFEDVAVNFTQEEWALLDISQRKLYREVMLETFRNLTSIGKKWKDQNIEYEYQNPRRNFRSIIEGNVNEIKEDR

SEQ ID NO: 5862 - protein, 81 aa, Hylobates moloch
PPVLSLSPILLYTCEMFQDPVAFEDVAVNFTQEEWALLDISQRKLYREVMLETFRNLTSIGKKWKDQNIEYEYQNPRRNFR

SEQ ID NO: 5863 - protein, 81 aa, Hylobates moloch
CSHRSCRKDPGTSESREMDPVAFEDVAVNFTQEEWALLDISQRKLYREVMLETFRNLTSIGKKWKDQNIEYEYQNPRRNFR

SEQ ID NO: 5864 - protein, 81 aa, Hylobates moloch
MPCCSHRSCRKDPGTSESREMRPESSDCKLRPMRNLQREVIESSPVIPALWEAEADGSSQMFQDPVAFEDVAVNFTQEEWA

SEQ ID NO: 5865 - protein, 81 aa, Hylobates moloch
CKLRPMRNLQREVIESSPVIPALWEAEADGSSQMFQDPVAFEDVAVNFTQEEWALLDISQRKLYREVMLETFRNLTSIGVS

SEQ ID NO: 5866 - protein, 81 aa, Hylobates moloch
MDPVAFEDVAVNFTQEEWTLLDISQKNLFREVMLETFRNLTSIGKKWKDQNIDYEYQNPRRSFRSLIEEKVNEIKDDSHCG

SEQ ID NO: 5867 - protein, 81 aa, Hylobates moloch
MFQDPVAFEDVAVNFTQEEWTLLDISQKNLFREVMLETFRNLTSIGKKWKDQNIDYEYQNPRRSFRSLIEEKVNEIKDDSH

SEQ ID NO: 5868 - protein, 81 aa, Hylobates moloch
RSCRKDPGTSESREMMFQDPVAFEDVAVNFTQEEWTLLDISQKNLFREVMLETFRNLTSIGKKWKDQNIDYEYQNPRRSFR

SEQ ID NO: 5869 - protein, 81 aa, Hylobates moloch
CSHRSCRKDPGTSESREMDPVAFEDVAVNFTQEEWTLLDISQKNLFREVMLETFRNLTSIGKKWKDQNIDYEYQNPRRSFR

SEQ ID NO: 5870 - protein, 81 aa, Hylobates moloch
MPCCSHRRCREDPGTSESQEMEEWALLDISQRKLYREVMLETFGNLASIGKSWKDQNIEYEYQNPRRNFRRLIEKKVNEIK

SEQ ID NO: 5871 - protein, 81 aa, Hylobates moloch
CSHRRCREDPGTSESQEMDSVAFKDVAVNFTQEEWALLDISQRKLYREVMLETFGNLASIGKSWKDQNIEYEYQNPRRNFR

SEQ ID NO: 5872 - protein, 81 aa, Hylobates moloch
MMFQDSVAFKDVAVNFTQEEWALLDISQRKLYREVMLETFGNLASIGKSWKDQNIEYEYQNPRRNFRRLIEKKVNEIKEDS

SEQ ID NO: 5873 - protein, 81 aa, Hylobates moloch
MDAVAFKDVAVNFTQEEWALLDISQRKLYREVMLETFRNLTSIGKSWKDKNIEYEYQNPRRNFRSVIEEKVNEIKDDSHCG

SEQ ID NO: 5874 - protein, 81 aa, Hylobates moloch
MFQDAVAFKDVAVNFTQEEWALLDISQRKLYREVMLETFRNLTSIGKSWKDKNIEYEYQNPRRNFRSVIEEKVNEIKDDSH

SEQ ID NO: 5875 - protein, 81 aa, Hylobates moloch
MMFQDAVAFKDVAVNFTQEEWALLDISQRKLYREVMLETFRNLTSIGKSWKDKNIEYEYQNPRRNFRSVIEEKVNEIKDDS

SEQ ID NO: 5876 - protein, 81 aa, Hylobates moloch
MDSVAFEDVAINFTCEEWALLGPSQKSLYRDVMQETIRNLDCIGMTWQTHDIEEDQYKDLRRNLRCHMVERSCEIKDNSQC

SEQ ID NO: 5877 - protein, 81 aa, Hylobates moloch
MDSVAFEDVAVNFTQEEWALLGPSQKSLYRNVMQETIRNLDCIEMKWEDQNIGDQCQNARRNLRSHTCEIKDDSQCGETFG

SEQ ID NO: 5878 - protein, 81 aa, Hylobates moloch
MDSVAFEDVAVNFTLEEWALLDPSQKNLYRDVMRETFRNLASIGKQWEDQNIEDPFKIPRRNISHIPERLCESKEGSQGEE

SEQ ID NO: 5879 - protein, 81 aa, Hylobates moloch
MDSSQHLVTFEDVAVDFPQEEWTLLDQTQRDFYRDVMLENYKNLIILAGLCKPCFMSGLEQMEELRTGVTGVLQGEKQYCR

SEQ ID NO: 5880 - protein, 81 aa, Hylobates moloch
EKTKAERMVEDYLANGYQDSVTFDDVAVDFTPEEWALLDTTEKYLYRDVMLENYMNLASVEWEIQPRTKWSSLQQGFLKNQ

SEQ ID NO: 5881 - protein, 81 aa, Hylobates moloch
FFSREPICPFEEKTKAERMVEDYLANGYQDSVTFDDVAVDFTPEEWALLDTTEKYLYRDVMLENYMNLASVDKRLQWMETL

SEQ ID NO: 5882 - protein, 81 aa, Hylobates moloch
EKTPAGRIVADCLTNCYQDSVTFDDVAVDFTQEEWTLLDSTQRSLYSDVMLENYKNLATVGGHIIKPSLISWLEQEESRTV

SEQ ID NO: 5883 - protein, 81 aa, Hylobates moloch
MDSVTFDDVAVDFTQEEWTLLDSTQRSLYSDVMLENYKNLATVGGHIIKPSLISWLEQEESRTVNGGVLQGWEMQLEAQWS

SEQ ID NO: 5884 - protein, 81 aa, Hylobates moloch
MAYSLTNCYQDSVTFEDTAVDFTQEEWTLLDPVQRNLYRDVMLENYENVAKVGFQLLKPSVISWLEEEELRTFQQGVLQDW

SEQ ID NO: 5885 - protein, 81 aa, Hylobates moloch
EKTEVERVVADCLTNCYQDSVTFDDLAVDFTPEEWTLLDPTQRNLYRDVMLENYKNLATVGCQLFKPSLISWLEQEESRTV

SEQ ID NO: 5886 - protein, 81 aa, Hylobates moloch
LVAGWLTNYSQDSVTFEDVAVDFTQEEWTLLDQTQRNLYRDVMLENYKNLVAVDWESRINTKWSAPQENFLQGKTSSVVEM

SEQ ID NO: 5887 - protein, 81 aa, Hylobates moloch
MEEERKTAELQKNRIRDSVVFEDVAVDFTQEEWALLDLAQRNLYRDVMLENFQNLASLGYPLHTPHLISQWEQEEDLQTVK

SEQ ID NO: 5888 - protein, 81 aa, Hylobates moloch
SSKDHSCPQNLNLFVCSGLEPHTPSVGSQESVTFQDIAVDFTEKEWPLLDSSQRKLYKDVMLENYSNLTSLEILAPPFCCS

SEQ ID NO: 5889 - protein, 81 aa, Hylobates moloch
NLFVCSGLEPHTPSVGSQESVTFQDIAVDFTEKEWPLLDSSQRKLYKDVMLENYSNLTSLGYQVGKPSLISHLEQEEEPRT

SEQ ID NO: 5890 - protein, 81 aa, Hylobates moloch
NLFVCSGLEPHTPSVGSQESVTFQDIAVDFTEKEWPLLDSSQRKLYKDVMLENYSNLTSLDWETPSKTKWSLLMEDIFGKE

SEQ ID NO: 5891 - protein, 81 aa, Hylobates moloch
GHTEGGELVNELLTSWLQGLVTFEDVAVEFTQEEWALLDPAQRTLYRDVMLENCRNLASLGCRVNKPSLISQLEQDKKVMT

SEQ ID NO: 5892 - protein, 81 aa, Hylobates moloch
GHTEGGELVNELLTSWLQGLVTFEDVAVEFTQEEWALLDPAQRTLYRDVMLENCRNLASLDLETLLKAKWLTPKKHVFRKE

SEQ ID NO: 5893 - protein, 81 aa, Hylobates moloch
MSQDSVTFADVAVNFTNEEWTLLDPAQRNLYRDVMLENSRNLAFIDWATPCKTKDTTPQPDILPKRTFPEANRVCLTSISS

SEQ ID NO: 5894 - protein, 81 aa, Hylobates moloch
PSSASQVAGTTGTRPHSWDSVTFADVAVNFTNEEWTLLDPAQRNLYRDVMLENSRNLAFIDWATPCKTKDTTPQPDILPKR

SEQ ID NO: 5895 - protein, 81 aa, Hylobates moloch
MAEEFVTLRDVGLDFPLEDWEQLGLEQGDMFWDTALDNCQDLFLLDPPRPNLTSHADGGEDLEPLAGGSPEATGPDVTETK

SEQ ID NO: 5896 - protein, 81 aa, Hylobates moloch
LDFPLEDWEQLGLEQGDMFWDTALDNCQDLFLLDPPRPNLTSHADGGEDLEPLAGGSPEATGPDVTETKNSPPMENFLEEG

SEQ ID NO: 5897 - protein, 81 aa, Hylobates moloch
MAEEFVTLRDVGLDFPLEDWEQLGLEQGDMFWDTALDNCQDLFLLDPPRPNLTSHADGGEDLEPLAGGSPEATGPVNRRHL

SEQ ID NO: 5898 - protein, 81 aa, Hylobates moloch
MANGTLMAEGQESVTFKDVAVDFTLEEWGWLEPGQRELYRDVMLENYRNLLSLDLETSSVTIRETPRKKSISEDSASPVEG

SEQ ID NO: 5899 - protein, 81 aa, Hylobates moloch
MANGTLMAEGQESVTFKDVAVDFTLEEWGWLEPGQRELYRDVMLENYRNLLSLGAGLPGSKPDVISRLERGEEPRQEEREA

SEQ ID NO: 5900 - protein, 81 aa, Hylobates moloch
LSQKPQVPGPEEQDGSCEASVSFEDVTVDFSREEWQQLDPAQRWLYQDVMLELYSHLFSVGYHIPNPDVIFRMLKEKEPRV

SEQ ID NO: 5901 - protein, 81 aa, Hylobates moloch
NQIQPVSHSAFFNKQTLNTESNCEYKDPGKMIHTWPHLASSQKQPQKCCLFAKSLKLNLEVNGQNESNDTAQLDDVVGSGQ

SEQ ID NO: 5902 - protein, 81 aa, Hylobates moloch
NATIVMSVRREQGSSSREGSLSFEDVAVGFTREEWQFLDQSQKVLYKEVMLENYSNLVSVGYQVTKPDALFKLEQGEPPWI

SEQ ID NO: 5903 - protein, 81 aa, Hylobates moloch
MTKAQESLTLKDVAVDFTREEWQLLGPAQKHLYRDVMLENYSNLVSVGYQASKPDALIELEQGEPLWTLEDEIHSPTHPEI

SEQ ID NO: 5904 - protein, 81 aa, Hylobates moloch
MLENYSNLVSVGYQASKPDALFKLEQGEPWTVENDSHICPEIKKVDNHLQIHSQNQRCLKRVEQCHKHNAFGNIIHQRKSD

SEQ ID NO: 5905 - protein, 81 aa, Hylobates moloch
ENYSNLVSVGYQASKPDALFKLEQGEPWTVENDSHICPEIKKVDNHLQIHSQNQRCLKRVEQCHKHNAFGNIIHQRKSDFP

SEQ ID NO: 5906 - protein, 81 aa, Hylobates moloch
MIKSQESLTLEDVAVEFTWEEWQLLGPAQKDLYRDVMLENYSNLVSVGYQASKPDALFKLEQGEPWTVENDSHICPEIKKV

SEQ ID NO: 5907 - protein, 81 aa, Hylobates moloch
MIQAQESVTLEDVAVDFTWEEWQLLGAAQKDLYRDVMMENYSNLVAVGYQPSKPDALFKLEQGEQPWTTEDGIHSGACSDI

SEQ ID NO: 5908 - protein, 81 aa, Hylobates moloch
MMQAQESLTLEDVAVDFTWEEWQFLSPAQKDLYRDVMLENYSNLVAVGYQARKPDALSKLERGEEPCTTEDEIYARICSDS

SEQ ID NO: 5909 - protein, 81 aa, Hylobates moloch
MMQAQESLTLEDVAVDFTWEEWQFLSPAQKDLYRDVMLENYSNLVAVGYQARKPDALSKLERGEEPCTTEDEIYARICSEI

SEQ ID NO: 5910 - protein, 81 aa, Hylobates moloch
MRPEQTKFWEESLTLEDVAVDFTWEEWQFLSPAQKDLYRDVMLENYSNLVAVGYQARKPDALSKLERGEEPCTTEDEIYAR

SEQ ID NO: 5911 - protein, 81 aa, Hylobates moloch
MESLTLEDVAVDFTWEEWQFLSPAQKDLYRDVMLENYSNLVAVGYQARKPDALSKLERGEEPCTTEDEIYARICSDSGGAS

SEQ ID NO: 5912 - protein, 81 aa, Hylobates moloch
MIKTQESLSLEDVAVEFSWEEWQLLDTAQKNLYRDVMVENYNHLVSLGYQTSKPDVLSKLAHGQEPWITDAKIQNKNCPGI

SEQ ID NO: 5913 - protein, 80 aa, Hylobates moloch
MIKTQESLSLEDVAVEFSWEEWQLLDTAQKNLYRDVMVENYNHLVSLGYQTSKPDVLSKLAHGQEPWITDAKIQNKNCPD

SEQ ID NO: 5914 - protein, 81 aa, Hylobates moloch
MINAQELLTLEDVTVEFTWEEWQLLDPFQKDLYRDVMLEIYSNLVSIGYQVSKPDALSKLERGEEPWTVEDERHSQICPEN

SEQ ID NO: 5915 - protein, 81 aa, Hylobates moloch
MINAQELLTLEDVTVEFTWEEWQLLDPFQKDLYRDVMLEIYSNLVSIGYQVSKPDALSKLERGEEPWTVEDERHSQICPGT

SEQ ID NO: 5916 - protein, 81 aa, Hylobates moloch
EAQERKKKEKEPGMALPQGSLTFRDVAVEFSQEEWKSLDPVQKALYRDVMLENYRNLGFLGLCLPDLNIISMLEQGKEPWT

SEQ ID NO: 5917 - protein, 81 aa, Hylobates moloch
MALPQGSLTFRDVAVEFSQEEWKSLDPVQKALYRDVMLENYRNLGFLGLCLPDLNIISMLEQGKEPWTVVSQVKIAKNPNC

SEQ ID NO: 5918 - protein, 81 aa, Hylobates moloch
MATQGPLTFKDVAIEFSQEEWKCLEPVQKALYKDVMLENYRNLVFLGISPKCVIKELPPTENSDTGERFQTVTLERHQSYD

SEQ ID NO: 5919 - protein, 81 aa, Hylobates moloch
MAFTQGPLTFRDVAIEFSQEEWKSLDPVQKALYWDVMLENYRNLVFLGILPKCMTKELPPVGNSNTGEKFQTVMLERHECY

SEQ ID NO: 5920 - protein, 81 aa, Hylobates moloch
LDPVQKALYWDVMLENYRNLVFLGILPKCMTKELPPVGNSNTGEKFQTVMLERHECYDVENFYLREIQKNLQDLEFQWKDG

SEQ ID NO: 5921 - protein, 81 aa, Hylobates moloch
MAFTQGPLTFRDVAIEFSQEEWKSLDPVQKALYWDVMLENYRNLVFLGKDNFALEVKICPRVFLYFLCCLSWEPFHYLTET

SEQ ID NO: 5922 - protein, 81 aa, Hylobates moloch
MAQLRRGHLTFRDVAIEFSQEEWKCLDPVQKALYRDVMLENYRNLVSLGICLPDLSVISMMKQRTEPWTVENEMKVAKNPD

SEQ ID NO: 5923 - protein, 81 aa, Hylobates moloch
CFHRVKSSLRVWLWHSKKGHLTFRDVAIEFSQEEWKCLDPVQKALYRDVMLENYRNLVSLGICLPDLSVISMMKQRTEPWT

SEQ ID NO: 5924 - protein, 81 aa, Hylobates moloch
EGEAQKRKAEESGMPLTQGHLTFRDVAIEFSQEEWKCLDPVQKALYRDVMLENYRNLVSLGICLPDLSVISMMKQRTEPWT

SEQ ID NO: 5925 - protein, 81 aa, Hylobates moloch
MLENYRNLVSLGICLPDLSVISMMKQRTEPWTVENEMKVAKNPDRWEGIKDINTGRNCAVRSQAGSKPITNQLGLTFHLPL

SEQ ID NO: 5926 - protein, 81 aa, Hylobates moloch
MGHLTFRDVAIEFSQEEWKCLDPVQKALYRDVMLENYRNLVSLGICLPDLSVISMMKQRTEPWTVENEMKVAKNPDRWEGI

SEQ ID NO: 5927 - protein, 81 aa, Hylobates moloch
AQKRRKRKAKESGMALPQGHLTFRDVAIEFSQAEWKCLDPAQRALYKDVMLENYRNLVSLGISLPDLNINSVLEQRREPWS

SEQ ID NO: 5928 - protein, 81 aa, Hylobates moloch
DEEAQKRKAKESGMALPQGHLTFMDVAIEFSQEEWKSLDPGQRALYRDVMLENYRNLVSLGICLPDLSIISMLKQRREPLT

SEQ ID NO: 5929 - protein, 81 aa, Hylobates moloch
MLRRGHLTFRDVAIEFSQEEGKCLDPAQRTLYRDVMLENYRNLVFLGICLPDLSVISMLEQRRDPQNLQSEVKIANNQGGR

SEQ ID NO: 5930 - protein, 81 aa, Hylobates moloch
MLRRGHLTFRDVAIEFSQEEGKCLDPAQRTLYRDVMLENYRNLVFLGICLPDLSVISMLEQRRDPQNLQSEVKIANNQGSC

SEQ ID NO: 5931 - protein, 81 aa, Hylobates moloch
MAFTQGPLKFMDVAIEFSQEEWKCLDPAQRTLYRDVMLENYRNLVSLGICLPDLSVISMLEQKKDPWTLQSEEKIANNPDS

SEQ ID NO: 5932 - protein, 81 aa, Hylobates moloch
MDVAIEFSQEEWKCLDPAQRTLYRDVMLENYRNLVSLGICLPDLSVISMLEQKKDPWTLQSEEKIANNPDSRECINGVNTV

SEQ ID NO: 5933 - protein, 81 aa, Hylobates moloch
LYRDVMLENYRNLVSLGICLPDLSVISMLEQKKDPWTLQSEEKIANNPDSRECINGVNTDSPLLQCITSVPCVFCTASMIY

SEQ ID NO: 5934 - protein, 81 aa, Hylobates moloch
MALTQGQLSFRDVAIEFSQEEWKCLDPGQKALYKDVMLENYRNLVSLGICLPDLSVISMLEQKKDPWTLQSEVKIAKNPNG

SEQ ID NO: 5935 - protein, 81 aa, Hylobates moloch
MALTQGQLSFRDVAIEFSQEEWKCLDPGQKALYKDVMLENYRNLVSLGEENVPPEACLCSGICLPDLSVISMLEQKKDPWT

SEQ ID NO: 5936 - protein, 81 aa, Hylobates moloch
MALTQGQLSFRDVAIEFSQEEWKCLDPGQKALYKDVMLENYRNLVSLDFSLLAWDALVFAVEAWRTSGGAEEPTSPNFGGN

SEQ ID NO: 5937 - protein, 81 aa, Hylobates moloch
MALPQGRLTFRDVAIEFSLAEWKFLNPSQRALYREVMLENYRNLEAVDISSKCMMKEVLSTGQGNSEVFYTGTLQRHESHH

SEQ ID NO: 5938 - protein, 81 aa, Hylobates moloch
ETQKRKRKAKESGMALPQGLLTFRDVAIEFSQEEWKCLDPAQRTLYRDVMLENYRNLVSLDISSKCMMNMFSSTGQGNTEV

SEQ ID NO: 5939 - protein, 81 aa, Hylobates moloch
MALPQGLLTFRDVAIEFSQEEWKCLDPAQRTLYRDVMLENYRNLVSLDISSKCMMNMFSSTGQGNTEVIHTGTLQRHASHH

SEQ ID NO: 5940 - protein, 81 aa, Hylobates moloch
MALPQGLLTFRDVAIEFSQEEWKCLDPAQRTLYRDVMLENYRNLVSLGQGNTEVIHTGTLQRHASHHTGDTCFQEIEKDIH

SEQ ID NO: 5941 - protein, 81 aa, Hylobates moloch
MALPQGLLTFRDVAIEFSQEEWKCLDPAQRTLYRDVMLENYRNLLSLDIFSKCEIKELPPKKKSNTGEVFQTAMLERHESH

SEQ ID NO: 5942 - protein, 81 aa, Hylobates moloch
LDPAQRTLYRDVMLENYRNLLSLDIFSKCEIKELPPKKKSNTGEVFQTAMLERHESHDIQDFCFRETQKNVHDSQCLQRHD

SEQ ID NO: 5943 - protein, 81 aa, Hylobates moloch
DPAQRTLYRDVMLENYRNLLSLDIFSKCEIKELPPKKKSNTGEVFQTAMLERHESHDIQDFCFRETQKNVHDSQCLQRHDE

SEQ ID NO: 5944 - protein, 81 aa, Hylobates moloch
AIEFSQEEWKCLDPAQRTLYRDVMLENYRNLLSLDIFSKCEIKELPPKKKSNTGEVFQTAMLERHESHDIQDFCFRETQKN

SEQ ID NO: 5945 - protein, 81 aa, Hylobates moloch
MALPQGLLTFRDVAIEFSQEEWKCLDPAQRTLYRDVMLENYRNLLSLGHDLIFFFPRWSFSCCPGWSAMARSRLTTTSASR

SEQ ID NO: 5946 - protein, 81 aa, Hylobates moloch
RNLLSLGHDLIFFFPRWSFSCCPGWSAMARSRLTTTSASRVQAILPPQPQKLELEIFFLNVRSRNYHQKRRVIQEKYSRRQ

SEQ ID NO: 5947 - protein, 81 aa, Hylobates moloch
MALPQGLLTFRDVAIEFSQEEWKCLDPAQRTLYRDVMLENYRNLLSLDGVSLVAPAGVQWHDLGSPQPLPPGFKRFSRLSL

SEQ ID NO: 5948 - protein, 81 aa, Hylobates moloch
HEETTKKTKEKEIRMALPQGRLTFRDVAIEFSLEEWKCLNSAQRALYREVMLENYRNLEAVAPAPGKYTPPRCKCLTPNPP

SEQ ID NO: 5949 - protein, 81 aa, Hylobates moloch
EEAAQKRKGKEPGMALPQGRLTFRDVAIEFSLAEWKFLNPSQRALYREVMLENYRNLEAVDISSKRLKKEVLSTGQGNTEV

SEQ ID NO: 5950 - protein, 81 aa, Hylobates moloch
EEAAQKRKGKEPGMALPQGRLTFRDVAIEFSLAEWKFLNPSQRALYREVMLENYRNLEAVESHFVTQAGVQWCDLGSLQLL

SEQ ID NO: 5951 - protein, 80 aa, Hylobates moloch
MLHEEAAQKRKGKEPGMALPQGRLTFRDVAIEFSLAEWKFLNPSQRALYREVMLENYRNLEAVETGFHSVSQDGLNLLTS

SEQ ID NO: 5952 - protein, 81 aa, Hylobates moloch
MALPQGLLTFRDVAIDFSQEEWKCLDPAQRTLYRDVMLENYRNLVSLDTSSKCMMKIFFSTGQGNTEVFHMGTLQTQASHH

SEQ ID NO: 5953 - protein, 81 aa, Hylobates moloch
MALPQGLLTFRDVAIDFSQEEWKCLDPAQRTLYRDVMLENYRNLVSLEFRSVTQAKVQWCHLSSLQPPLPRFKQFSCLSLP

SEQ ID NO: 5954 - protein, 81 aa, Hylobates moloch
MALPQGLLTFRDVAIEFSQEEWKCLDPAQRTLYRDVMLENYRNLVSLDISSKCMLKTLSSTGQGNTEVFHTRTLHRQASHH

SEQ ID NO: 5955 - protein, 81 aa, Hylobates moloch
MAFSQGLLTFRDVAIEFSQEEWKCLDPAQRTLYRDVMLENYRNLVSLDTSSKCMMTTLSSTGQGNTEVFHTGTLQRQASYR

SEQ ID NO: 5956 - protein, 81 aa, Hylobates moloch
MALPQGLLTFRDVAIEFSQEEWKCLDPAQRTLYRDVMLENYRNLVSLDISSKCLAKEFSSTGQGNTEVIHTGTLQRHESHH

SEQ ID NO: 5957 - protein, 81 aa, Hylobates moloch
GCLTFRDVAIEFSLEEWKCLNPAQRALYRAVMLENYRNLEFVDISSKCMMKKFSSTGQGNTEVIHTGTLQRHESHPIRDFC

SEQ ID NO: 5958 - protein, 81 aa, Hylobates moloch
GCLTFRDVAIEFSLEEWKCLNPAQRALYRAVMLENYRNLEFVDSSLKSMMEFLPTGHGNTREEFHTGTLERHKSHHIGDFC

SEQ ID NO: 5959 - protein, 81 aa, Hylobates moloch
MALLQGCLTFRDVAIEFSLEEWKCLNPAQRALYRAVMLENYRNLEFVGEENVPPDMRNLHLSILALPDFVFSFVMLLHTCF

SEQ ID NO: 5960 - protein, 81 aa, Hylobates moloch
MLENYWNLVSLGLCHFDMNIISMLEEGKEPWTVKSCVKIARKPRMRECVKSVVTDIPLKRTIKDLLPKEKSSTEAVFHTVV

SEQ ID NO: 5961 - protein, 81 aa, Hylobates moloch
CTGHGPGKGSHPDMDGDGVRLTFRDVAIEFSQEEWKCLDPAQRILYRDVMLENYWNLVSLGLCHFDMNIISMLEEGKEPWT

SEQ ID NO: 5962 - protein, 81 aa, Hylobates moloch
MAVTQLTFRDVAIEFSQEEWKCLNSTQRTLYRDVMLENYRNLVSLDLSRNCVIKELAPQWESNTGEVFHTVTLEQHEKHDI

SEQ ID NO: 5963 - protein, 81 aa, Hylobates moloch
MAVTQLTFRDVAIEFSQEEWKCLNSTQRTLYRDVMLENYRNLVSLEYSLMWEHREEPWTIESQVQIARKPKGWEWIKGVKI

SEQ ID NO: 5964 - protein, 81 aa, Hylobates moloch
MDGDGLTFRDVAIEFSQEEWKCLNSTQRTLYRDVMLENYRNLVSLDLSRNCVIKELAPQWESNTGEVFHTVTLEQHEKHDI

SEQ ID NO: 5965 - protein, 81 aa, Hylobates moloch
HEEETQKRRAEESGMAVTQLTFRDVAIEFSQEEWKCLNSTQRTLYRDVMLENYRNLVSLDLSRNCVIKELAPQWESNTGEV

SEQ ID NO: 5966 - protein, 81 aa, Hylobates moloch
MDGDGLTFRDVAIEFSQEEWKCLNSTQRTLYRDVMLENYRNLVSLEYSLMWEHREEPWTIESQVQIARKPKGWEWIKGVKI

SEQ ID NO: 5967 - protein, 81 aa, Hylobates moloch
MALTQGQVTFRDVAIEFSQEEWTCLDPAQRTLYRDVMLENYRNLASLGISCFDLSIISMLEQGKEPFTVESQVQIARNPDR

SEQ ID NO: 5968 - protein, 81 aa, Hylobates moloch
MLENYRNLASLGISCFDLSIISMLEQGKEPFTVESQVQIARNPDRWEWIKAMITALSSEFVMKDLPHKGKSDTGEVFQTVM

SEQ ID NO: 5969 - protein, 81 aa, Hylobates moloch
SMLEQGKEPFTVESQVQIARNPDRWEWIKAMITALSSEFVMKDLPHKGKSDTGEVFQTVMLERQESHDIEGCSFREVQKNT

SEQ ID NO: 5970 - protein, 81 aa, Hylobates moloch
MALPQGLLTFRDVAIEFSQEEWTCLDPAQKTLYRDAMLENYRNLVSLDTSCKCVNKDLPSKGKSNMREAFYTVKLERLESH

SEQ ID NO: 5971 - protein, 81 aa, Hylobates moloch
MIQSQISFEDVAVDFTLEEWQLLNPTQKNLYRDVMLENYSNLVFLGFQILKPDAIFKLEQQDPWIIDQEILNQNFSEVWLD

SEQ ID NO: 5972 - protein, 81 aa, Hylobates moloch
FGNLPGVPWAQGNSALPEGLLSFKDISMEFTWDEWQLLDSTQKYLYRDVILENYHNLISVGYHGTKPDLIFKLEQGEDPWI

SEQ ID NO: 5973 - protein, 81 aa, Hylobates moloch
MSQGSVTFRDVAIDFSQEEWKWLQPAQRDLYRCVMLENYGHLVSLGLSISKPDVVSLLEQGKEPWLGKRDVKRDLFSVSES

SEQ ID NO: 5974 - protein, 81 aa, Hylobates moloch
MLENYGHLVSLGLSISKPDVVSLLEQGKEPWLGKRDVKRDLFSVSESSGEIKDFSPKNVIYDDSSQYLIMERILSQGPVYS

SEQ ID NO: 5975 - protein, 81 aa, Hylobates moloch
MSQGSVTFRDVAIDFSQEEWKWLQPAQRDLYRCVMLENYGHLVSLAGLSISKPDVVSLLEQGKEPWLGKRDVKRDLFSVRV

SEQ ID NO: 5976 - protein, 81 aa, Hylobates moloch
MSQGSVTFRDVAIDFSQEEWKWLQPAQRDLYRCVMLENYGHLVSLGLSISKPDVVSLLEQGKEPWLGKRDVKRDLFSVLKE

SEQ ID NO: 5977 - protein, 81 aa, Hylobates moloch
REFGGMRAGHADICLSFQGSVTFRDVAIDFSQEEWKWLQPAQRDLYRCVMLENYGHLVSLGLSISKPDVVSLLEQGKEPWL

SEQ ID NO: 5978 - protein, 81 aa, Hylobates moloch
RNAEEERMIAVFLTTWLQEPMSFKDVAVEFTQEEWMMLDSAQRSLYRDVMLENYRNLTSVEYQLCRLTVISPLDQEEIRNM

SEQ ID NO: 5979 - protein, 81 aa, Hylobates moloch
MDAKSLTAWSQTLVTFKDVFVDFTREEWKLLDTAQQIVYRNVMLENYKNLVSLGYQLTKPDVILRLEKGEEPWLMERGIHQ

SEQ ID NO: 5980 - protein, 81 aa, Hylobates moloch
VLEWLFISQEQPKITKSWGPLSFMDVFVDFTWEEWLLLDPAQKCLYRSVMLENYSNLVSLGYQHTKPDVIFKLEQGEELCM

SEQ ID NO: 5981 - protein, 81 aa, Hylobates moloch
MDVFVDFTWEEWLLLDPAQKCLYRSVMLENYSNLVSLGYQHTKPDVIFKLEQGEELCMVQAQVPNQSCPNTVWKIDDLMDW

SEQ ID NO: 5982 - protein, 81 aa, Hylobates moloch
LLDPAQKCLYRSVMLENYSNLVSLGYQHTKPDVIFKLEQGEELCMVQAQVPNQSCPNTVWKIDDLMDWHQENKDKLGSTAK

SEQ ID NO: 5983 - protein, 81 aa, Hylobates moloch
KQKSHRTEKVLEWLFISQEQPKITKSWEWLLLDPAQKCLYRSVMLENYSNLVSLGYQHTKPDVIFKLEQGEELCMVQAQVP

SEQ ID NO: 5984 - protein, 81 aa, Hylobates moloch
MATRVRTASIWGPLSFMDVFVDFTWEEWLLLDPAQKCLYRSVMLENYSNLVSLGYQHTKPDVIFKLEQGEELCMVQAQVPN

SEQ ID NO: 5985 - protein, 81 aa, Hylobates moloch
LLDPAQKCLYRSVMLENYSNLVSLGYQHTKPDVIFKLEQGEELCMVQAQVPNQSCPILKAGKSKAKVLAGLVSGEGLPCAS

SEQ ID NO: 5986 - protein, 81 aa, Hylobates moloch
SFMDVFVDFTWEEWLLLDPAQKCLYRSVMLENYSNLVSLGYQHTKPDVIFKLEQGEELCMVQAQVPNQSCPILKAGKSKAK

SEQ ID NO: 5987 - protein, 81 aa, Hylobates moloch
MLENYRNLLSLGGHSISKPVVVDLLERGKEPWMILREETEFTDLDLQCEIISYIEVPTYETDISSTQLQSIYKREKLYECK

SEQ ID NO: 5988 - protein, 81 aa, Hylobates moloch
HRVGLIRSYNSKTMTCFQELVTFRDVAIDFSRQEWEYLDPNQRDLYRDVMLENYRNLLSLGGHSISKPVVVDLLERGKEPW

SEQ ID NO: 5989 - protein, 81 aa, Hylobates moloch
HRVGLIRSYNSKTMTCFQELVTFRDVAIDFSRQEWEYLDPNQRDLYRDVMLENYRNLLSLEMRSRCVAQVGLKLLVSSDPP

SEQ ID NO: 5990 - protein, 81 aa, Hylobates moloch
TCNWGRPLKFCPTKYMKFQELVTFRDVAIDFSRQEWEYLDPNQRDLYRDVMLENYRNLLSLGGHSISKPVVVDLLERGKEP

SEQ ID NO: 5991 - protein, 81 aa, Hylobates moloch
EPHRVGLIRSYNSKTMTCELVTFRDVAIDFSRQEWEYLDPNQRDLYRDVMLENYRNLLSLGGHSISKPVVVDLLERGKEPW

SEQ ID NO: 5992 - protein, 81 aa, Hylobates moloch
CNWGRPLKFCPTKYMKFQELVTFRDVAIDFSRQEWEYLDPNQRDLYRDVMLENYRNLLSLGGHSISKPVVVDLLERGKEPW

SEQ ID NO: 5993 - protein, 81 aa, Hylobates moloch
MTCFQELVTFRDVAIDFSRQEWEYLDPNQRDLYRDVMLENYRNLLSLGGHSISKPVVVDLLERGKEPWMILREETEFTDLD

SEQ ID NO: 5994 - protein, 81 aa, Hylobates moloch
MTCFQELVTFRDVAIDFSRQEWEYLDPNQRDLYRDVMLENYRNLLSLDLDLQCEIISYIEVPTYETDISSTQLQSIYKREK

SEQ ID NO: 5995 - protein, 81 aa, Hylobates moloch
MACGSITFGDVAIDFSHQEWEYLNLVQKTLYQEVMMENYDNLVSLGHSISKPDLITLLEQGKEPWMIVREETRGECTDLDS

SEQ ID NO: 5996 - protein, 81 aa, Hylobates moloch
MACGSITFGDVAIDFSHQEWEYLNLVQKTLYQEVMMENYDNLVSLGHSISKPDLITLLEQGKEPWMIVREETRGECTAELQ

SEQ ID NO: 5997 - protein, 81 aa, Hylobates moloch
MACGSITFGDVAIDFSHQEWEYLNLVQKTLYQEVMMENYDNLVSLAGHSISKPDLITLLEQGKEPWMIVREETRGECTDLD

SEQ ID NO: 5998 - protein, 81 aa, Hylobates moloch
MACDLVMFRDVAVDFSQEEWECLNSYQRNLYRDVILENYSNLVSLAGCSISKPDVITLLEQGKEPWMVVRDEKRRWTLDLE

SEQ ID NO: 5999 - protein, 81 aa, Hylobates moloch
MACDLVMFRDVAVDFSQEEWECLNSYQRNLYRDVILENYSNLVSLGCSISKPDVITLLEQGKEPWMVVRDEKRRWTLDLES

SEQ ID NO: 6000 - protein, 81 aa, Hylobates moloch
MACDLVMFRDVAVDFSQEEWECLNSYQRNLYRDVILENYSNLVSLGCSISKPDVITLLEQGKEPWMVVRDEKRRWTLGPTF

SEQ ID NO: 6001 - protein, 81 aa, Hylobates moloch
MAHALVTFRDVAIDFSQKEWECLDTTQRKLYRDVMLENYNNLVSLGYSGSKPDVITLLEQGKEPCMAARDVTGRQYPGLLS

SEQ ID NO: 6002 - protein, 81 aa, Hylobates moloch
MAHALVTFRDVAIDFSQKEWECLDTTQRKLYRDVMLENYNNLVSLAGYSGSKPDVITLLEQGKEPCMAARDVTGRQYPGLL

SEQ ID NO: 6003 - protein, 81 aa, Hylobates moloch
MPHLLVTFRDVAIDFSQEEWECLDPAQRDLYRDVMLENYSNLISLDLESSRTTKKLSPEKEIDEMESLQWENMEKLINHQY

SEQ ID NO: 6004 - protein, 81 aa, Hylobates moloch
MDLLFQLLVTFRDVAIDFSQEEWECLDPAQRDLYRDVMLENYSNLISLDLESSRTTKKLSPEKEIDEMESLQWENMEKLIN

SEQ ID NO: 6005 - protein, 81 aa, Hylobates moloch
DLLFQLLVTFRDVAIDFSQEEWECLDPAQRDLYRDVMLENYSNLISLDLESSRTTKKLSPEKEIDEMESLQWENMEKLINH

SEQ ID NO: 6006 - protein, 81 aa, Hylobates moloch
MIEYQIPVSFKDVVVGFTQEEWHQLSPAQRALYRDVMLETYSNLVSVGYEGTKPDVILRLEQEEAPWIGEAACLGCHCWED

SEQ ID NO: 6007 - protein, 81 aa, Hylobates moloch
EWHQLSPAQRALYRDVMLETYSNLVSVGYEGTKPDVILRLEQEEAPWIGEAACLGCHCWEDIWRVNIQRKRRQDMLLRQGT

SEQ ID NO: 6008 - protein, 81 aa, Hylobates moloch
MIEYQIPVSFKDVVVGFTQEEWHQLSPAQRALYRDVMLETYSNLVSVGYEGTKPDVILRLEQEEAPWIGEAACLGCHCWGI

SEQ ID NO: 6009 - protein, 81 aa, Hylobates moloch
VVVGFTQEEWHQLSPAQRALYRDVMLETYSNLVSVGYEGTKPDVILRLEQEEAPWIGEAACLGCHCWGISKLWPTDWPPAL

SEQ ID NO: 6010 - protein, 81 aa, Hylobates moloch
MIEYQIPVSFKDVVVGFTQEEWHQLSPAQRALYRDVMLETYSNLVSVGYEGTKPDVILRLEQEEAPWIGEAACLGCHCWGK

SEQ ID NO: 6011 - protein, 81 aa, Hylobates moloch
EWHQLSPAQRALYRDVMLETYSNLVSVGYEGTKPDVILRLEQEEAPWIGEAACLGCHCWGKCDKSSKRGTEGGWHVGNFVQ

SEQ ID NO: 6012 - protein, 81 aa, Hylobates moloch
SFKDVVVGFTQEEWHQLSPAQRALYRDVMLETYSNLVSVGYEGTKPDVILRLEQEEAPWIGEAACLGCHCWALTFLRELQP

SEQ ID NO: 6013 - protein, 81 aa, Hylobates moloch
FKDVVVGFTQEEWHQLSPAQRALYRDVMLETYSNLVSVGYEGTKPDVILRLEQEEAPWIGEAACLGCHCWALTFLRELQPR

SEQ ID NO: 6014 - protein, 81 aa, Hylobates moloch
MFWKQEQRGDLPHLQELVTFRDVAVDFSQEEWDCLDSSQRHLYSNVMLENYRILVSLGLCFSKPSVILLLEQGKAPWMVKR

SEQ ID NO: 6015 - protein, 81 aa, Hylobates moloch
QGKAPWMVKRELTKGLCSGWEPICETEELTPKQDFYEEHQSQKIIETLTSYNLEYSSLREEWKYEGYFERQPGNQKVCFKE

SEQ ID NO: 6016 - protein, 81 aa, Hylobates moloch
TSAGPIPSQEEEEMTQSQGIVTFKDVAIDFTQEEWKRLDPAQRNLYRNVMLENYNNLITVGYPFTKPDVIFKLEQEEEPWV

SEQ ID NO: 6017 - protein, 81 aa, Hylobates moloch
MTQSQGIVTFKDVAIDFTQEEWKRLDPAQRNLYRNVMLENYNNLITVGYPFTKPDVIFKLEQEEEPWVMEEEVLRRHWQGE

SEQ ID NO: 6018 - protein, 81 aa, Hylobates moloch
MDSARHHISHSTSAGPIPSQEEEEMTQSQGIVTFKDVAIDFTQEEWKRLDPAQRNLYRNVMLENYNNLITVGYPFTKPDVI

SEQ ID NO: 6019 - protein, 81 aa, Hylobates moloch
EMTQSQGIVTFKDVAIDFTQEEWKRLDPAQRNLYRNVMLENYNNLITVGYPFTKPDVIFKLEQEEEPWVMEEEVLRRHWQG

SEQ ID NO: 6020 - protein, 81 aa, Hylobates moloch
MAVGLCKAMSQGLVTFRDVALDFSQEEWEWLKPSQKDLYRDVMLENYRNLVWLGDGCSCRSTLRTTATAETSSSSSSIQVS

SEQ ID NO: 6021 - protein, 81 aa, Hylobates moloch
MAVGLCKAMSQGLVTFRDVALDFSQEEWEWLKPSQKDLYRDVMLENYRNLVWLDWESWCKIEELSPKWFIDEDEISQEMVM

SEQ ID NO: 6022 - protein, 81 aa, Hylobates moloch
AQAGVIRQPRPPRMLGLQAFVAFRDVAVDFTQEEWRLLSPAQRTLHREVMLETYNHLVSLEIPSSKPKLIAQLERGEEPWR

SEQ ID NO: 6023 - protein, 81 aa, Hylobates moloch
EEPWREERKCPLDLCPESKPEIQLCSSCPLIFSNQQALSQHVWLSHLSHLFSSLWAGNPLQLGKHYPEDQKQQQDPFCLSG

SEQ ID NO: 6024 - protein, 81 aa, Hylobates moloch
EPWREERKCPLDLCPAESKPEIQLCSSCPLIFSNQQALSQHVWLSHLSHLFSSLWAGNPLQLGKHYPEDQKQQQDPFCLSG

SEQ ID NO: 6025 - protein, 81 aa, Hylobates moloch
AKKEVIRQPRPPRMLGLQAFVAFRDVAVDFTQEEWRLLSPAQRTLHREVMLETYNHLVSLEIPSSKPKLIAQLERGEEPWR

SEQ ID NO: 6026 - protein, 81 aa, Hylobates moloch
MLETYNHLVSLEIPSSKPKLIAQLERGEEPWREERKCPLDLCPESKPEIQLCSSCPLIFSNQQALSQHVWLSHLSHLFSSL

SEQ ID NO: 6027 - protein, 81 aa, Hylobates moloch
GEEPWREERKCPLDLCPESKPEIQLCSSCPLIFSNQQALSQHVWLSHLSHLFSSLWAGNPLQLGKHYPEDQKQQQDPFCLS

SEQ ID NO: 6028 - protein, 81 aa, Hylobates moloch
MLETYNHLVSLEIPSSKPKLIAQLERGEEPWREERKCPLDLCPDVVSLCCLGSAVASQLTATSTSWVQAVLCLSLPISWDY

SEQ ID NO: 6029 - protein, 81 aa, Hylobates moloch
KLIAQLERGEEPWREERKCPLDLCPAESKPEIQLCSSCPLIFSNQQALSQHVWLSHLSHLFSSLWAGNPLQLGKHYPEDQK

SEQ ID NO: 6030 - protein, 81 aa, Hylobates moloch
MLETYNHLVSLEIPSSKPKLIAQLERGEEPWREERKCPLDLCPDGALLCHQAGIQWRDNGLLQPLPPGFKQFPCVSLLSSW

SEQ ID NO: 6031 - protein, 81 aa, Hylobates moloch
MAEGSVTFSDVSIDFSQEEWDCLDPVQRDLYRDVMLENYSNLVSMGLYTPKPQVISLLEQGKEPWMVGRELTRGLCSDLES

SEQ ID NO: 6032 - protein, 81 aa, Hylobates moloch
MAEGSVTFSDVSIDFSQEEWDCLDPVQRDLYRDVMLENYSNLVSMGKGIRTSDSQFFSGMSASSTVNFSAAFQDFTLLSLK

SEQ ID NO: 6033 - protein, 81 aa, Hylobates moloch
SPQKSSALAPEDHGSSYEGSVSFRDVAINFSREEWQHLDLSQRNLYRDVMLETYSHLLSVGYQVPKPEVVMLEQGKESWAL

SEQ ID NO: 6034 - protein, 81 aa, Hylobates moloch
MQLNEEINKGSVSFRDVAINFSREEWQHLDLSQRNLYRDVMLETYSHLLSVGYQVPKPEVVMLEQGKESWALQGERPRHSC

SEQ ID NO: 6035 - protein, 81 aa, Hylobates moloch
REEWQHLDLSQRNLYRDVMLETYSHLLSVGYQVPKPEVVMLEQGKESWALQGERPRHSCPGEKLWDHNQHRKIIGYKPASS

SEQ ID NO: 6036 - protein, 81 aa, Hylobates moloch
NEEINKGSVSFRDVAINFSREEWQHLDLSQRNLYRDVMLETYSHLLSVGYQVPKPEVVMLEQGKESWALQGERPRHSCPGE

SEQ ID NO: 6037 - protein, 81 aa, Hylobates moloch
LAPEDHGSSYEGSVSFRDVAIDFSREEWRHLDLSQRNLYRDVMLETYSHLLSVGYQVPEAEVVMLEQGKEPWALQGERPRH

SEQ ID NO: 6038 - protein, 81 aa, Hylobates moloch
REEWRHLDLSQRNLYRDVMLETYSHLLSVGYQVPEAEVVMLEQGKEPWALQGERPRHSCPVTHLPFPSTMTKSFLGLTRSQ

SEQ ID NO: 6039 - protein, 81 aa, Hylobates moloch
SPQKSSALAPEDHGSFYEGSVSFRDVAIDFSREEWRHLDLSQRNLYRDVMLETYSHLLSVGYQVPEAEVVMLEQGKEPWAL

SEQ ID NO: 6040 - protein, 81 aa, Hylobates moloch
VAIDFSREEWRHLDLSQRNLYRDVMLETYSHLLSVGYQVPEAEVVMLEQGKEPWALQGERPRHSCPAQCLVNSHHLQESFG

SEQ ID NO: 6041 - protein, 81 aa, Hylobates moloch
MARKLVMFRDVAIDFSQEEWECLDSAQRDLYRDVMLENYSNLVSLDLPSRYASKDLSPEKNTYETQLSQWEMSDRLENCDL

SEQ ID NO: 6042 - protein, 81 aa, Hylobates moloch
TQLSQWEMSDRLENCDLEESNSRDYLEAKGKREKQQENQKEYFRQGMIIYDKMSIFNQHTYLSQHSRCHSTEKPYKCKECG

SEQ ID NO: 6043 - protein, 81 aa, Hylobates moloch
FRDVAIDFSQEEWECLDSAQRDLYRDVMLENYSNLVSLDLPSRYASKDLSPEKNTYETQLSQWEMSDRLENCDLEESNSRD

SEQ ID NO: 6044 - protein, 81 aa, Hylobates moloch
MKPAQRNLYRDVMLENYSNLVTVGCQVTKPDVIFKLEQEEEPWVMEEEMFGRHCPDWELGRETKNLSPKENIYEIRSPQQE

SEQ ID NO: 6045 - protein, 81 aa, Hylobates moloch
SQESALSEEEEDTTRPLETVTFKDVAVDLTQEEWEQMKPAQRNLYRDVMLENYSNLVTVGCQVTKPDVIFKLEQEEEPWVM

SEQ ID NO: 6046 - protein, 81 aa, Hylobates moloch
QEEWEQMKPAQRNLYRDVMLENYSNLVTVGCQVTKPDVIFKLEQEEEPWVMEEEMFGRHCPDWELGRETKNLSPKENIYEI

SEQ ID NO: 6047 - protein, 81 aa, Hylobates moloch
EDTTRPLETVTFKDVAVDLTQEEWEQMKPAQRNLYRDVMLENYSNLVTVGCQVTKPDVIFKLEQEEEPWVMEEEMFGRHCP

SEQ ID NO: 6048 - protein, 81 aa, Hylobates moloch
EEEERMHDELLQAVSKGPVMFRDVSIDFSQEEWECLDAGQMNLYKEVMLENFSNLVSVGLSNSKPAVISLLEQGKEPWMVD

SEQ ID NO: 6049 - protein, 81 aa, Hylobates moloch
MAHLMMFRDVAVDFSQEEWECLDLEQRDLYRDVMLENYSNMVSLGLCIYQPEVFSLLEKGKEPWKILSNETRGPCPDMQSR

SEQ ID NO: 6050 - protein, 81 aa, Hylobates moloch
MNMEGLVMFQDLSIDFSQEEWECLDAAQKDLYRDVMMENYSSLVSLGLSIPKPDVISLLEQGKEPWMVSRDMLGGWCPDRL

SEQ ID NO: 6051 - protein, 81 aa, Hylobates moloch
MNMEGLVMFQDLSIDFSQEEWECLDAAQKDLYRDVMMENYSSLVSLGLSIPKPDVISLLEQGKEPWMVSRDMLGGWCPDSE

SEQ ID NO: 6052 - protein, 81 aa, Hylobates moloch
MNMEGLVMFQDLSIDFSQEEWECLDAAQKDLYRDVMMENYSSLVSLDSEFRCKTKDSCLPKEIYEATSSQWVRMEKCHSLV

SEQ ID NO: 6053 - protein, 81 aa, Hylobates moloch
MDVMLENYCHLISVGCHITKPDVILKLERGEEPWTSFAGHTCLEENWKAEDFLVKFKEHQEKYSRSVVSINHKKLVKEKSK

SEQ ID NO: 6054 - protein, 81 aa, Hylobates moloch
MAQGSVSFNDVTVDFTQEEWQHLDHAQKTLYMDVMLENYCHLISVGCHITKPDVILKLERGEEPWTSFAGHTCLEENWKAE

SEQ ID NO: 6055 - protein, 81 aa, Hylobates moloch
GESLESRVTLGSLTAESQELLTFKDVSVDFTQEEWGQLAPAHRNLYREVMLENYGNLVSVGYRLSKPGVISQLEKGEEPWL

SEQ ID NO: 6056 - protein, 81 aa, Hylobates moloch
EELHCGLMMEGSTKGSTMYSTLGRISKCNKLESQKENQRMDEGQIPLMCKKTFTQERGQKSNRFEKRINAKSEVMPEPIGL

SEQ ID NO: 6057 - protein, 81 aa, Hylobates moloch
QGESLESRVTLGSLTAESQELLTFKDVSVDFTQEEWGQLAPAHRNLYREVMLENYGNLVSVAGYRLSKPGVISQLEKGEEP

SEQ ID NO: 6058 - protein, 81 aa, Hylobates moloch
MINFQESVTFQDVAVDFTAEEWQLLDCAERTLYWDVMLENYRNLISVGCPITKTKVILKVEQGQEPWMVEGVNPDQSSPEN

SEQ ID NO: 6059 - protein, 81 aa, Hylobates moloch
MINFQESVTFQDVAVDFTAEEWQLLDCAERTLYWDVMLENYRNLISVGCPITKTKVILKVEQGQEPWMVEGVNPDQSSPGW

SEQ ID NO: 6060 - protein, 81 aa, Hylobates moloch
MINFQESVTFQDVAVDFTAEEWQLLDCAERTLYWDVMLENYRNLISVGCPITKTKVILKVEQGQEPWMVEGVNPDQSSPES

SEQ ID NO: 6061 - protein, 81 aa, Hylobates moloch
MLENYSNLVSVGYHVSKPDVIFKLEQGEEPWIMEKFSNQNYPEVDDALEKSKEIQDKHLIQTVFFSNKTLITERENVFGKT

SEQ ID NO: 6062 - protein, 81 aa, Hylobates moloch
MENEKERPVSFQDLTVNFTQEEWQQLDPAQRLLYRDVMLENYSNLVSVGYHVSKPDVIFKLEQGEEPWIMEKFSNQNYPEV

SEQ ID NO: 6063 - protein, 81 aa, Hylobates moloch
LKMKKFQRPVSFQDLTVNFTQEEWQQLDPAQRLLYRDVMLENYSNLVSVGYHVSKPDVIFKLEQGEEPWIMEKFSNQNYPE

SEQ ID NO: 6064 - protein, 81 aa, Hylobates moloch
MNSPSFLYSVHYFKRPVSFQDLTVNFTQEEWQQLDPAQRLLYRDVMLENYSNLVSVGYHVSKPDVIFKLEQGEEPWIMEKF

SEQ ID NO: 6065 - protein, 81 aa, Hylobates moloch
TQNHKAKGLPSNDTDWSQKKETKAQIVVPVTFRDVTVIFTEAEWKRLSPEQRNLYKEVMLENYRNILSLDGGQEQQDAAAY

SEQ ID NO: 6066 - protein, 81 aa, Hylobates moloch
LPSNDTDWSQKKETKAQIVVPVTFRDVTVIFTEAEWKRLSPEQRNLYKEVMLENYRNILSLAEPEPEIYTCSSCLLAFSCQ

SEQ ID NO: 6067 - protein, 81 aa, Hylobates moloch
PSNDTDWSQKKETKAQIVVPVTFRDVTVIFTEAEWKRLSPEQRNLYKEVMLENYRNILSLDRVSLLLPRLECNGAISAHHN

SEQ ID NO: 6068 - protein, 81 aa, Hylobates moloch
AKGLPSNDTDWSQKKETKAQIVVPVTFRDVTVIFTEAEWKRLSPEQRNLYKEVMLENYRNILSLGQEIETILANIVKSHLY

SEQ ID NO: 6069 - protein, 81 aa, Hylobates moloch
KNGENVETMKKLTQNHKAKGLPSNDTDWSQKKETKAQIVVPVTFRDVTVIFTEAEWKRLSPEQRNLYKEVMLENYRNILSL

SEQ ID NO: 6070 - protein, 81 aa, Hylobates moloch
MAEPASVTVTFDDVAFYFSEQEWEILEKWQKQMYRQEMKTNYETLDSLGYAFSKPDLITWMEQGRMLLISEQGCLDKTRRT

SEQ ID NO: 6071 - protein, 81 aa, Hylobates moloch
QEMKTNYETLDSLGYAFSKPDLITWMEQGRMLLISEQGCLDKTRRTTSPPTDEQLNMKNTGKLLRFDDQGTLRTKEGDCRL

SEQ ID NO: 6072 - protein, 81 aa, Hylobates moloch
GGECRLCNSGSCRSWIGVTVTFDDVAFYFSEQEWEILEKWQKQMYRQEMKTNYETLDSLGYAFSKPDLITWMEQGRMLLIS

SEQ ID NO: 6073 - protein, 81 aa, Hylobates moloch
MKTNYETLDSLGYAFSKPDLITWMEQGRMLLISEQGCLDKTRRTTSPPTDEQLNMKNTGKLLRFDDQGTLRTKEGDCRLNG

SEQ ID NO: 6074 - protein, 81 aa, Hylobates moloch
TLCVRGQRGLEERAIPMESITDSPISAQDLLSRIKQEEHQCVWDQQDLADRDIPTDPNSESLISAHDILSWIKQEEQPYPW

SEQ ID NO: 6075 - protein, 81 aa, Hylobates moloch
RNFWILRLPPGSKGEAPKVSRSLENDGVCFTEQEWENLEDWQKELYRNVMESNYETLVSLILLCCPGWSAVTRSWLTATSA

SEQ ID NO: 6076 - protein, 81 aa, Hylobates moloch
PGGAHPAGGVMIKQELQYTQEGPVDLSGEFSCIADEQAFLSPEQTELWGGQGSSVLLETGPGDSTLEEPVGSRDPSSSRTV

SEQ ID NO: 6077 - protein, 81 aa, Hylobates moloch
MAVEFGNQLEGKWAVLGTLLQEYGLLQRRLENVENLLRNRNFWILRLPPGSKGEAPKVSRSLENDGVCFTEQEWENLEDWQ

SEQ ID NO: 6078 - protein, 81 aa, Hylobates moloch
LEEEGPGGAHPAGGVMIKQELQYTQEGPVDLSGEFSCIADEQAFLSPEQTELWGGQGSSVLLETGPGDSTLEEPVGSRDPS

SEQ ID NO: 6079 - protein, 81 aa, Hylobates moloch
RNFWILRLPPGSKGEAPKVPVTFDDVAVYFSELEWGKLEDWQKELYKHVMRGNYETLVSLDYAISKPDILTRLERGEEPCP

SEQ ID NO: 6080 - protein, 81 aa, Hylobates moloch
MARQVSITFKDLAVRFSEEEWRLLEEGQREFYRDVMRENYETLVSVGTAELLPLSAFLSPSDPGRAVGGGSHADEGQEPAG

SEQ ID NO: 6081 - protein, 81 aa, Hylobates moloch
MRENYETLVSVGTAELLPLSAFLSPSDPGRAVGGGSHADEGQEPAGCGGPQGGQPRHSLHLTALVQLVKEIPEFLFGEVKG

SEQ ID NO: 6082 - protein, 81 aa, Hylobates moloch
MEPRESGKAPVTFDDITVYLLQEEWVLLSQQQKELCGSDKPVATLGPTVANPELFCKFGRGPEPWLGSVQGQRSLLEHHPG

SEQ ID NO: 6083 - protein, 81 aa, Hylobates moloch
MTFEDVAVEFTQWEWGQLNPAQKDLYREVMLETFRNLAFLGLLVSKPYVICQLEEGGEPFMVEREISTGAHSDWERRSKSK

SEQ ID NO: 6084 - protein, 81 aa, Hylobates moloch
MAAVSPTTRCQESVTFEDVAVVFTDEEWSHLVPIQRDLYKEVMLENYNSIVSLGLPVPQPDVIFQWKRGDKPWMVDLHGSE

SEQ ID NO: 6085 - protein, 81 aa, Hylobates moloch
ELVSSEEVAVHFTWEEWQDLDDAQGTLYRDVILETYSSLISLGHITKPEMIFKLEQGAEPWILQEAPNLRLSGGSRKRVFS

SEQ ID NO: 6086 - protein, 81 aa, Hylobates moloch
ELVSSEEVAVHFTWEEWQDLDDAQGTLYRDVILETYSSLISLGHITKPEMIFKLEQGAEPWILQEAPNLRLSAVQIIDDLI

SEQ ID NO: 6087 - protein, 81 aa, Hylobates moloch
TLLYIRELPLGKSPMNVMNVENPFIRSQSSLYIIELIPEENLTNVMSVGKPCHKSNLNMHQRTHSGEKPYECDECRKIYHK

SEQ ID NO: 6088 - protein, 81 aa, Hylobates moloch
QMGSIKEKMKAGSRTGKPQEPVTFKDVVVEFSKEEWGQLDSAVKNLYRSVMLENFRNLNSLRKAHLLSKPFESLKLESKKK

SEQ ID NO: 6089 - protein, 81 aa, Hylobates moloch
MAVTFEDVTIIFTWEEWKFLDSSQKSLYREVMWENYTNVMLVENWNESYKSQEEKFRYLEYENFSCWQGWWNAGTQMYENQ

SEQ ID NO: 6090 - protein, 81 aa, Hylobates moloch
SRKNLSMEKEQKLIVQHSYIPVEEALPQYIGVICQKDLLRDSMEEKYCGCNKCKEIYYWNSRCVFHKRNQPGENLYQCSIC

SEQ ID NO: 6091 - protein, 81 aa, Hylobates moloch
AEPSFSWEWPLRELCVLQEPVTFRDVAIYFSREEWACLEPSQRALYRDVMLDNFSSVAALGFCSPRPDLVSRLEQWEEPWV

SEQ ID NO: 6092 - protein, 81 aa, Hylobates moloch
MNTLQGPVSFRDVAVDFTQEEWQQLDPDEKITYRDVMLENYSHLVSVGYDITKPNVIIKLEQGEEPWIVEGEFPCQHSPEV

SEQ ID NO: 6093 - protein, 81 aa, Hylobates moloch
MNTLQGPVSFRDVAVDFTQEEWQQLDPDEKITYRDVMLENYSHLVSVGYDITKPNVIIKLEQGEEPWIVEGEFPCQHSPAA

SEQ ID NO: 6094 - protein, 81 aa, Hylobates moloch
EEEEEDEDEDDLLTAGSQGLVTFEDVAVYFSLEEWERLEADQRGLYQEVMQENYGILVSLGYPIPKPDLIFRLEQGEEPWV

SEQ ID NO: 6095 - protein, 81 aa, Hylobates moloch
MFPPARGKELLSFEDVAMYFTREEWGHLNLGQKDLYRDVMLENYRNMVLLGFQFPKPEVICQLENWDEQWILDLPRAGNRK

SEQ ID NO: 6096 - protein, 81 aa, Hylobates moloch
MELLSFEDVAMYFTREEWGHLNLGQKDLYRDVMLENYRNMVLLGFQFPKPEVICQLENWDEQWILDLPRAGNRKASGSACP

SEQ ID NO: 6097 - protein, 81 aa, Hylobates moloch
EEAVAVVRALQRALNGTSPQGMVTFEDMAVSLTWEEWERLDPARRDFCRESTQKDSGSTVGPSLESRVENKELIPMQQILE

SEQ ID NO: 6098 - protein, 81 aa, Hylobates moloch
DGEEHGKKCKQSFHKVTWHVLKPHKSDSGDSFHHSSLFETQRQLHEERPYKCGNCGKSFKQRSDLFRHQRIHTGEKPYGCQ

SEQ ID NO: 6099 - protein, 81 aa, Hylobates moloch
GEEHGKKCKQSFHKVTWHVLKPHKSDSGDSFHHSSLFETQRQLHEERPYKCGNCGKSFKQRSDLFRHQRIHTGEKPYGCQE

SEQ ID NO: 6100 - protein, 81 aa, Hylobates moloch
SQELTASLLSTGSQKLVKIEEVADVAVSFILEEWGHLDQSQKSLYRDDRKENYGSITSMGYESRDNMELIAKQISDDSESH

SEQ ID NO: 6101 - protein, 81 aa, Hylobates moloch
REGSPGDQAAALLTARYQEFVTFEDVAVHLTREEWGYLDPVQRDLYREVMLENYGNVVSLGFPISKPDGISQLEQDLQVFD

SEQ ID NO: 6102 - protein, 81 aa, Hylobates moloch
KPDGISQLEQDLQVFDLETKTREVLRDDCSDGETREENKLLIPKQKISEEVHSYKVRVGRLKHDITQVPETREVYKSEDRL

SEQ ID NO: 6103 - protein, 81 aa, Hylobates moloch
NECGKAFSQTSCLVQHHRMHRKEKSYECNEYEGSFSHSSDLILQQEVLTRQKAFDCDVWEKNSSQRAHLVQHQSIHTKENS

SEQ ID NO: 6104 - protein, 81 aa, Hylobates moloch
GPGLPTMNPRDQEMAAGFFTAGSQGLGPFKDMALAFPEEEWRHVTPAQIDCFGEYVEPQDCRVSPGGGSKEKEAKPPQEDL

SEQ ID NO: 6105 - protein, 81 aa, Hylobates moloch
EGSPRDQAMASALFTADSQAMVKIEDMAVSLILEEWGCQNLARRNLSRDNRQENYGSAFPQGGENRNENEESTSKAETTED

SEQ ID NO: 6106 - protein, 81 aa, Hylobates moloch
METQADLVSQEPQALLDSALPSKVPAFSNKDSLGDEMLAAALLKAKSQELVTFEDVAVYFIRKEWKRLEPAQRDLYRDVML

SEQ ID NO: 6107 - protein, 81 aa, Hylobates moloch
VPAFSNKDSLGDEMLAAALLKAKSQELVTFEDVAVYFIRKEWKRLEPAQRDLYRDVMLENYGNVFSLDRETRTENDQEISE

SEQ ID NO: 6108 - protein, 81 aa, Hylobates moloch
MGPLTFRDVKIEFSLEEWQCLDTAQRNLYRDVMLENYRNLVFLVMCSHFAQDVWPEQSIKDSFQKVILRTYGKYGHENLQL

SEQ ID NO: 6109 - protein, 81 aa, Hylobates moloch
MGPLTFRDVKIEFSLEEWQCLDTAQRNLYRDVMLENYRNLVFLGIAVSKPDLITWLEQGKEPWNMKRHEMVDKTAVMCSHF

SEQ ID NO: 6110 - protein, 81 aa, Hylobates moloch
GIGGSTAKTPGLPGSLEMGPLTFRDVAIEFSLEEWQCLDTSQQNLYRNVMLDNYRNLVFLGIAVSKPDLITCLEQGKEPCN

SEQ ID NO: 6111 - protein, 81 aa, Hylobates moloch
MEPLTFKDVAIEFSLEEWQCLDTAQRDLYRNVLLENYRNLVFLVMSFHFAQDLWPEQNIKDSFQKVTLRRHGKCEYENLQL

SEQ ID NO: 6112 - protein, 81 aa, Hylobates moloch
MGVLTFRDVAIEFSPEEWECLDSAQQRLYRDVMLENYGNLVSLGLAIFKPDLMTCLEQRKEPWKVKRQEAVAKHPAGSFHF

SEQ ID NO: 6113 - protein, 81 aa, Hylobates moloch
EQRKEPWKVKRQEAVAKHPAGSFHFTAEILPEHDMKDAFRKVILRKYRSCDLNNLHLKKDNQSVGNCKGQKSSYNGLHQCL

SEQ ID NO: 6114 - protein, 81 aa, Hylobates moloch
MANREMELLTFRDIAIEFSLEEWQCLDRAQQNLYREVMLENYRNLVSLGITLSKSDLITCLEQNKEPQNIKRNEMVSKHPV

SEQ ID NO: 6115 - protein, 81 aa, Hylobates moloch
MGVLTFRDVAIEFSPEEWECLDSAQQHLYRDVMLENYGNLFSLGLAIFKPHLITYLEQRKEPWNVKRQKTVAKHPAGSFHF

SEQ ID NO: 6116 - protein, 81 aa, Hylobates moloch
MAKRPGSPGSREMRLLTFRDIAIEFSLVEWQYLDHAQQNLYRDVMLENYRNLVSLGIADSKPDLITCLEQNKEYWNIKRNE

SEQ ID NO: 6117 - protein, 81 aa, Hylobates moloch
MEEKEMNDGSQIVRSQESLTFQDVAVDFTREEWDQLYPAQKNLYRDVMLENYRNLVALGYQLYKPEVIAQLELEEEWVIER

SEQ ID NO: 6118 - protein, 81 aa, Hylobates moloch
GNMEEKEMNDGSQIVRSQESLTFQDVAVDFTREEWDQLYPAQKNLYRDVMLENYRNLVALGYQLYKPEVIAQLELEEEWVI

SEQ ID NO: 6119 - protein, 81 aa, Hylobates moloch
MVHGSVTFRDVAIDFSQEEWECLQPDQRTLYRDVMLENYSHLISLAGSSISKPDVITLLEQEKEPWIVIWSQNMDLRKYLH

SEQ ID NO: 6120 - protein, 81 aa, Hylobates moloch
MVHGSVTFRDVAIDFSQEEWECLQPDQRTLYRDVMLENYSHLISLGSSISKPDVITLLEQEKEPWMVVRKETNRRYPDLES

SEQ ID NO: 6121 - protein, 81 aa, Hylobates moloch
MVHGSVTFRDVAIDFSQEEWECLQPDQRTLYRDVMLENYSHLISLAGSSISKPDVITLLEQEKEPWMVVRKETNRRYPDLE

SEQ ID NO: 6122 - protein, 81 aa, Hylobates moloch
GRSPRKIDQFCNSRNMVHGSVTFRDVAIDFSQEEWECLQPDQRTLYRDVMLENYSHLISLGSSISKPDVITLLEQEKEPWM

SEQ ID NO: 6123 - protein, 81 aa, Hylobates moloch
EESHGALISSCNSRTMTDGLVTFRDVAIDFSQEEWECLDPAQRDLYVDVMLENYSNLVSLDLESTTYETKKIFSEKDIFEI

SEQ ID NO: 6124 - protein, 81 aa, Hylobates moloch
MTKSKEPVTFKDVAVVFSEEELRLLDLAQRKLYRDVMLENFRNVVSVGHQSTPDGLPQLEREEKLRMMKMATQRDNSSGGK

SEQ ID NO: 6125 - protein, 81 aa, Hylobates moloch
MLENFRNVVSVGHQSTPDGLPQLEREEKLRMMKMATQRDNSSGGKNLKEMETLQEVGLRYLPHEELFCSQIWQQVTRELTK

SEQ ID NO: 6126 - protein, 81 aa, Hylobates moloch
HSGLCKFPEVEGKMTTFKEAVTFKDVAVVFTEEELGLMDPAQRKLYRDVMLENFRNLLSVGNQPFHQDTFHFLRKEMFWMI

SEQ ID NO: 6127 - protein, 81 aa, Hylobates moloch
LRKEMFWMIKTTSQREGNSGGKIQIEMETVPEAGPHEEWSCQQIWEQIASDLIRCQNSIRNSSLFFKESDVPCQIEAGLSI

SEQ ID NO: 6128 - protein, 81 aa, Hylobates moloch
EQCEKGYNSKFNLDMHQRVHRGERPYNCKECGKSFGWASCLLKHQRLHSGEKPLKRGVWEEIYSEFTASFTSVTLCGRKAI

SEQ ID NO: 6129 - protein, 81 aa, Hylobates moloch
AQRKLYRDVMLENFRNLLSVGNQPFHQDTFHFLRKEMFWMIKTTSQREGNSGGKIQIEMETVPEAGPHEEWSCQQIWEQIA

SEQ ID NO: 6130 - protein, 81 aa, Hylobates moloch
MTTFKEAVTFKDVAVVFTEEELGLLDPAQRKLYRDVMLENFRNLLSMGHQPFHRDTFHFLREEKFWMMGTATEREGNPGGK

SEQ ID NO: 6131 - protein, 81 aa, Hylobates moloch
LREEKFWMMGTATEREGNPGGKIQTELESVPEAGAHEEWSCQQIWEQIAKDLTRSQDSIINNSQFFENGDVPSQVEAGLPT

SEQ ID NO: 6132 - protein, 81 aa, Hylobates moloch
MIKRSKILVFCSKIMEEAVTFKDVAVVFTEEELGLLDPAQRKLYRDVMLENFRNLLSMGHQPFHRDTFHFLREEKFWMMGT

SEQ ID NO: 6133 - protein, 81 aa, Hylobates moloch
DVMLENFRNLLSMGHQPFHRDTFHFLREEKFWMMGTATEREGNPGGKIQTELESVPEAGAHEEWSCQQIWEQIAKDLTRSQ

SEQ ID NO: 6134 - protein, 81 aa, Hylobates moloch
MTTFKEAVTFKDVAVFFTEEELGLLDPAQRKLYQDVMLENFTNLLSVGHQPFHPFHFLREEKFWMMETATQRDGNSGGKTV

SEQ ID NO: 6135 - protein, 81 aa, Hylobates moloch
NNSDFFEQGDVPSQVEAGLSIIHTGQKPSQNGKCKQSFSDVAIFDLPQQLHSGEKSHTCNECGKSFCYISALRIHQRVHLR

SEQ ID NO: 6136 - protein, 81 aa, Hylobates moloch
MTTFKEAVTFKDVAVFFTEEELGLLDPAQRKLYQDVMLENFTNLLSVGHQPFHPFHFLREEKFWMMETATQRDGNSGKKQA

SEQ ID NO: 6137 - protein, 81 aa, Hylobates moloch
MIDPGEKKPGRRAEEAVTFKDVAVVFTEEELQLLDLAQRKLYRDVMLENFRNLLSVGHQPFHGDTFHFLREEKFWVMETTS

SEQ ID NO: 6138 - protein, 81 aa, Hylobates moloch
GRRAEEAVTFKDVAVVFTEEELQLLDLAQRKLYRDVMLENFRNLLSVGHQPFHGDTFHFLREEKFWVMETTSQREGNSGPL

SEQ ID NO: 6139 - protein, 81 aa, Hylobates moloch
RAKLYEAVTFKDVAVVFTEEELQLLDLAQRKLYRDVMLENFRNLLSVGGKIQTEMETVPEAGTHEEFSCKQIWEQIASDLT

SEQ ID NO: 6140 - protein, 81 aa, Hylobates moloch
HSGLCKFPKVGGKLTMSKEAVTFKDVAVVFTEEELGLLDLAQRKLYRDVMLENFRNLLSVGHQPFHQDTFHFLREEKFWMM

SEQ ID NO: 6141 - protein, 81 aa, Hylobates moloch
LTMSKEAVTFKDVAVVFTEEELGLLDLAQRKLYRDVMLENFRNLLSVGHQPFHQDTFHFLREEKFWMMDIAPQRERNSGGK

SEQ ID NO: 6142 - protein, 81 aa, Hylobates moloch
LTMSKEAVTFKDVAVVFTEEELGLLDLAQRKLYRDVMLENFRNLLSVGHQPFHQDTFHFLREEKFWMMDIAPQRERNSGKK

SEQ ID NO: 6143 - protein, 81 aa, Hylobates moloch
TFKDVAVVFTEEELGLLDLAQRKLYRDVMLENFRNLLSVGHQPFHQDTFHFLREEKFWMMDIAPQRERNSGKKQATVCPCL

SEQ ID NO: 6144 - protein, 81 aa, Hylobates moloch
LTMSKEAVTFKDVAVVFTEEELGLLDLAQRKLYRDVMLENFRNLLSVGHQPFHQDTFHFLREEKFWMMDIAPQRERNSGGS

SEQ ID NO: 6145 - protein, 81 aa, Hylobates moloch
DVAVVFTEEELGLLDLAQRKLYRDVMLENFRNLLSVGHQPFHQDTFHFLREEKFWMMDIAPQRERNSGGSVQASECRNWSK

SEQ ID NO: 6146 - protein, 81 aa, Hylobates moloch
MLENFRNLLSVGHQPFHQDTFHFLREEKFWMMDIAPQRERNSGGKIQPEMKTVPEAGPHEGWSCQQIWEEIASNLTRPQDS

SEQ ID NO: 6147 - protein, 81 aa, Hylobates moloch
MTMFREAVTFKDVAVVFTKEELGLLDLSQRKLYRDVMLENFRNLLSVGHQPSHRDTFHFRREEKFWIMETATQTEGNSGGK

SEQ ID NO: 6148 - protein, 81 aa, Hylobates moloch
RREEKFWIMETATQTEGNSGGKIQTELESVPATGPHEEWSCQQIWEQTASELTRPQDSISSSQFSTQGDVPSQVDAGLSII

SEQ ID NO: 6149 - protein, 81 aa, Hylobates moloch
MTTFKEAMTFKDVAVVFTEEELGLLDLAQRKLYQDVMLENFRNLLSVGHQAFHRDTFHFLREEKIWMMKTATQREGNSGDK

SEQ ID NO: 6150 - protein, 81 aa, Hylobates moloch
HFLREEKIWMMKTATQREGNSGDKIQTEMETVSEAGTHQEWSCQQIWEKIASDLTRSQDLVINSSQFSKEGDFPCQTGEGL

SEQ ID NO: 6151 - protein, 81 aa, Hylobates moloch
DLAQRKLYQDVMLENFRNLLSVGHQAFHRDTFHFLREEKIWMMKTATQREGNSGDKIQTEMETVSEAGTHQEWSCQQIWEK

SEQ ID NO: 6152 - protein, 81 aa, Hylobates moloch
LLSVGHQAFHRDTFHFLREEKIWMMKTATQREGNSGDKIQTEMETVSEAGTHQEWSCQQIWEKIASDLTRSQDLVINSSQF

SEQ ID NO: 6153 - protein, 81 aa, Hylobates moloch
MTTLKEAVTFKDVAVVFTEEELRLLDFAQRKLYREVMLENFRNLLSVGHQPLHRDTFHFLKEEKFWMMETATQREGNLGGK

SEQ ID NO: 6154 - protein, 81 aa, Hylobates moloch
RNLLSVGHQPLHRDTFHFLKEEKFWMMETATQREGNLGGKIQTEMETVPESGTLEGLFSHQTWGQISSDLTRFQDSTVNSF

SEQ ID NO: 6155 - protein, 81 aa, Hylobates moloch
MTTLKEAVTFKDVAVVFTEEELRLLDFAQRKLYREVMLENFRNLLSVGHQPLHRDTFHFLKEEKFWMMETATQREGNLGPA

SEQ ID NO: 6156 - protein, 81 aa, Hylobates moloch
MTTFKEGLTFKDVAVVFTEEELGLLDPVQRNLYRDVMLENFRNLLSVGHHPFKHDVFPLEKEKKLHMMKTAAQRKGKSADK

SEQ ID NO: 6157 - protein, 81 aa, Hylobates moloch
VGHQPFKQDVSPIERNEQLWIMTTATRRQGNLGEKNQSKLITVQDRESEEELSCWQIWQQIANDLTRCQDSMINNSQFHKQ

SEQ ID NO: 6158 - protein, 81 aa, Hylobates moloch
RNEQLWIMTTATRRQGNLGEKNQSKLITVQDRESEEELSCWQIWQQIANDLTRCQDSMINNSQFHKQGDFPCQVGAELSIQ

SEQ ID NO: 6159 - protein, 81 aa, Hylobates moloch
IERNEQLWIMTTATRRQGNLGEKNQSKLITVQDRESEEELSCWQIWQQIANDLTRCQDSMINNSQFHKQGDFPCQVGAELS

SEQ ID NO: 6160 - protein, 81 aa, Hylobates moloch
SRDCDLPQKEQEKMTKFQEAVTFKDVAVVFSREELRLLDLTQRKLYRDVMVENFKNLVAVGHLPFQPDMVSQLEAEEKLWM

SEQ ID NO: 6161 - protein, 81 aa, Hylobates moloch
SRDCDLPQKEQEKMTKFQEAVTFKDVAVVFSREELRLLDLTQRKLYRDVMVENFKNLVAVGSKHQNKMETLQKFALKYLSN

SEQ ID NO: 6162 - protein, 81 aa, Hylobates moloch
MPSRDCDLPQKEQEKMTKFQEAVTFKDVAVVFSREELRLLDLTQRKLYRDVMVENFKNLVAVGHLPFQPDMVSQLEAEEKL

SEQ ID NO: 6163 - protein, 81 aa, Hylobates moloch
PSRDCDLPQKEQEKMTKFQEAVTFKDVAVVFSREELRLLDLTQRKLYRDVMVENFKNLVAVGHLPFQPDMVSQLEAEEKLW

SEQ ID NO: 6164 - protein, 81 aa, Hylobates moloch
MTKFQEAVTFKDVAVAFTEEELGMLDSAQKKLYRDVMLENFRNLVSVGHQSFKPDMISQLEREEKLWMKELQTQRGKHSGD

SEQ ID NO: 6165 - protein, 81 aa, Hylobates moloch
MTKFQEAVTFKDVAVAFTEEELGMLDSAQKKLYRDVMLENFRNLVSVGHQSFKPDMISQLEREEKLWMKELQTQRGDRNQN

SEQ ID NO: 6166 - protein, 81 aa, Hylobates moloch
MVTFKDVAVVFTEEELELLDSVQRKLYRDVMLENFRNLLLVARQPFKPDLISQLEREEKLLMVETEAPRDGCSGRKNQQKM

SEQ ID NO: 6167 - protein, 81 aa, Hylobates moloch
MTKFQEMVTFKDVAVVFTEEELELLDSVQRKLYRDVMLENFRNLLLVARQPFKPDLISQLEREEKLLMVETEAPRDGCSGR

SEQ ID NO: 6168 - protein, 81 aa, Hylobates moloch
EREEKLLMVETEAPRDGCSGRKNQQKMESIQEVTVSYLSPKELSSCQTWQQSAGGLIGCQNFLKVFQGKNSQLQEQGNSLC

SEQ ID NO: 6169 - protein, 81 aa, Hylobates moloch
GPRSLPFSRKRKRKMTKFQEMVTFKDVAVVFTEEELELLDSVQRKLYRDVMLENFRNLLLVARQPFKPDLISQLEREEKLL

SEQ ID NO: 6170 - protein, 81 aa, Hylobates moloch
RQPFKPDLISQLEREEKLLMVETEAPRDGCSGRKNQQKMESIQEVTVSYLSPKELSSCQTWQQSAGGLIGCQNFLKVFQGK

SEQ ID NO: 6171 - protein, 81 aa, Hylobates moloch
HSEASAVSQDREDKIMSQEPLSFKDVAVVFTEEELELLDSTQRQLYQDVMQENFRNLLSVGDKNGKDMEYIQDEELRFFSH

SEQ ID NO: 6172 - protein, 81 aa, Hylobates moloch
HSEASAVSQDREDKIMSQEPLSFKDVAVVFTEEELELLDSTQRQLYQDVMQENFRNLLSVGERSPLGDKNGKDMEYIQDEE

SEQ ID NO: 6173 - protein, 81 aa, Hylobates moloch
TLTSRHEKRALHSEASAVSQDREDKIMSQEPLSFKDVAVVFTEEELELLDSTQRQLYQDVMQENFRNLLSVGERSPLGNWN

SEQ ID NO: 6174 - protein, 81 aa, Hylobates moloch
MIKFQERVTFKDVAAVFTKEELALLDKAQINLYQDVMLENFRNLISVRDGIKNNILNLQAKGLSYLSQEVLHCWQIWKQRI

SEQ ID NO: 6175 - protein, 81 aa, Hylobates moloch
SMEEQDEKPPEPPKACAQEGVNFKIVTVDFTQEEEGTWNPAQRTLDRDVILENDRDLVSWDLATAVGKKDSTSKQRIFDEE

SEQ ID NO: 6176 - protein, 81 aa, Hylobates moloch
IIIKVEGEDTGSLTIPSKEGVNFKIVTVDFTQEEEGTWNPAQRTLDRDVILENDRDLVSWDLATAVGKKDSTSKQRIFDEE

SEQ ID NO: 6177 - protein, 81 aa, Hylobates moloch
AQDSFLPQEIIIKVEGEDTGSLTIPSKEEEGTWNPAQRTLDRDVILENDRDLVSWDLATAVGKKDSTSKQRIFDEEPANGV

SEQ ID NO: 6178 - protein, 81 aa, Hylobates moloch
MDSVVFEEVAVNFTPEEWALLDHAQRSLYRDVMLETCRNLASLDCCIYVRTSGSSSQRDIFGNGISDDEEIVKFTRSDSWS

SEQ ID NO: 6179 - protein, 81 aa, Hylobates moloch
MDSVVFEDVAVDFTLEEWALLDSAQRNLYRDVMLETFRNLASVDDETQFKANGSVSQQDMYGQDKSKEQTIPTFTGNNSCA

SEQ ID NO: 6180 - protein, 81 aa, Hylobates moloch
MDSVVFEDVAVDFTLEEWALLDSAQRNLYRDVMLETFRNLASVGFEMWERTNGSVSQQDMYGQDKSKEQTIPTFTGNNSCA

SEQ ID NO: 6181 - protein, 81 aa, Hylobates moloch
MDTVVFQDVVVDFTLEEWALLNPAQRKLYRDVMLEIFKHLASVDNEAQLKTNGSISQQDTCGEKLSLKQKIEKFTRKNAWA

SEQ ID NO: 6182 - protein, 81 aa, Hylobates moloch; identical to SEQ ID NO: 2427

SEQ ID NO: 6183 - protein, 81 aa, Hylobates moloch
MVTCAHLGRRARLPAAQPSACPGTYFSQEERMAAGYLPRWSQELVTFEDVSVDFSQEEWELLEPAQKNLYREVMLENYRNV

SEQ ID NO: 6184 - protein, 81 aa, Hylobates moloch
YFSQEERMAAGYLPRWSQELVTFEDVSVDFSQEEWELLEPAQKNLYREVMLENYRNVISLEALKNQCTDVGIKEGLLSPAQ

SEQ ID NO: 6185 - protein, 81 aa, Hylobates moloch
EPAQKNLYREVMLENYRNVISLEALKNQCTDVGIKEGLLSPAQTSQVTSLSSWTGYLRFEPVASSHLEQREALWMEEKGTP

SEQ ID NO: 6186 - protein, 81 aa, Hylobates moloch
SPSVQEQNKMNKVEQKFQGSVSFKDVTVGFTQEEWQHLDPSQRALYRDVMLENYSNLVSVGYCVHKPEVIFRLEQGEEPWR

SEQ ID NO: 6187 - protein, 81 aa, Hylobates moloch
MITSQGSVSFRDVTMGFTQEEWQHLDPAQRTLYRNVMLDNYSHLVSVEVILKLEKGKEPWILEEKFGSQSHQGELVSARWN

SEQ ID NO: 6188 - protein, 81 aa, Hylobates moloch
TAAEDKAEKEHGPDLHGEGSVSFSDVAVGFTQEEWQHLDPAQRTLYRDVMLENYSLLLSVGYCTTKPEVVCKLEHEEVLWI

SEQ ID NO: 6189 - protein, 81 aa, Hylobates moloch
VMLENYSLLLSVGYCTTKPEVVCKLEHEEVLWILEEESPSQSHLDCCIDDELMEKRQENQDQHLQKVDFVNNKTLTMDRNG

SEQ ID NO: 6190 - protein, 81 aa, Hylobates moloch
MAPRAQIQGPLTFGDVAVAFTWIEWRHLDAAQRALYRDVMLENYGNLVSVGLLSSKPKLITQLEQGAEPWTEVREAPSGTH

SEQ ID NO: 6191 - protein, 81 aa, Hylobates moloch
RDVMLENYGNLVSVGLLSSKPKLITQLEQGAEPWTEVREAPSGTHAVQDYWFETKMSALKQSTSEGSVLGGRMKSVMMEKG

SEQ ID NO: 6192 - protein, 81 aa, Hylobates moloch
MLENYSNLVSVGYCVHKPEVIFRLEQGEEPWRLEEEFPSQSFPEVWTADHLKERSQENQSKHVWEVVFINNEMLTKEQGDV

SEQ ID NO: 6193 - protein, 81 aa, Hylobates moloch
MNKVEQKFQGSVSFKDVTVGFTQEEWQHLDPSQRALYRDVMLENYSNLVSVGYCVHKPEVIFRLEQGEEPWRLEEEFPSQS

SEQ ID NO: 6194 - protein, 81 aa, Hylobates moloch
MNKSQEQVSFKDVCVDFTQEEWYLLDPAQKILYRDVILENYSNLVSVGYCITKPEVIFKIEQGEEPWILEKGFPSQWHPER

SEQ ID NO: 6195 - protein, 81 aa, Hylobates moloch
WPERGPAAPRHQEMASASPFLSAWSQVPVNLEDMAVYLSGEEPGCLDPAQRDTPLENEGPGIQLEDGGDGREDAPVRMEWY

SEQ ID NO: 6196 - protein, 81 aa, Hylobates moloch
MASMPPTPEAQGPILFEDLAVYFSQEECVTLHPAQRSLSKDATKESLEDAALMGEEGKPEINQQLSLESMELDELALEEYP

SEQ ID NO: 6197 - protein, 81 aa, Hylobates moloch
QNTGLHDQETGAVVWTAGSQGPATCDNRAVSLCQQEWMCPGPAQRALYRGATQRKDRHVSLATGVPWGYEETKTLLAILSS

SEQ ID NO: 6198 - protein, 81 aa, Hylobates moloch
TCDNRAVSLCQQEWMCPGPAQRALYRGATQRKDRHVSLATGVPWGYEETKTLLAILSSSQFYGKLQTCQQNSQIYRAMAEG

SEQ ID NO: 6199 - protein, 81 aa, Hylobates moloch
ENGEEAVALVEDVQRAPGQQGPATCDNRAVSLCQQEWMCPGPAQRALYRGATQRKDRHVSLATGVPWGYEETKTLLAILSS

SEQ ID NO: 6200 - protein, 81 aa, Hylobates moloch
MYFSQEEWELLDPTQKALYNDVMQENYETVISLALFVLPKPKVISCLEQGEEPWVQVSPEFKDSAGKSPTGLQLKNDTEKH

SEQ ID NO: 6201 - protein, 81 aa, Hylobates moloch
QTTTKDWTVTPEHVLPESQSLLTFEEVAMYFSQEEWELLDPTQKALYNDVMQENYETVISLALFVLPKPKVISCLEQGEEP

SEQ ID NO: 6202 - protein, 81 aa, Hylobates moloch
LFPPEGNVEDKEMTGPQLPESLEDVAMYISQEEWGHQDPSKRVLSRDTVQESYENVDSLESHIPSQEVPGTQVGQGGKLWD

SEQ ID NO: 6203 - protein, 81 aa, Hylobates moloch
PLVKLLPKGVQREQDTVSLYLKANPEELVVFEDLNVFHCQEECVSLDPTQQLTSEKEDDSSVGEMMLLVNGSNPEGEDPER

SEQ ID NO: 6204 - protein, 81 aa, Hylobates moloch
PLVKLLPKGVQREQDTVSLYLKANPEELVVFEDLNVFHCQEECVSLDPTQQLTSEKEDDSSVGEMMLLAVNGSNPEGEDPE

SEQ ID NO: 6205 - protein, 81 aa, Hylobates moloch
LKEGCTRETTDTCFVSGVHGPVALGDIPFYFSQEEWGTLDPAQRDLFWDIKRENSRNTTLGLGLKGQSEKSRLQEVVPVVP

SEQ ID NO: 6206 - protein, 81 aa, Hylobates moloch
SRNTTLGLGLKGQSEKSRLQEVVPVVPGQTGSDVTVSWSPEEAEGWESENRPRAALGPVVGARRGRPPTRRRQFRDLAAEK

SEQ ID NO: 6207 - protein, 81 aa, Hylobates moloch
QHSHSAQPPALLKEGCTRETTDTCFVSGVHEEWGTLDPAQRDLFWDIKRENSRNTTLGLGLKGQSEKSRLQEVVPVVPGQT

SEQ ID NO: 6208 - protein, 81 aa, Hylobates moloch
EGRTRDRQMAAALLTAWSQMPVTFEDVALYLSREEWGRLDHTQQNFYRDVLQKENGLSLGFPFSRPFWAPQAHGKGEASGS

SEQ ID NO: 6209 - protein, 81 aa, Hylobates moloch
EGRTRDRQMAAALLTAWSQMPVTFEDVALYLSREEWGRLDHTQQNFYRDVLQKENGLSLGAVEMGQRVPTSSAAALGDVKP

SEQ ID NO: 6210 - protein, 81 aa, Hylobates moloch
MLVAAAAERNKDPILHVLRQYLDPAQRGVRVLEVASGSGQHAAHFARAFPLAEWQPSDVDQRCLDRNPEWGLRDTALLEDL

SEQ ID NO: 6211 - protein, 81 aa, Hylobates moloch
VLRQYLDPAQRGVRVLEVASGSGQHAAHFARAFPLAEWQPSDVDQRCLDRNPEWGLRDTALLEDLGQASGLLLERMVDMPA

SEQ ID NO: 6212 - protein, 81 aa, Hylobates moloch
RGVRVLEVASGSGQHAAHFARAFPLAEWQPSDVDQRCLDRNPEWGLRDTALLEDLGQASGLLLERMVDMPANNKCLIFRKN

SEQ ID NO: 6213 - protein, 81 aa, Hylobates moloch
PRGKHAFQAGWLNDLVTKESMTFKDVAVDITQEDWELMRPVQKELYKTVTLQNYWNMVSLGLTVYRPTVIPILEEPWMVIK

SEQ ID NO: 6214 - protein, 81 aa, Hylobates moloch
TQPDEDLHLQVEETQLVKESVTFKDVAIDFTLEEWRLMDPTQRNLHKDVMLENYRNLVSLGLAVSKPDMISHLENGKGPWV

SEQ ID NO: 6215 - protein, 81 aa, Hylobates moloch
PEVTQPDEDLHLQVEETQLVKESVTFKDVAIDFTLEEWRLMDPTQRNLHKDVMLENYRNLVSLGLAVSKPDMISHLENGKG

SEQ ID NO: 6216 - protein, 81 aa, Hylobates moloch
FQEKITEEGEVAALHLTARSQETVTFKDVAMDFTPEEWGKLDPAQRDVMLENYRNLVSLWLPVSKPENHNLEHGKEPLKLE

SEQ ID NO: 6217 - protein, 81 aa, Hylobates moloch
EGEVAALHLTARSQETVTFKDVAMDFTPEEWGKLDPAQRDVMLENYRNLVSLWLPVSKPENHNLEHGKEPLKLERKAPKSS

SEQ ID NO: 6218 - protein, 81 aa, Hylobates moloch
ASQPAPLEERLIRDQDLGASLLPAAPQEQWRHLDSTQKEQYWDLMLETYGKMVSGAGISHSKSDLTNSIEYGEELAGLYLH

SEQ ID NO: 6219 - protein, 81 aa, Hylobates moloch
ASQPAPLEERLIRDQDLGASLLPAAPQEQWRHLDSTQKEQYWDLMLETYGKMVSGGISHSKSDLTNSIEYGEELAGLYLHV

SEQ ID NO: 6220 - protein, 81 aa, Hylobates moloch
AASQPAPLEERLIRDQDLGASLLPAAPQWRHLDSTQKEQYWDLMLETYGKMVSGGISHSKSDLTNSIEYGEELAGLYLHVN

SEQ ID NO: 6221 - protein, 81 aa, Hylobates moloch
ASQPAPLEERLIRDQDLGASLLPAAPQEQWRHLDSTQKEQYWDLMLETYGKMVSGGDRQENDKENLNLENHRDQELLHASC

SEQ ID NO: 6222 - protein, 81 aa, Hylobates moloch
VLFQEATAFEDMTKDWNYLEGSQKDCYRDTMLDSYENMVPQGSFLQFSMMPQRAGNDPPGVSNASEMEMEISTMREKFLMS

SEQ ID NO: 6223 - protein, 81 aa, Hylobates moloch
LQGKYGNVTKEVIVLYLTLCKQCHQKNPVPKRGLAPKPMTFKDIDSTCQVEIFDMQSSADGEFKFILYYQDHLTKFIILRP

SEQ ID NO: 6224 - protein, 81 aa, Hylobates moloch
LFSPGPKTVWSLWQQPVLFQEATAFEDMTKDWNYLEGSQKDCYRDTMLDSYENMVPQGSFLQFSMMPQRAGNDPPGVSNAS

SEQ ID NO: 6225 - protein, 81 aa, Hylobates moloch
ENSKEDKMVAVCPNTESCESITLKDVAVNFSRGEWKKLEPFQKELYKEVLLENLRNLEFLDFPVSKLELISQLKWVELPWL

SEQ ID NO: 6226 - protein, 81 aa, Hylobates moloch
MNTFQASVSFQDVTVEFSQEEWQHLGPVERTLYRDVMLENYSHLVSVGYCFTKPELIFTLEQGEDPWLLEKEKGFLSRNSP

SEQ ID NO: 6227 - protein, 81 aa, Hylobates moloch
PLRFSTLFQEQQKMNISQASVSFKDVTIEFTQEEWQQMAPVQKNLYRDVMLENYSNLISVGYCHFKPEVIFKLEHGEEPWF

SEQ ID NO: 6228 - protein, 81 aa, Hylobates moloch
EFTQEEWQQMAPVQKNLYRDVMLENYSNLISVGYCHFKPEVIFKLEHGEEPWFSEEEFSNQSHPSELLSSSRHNSAGVVRL

SEQ ID NO: 6229 - protein, 81 aa, Hylobates moloch
PTSASRVAGITGTHHNAQASVSFKDVTIEFTQEEWQQMAPVQKNLYRDVMLENYSNLISVGYCHFKPEVIFKLEHGEEPWF

SEQ ID NO: 6230 - protein, 81 aa, Hylobates moloch
MAPGLLTTREEALMAFWDVAVAFTQKEWKLLSSAQRTLYREVMLENYSHLVSVGIAFSKPKLIKQLEQGDEPWREENEHLD

SEQ ID NO: 6231 - protein, 81 aa, Hylobates moloch
REVMLENYSHLVSVGIAFSKPKLIKQLEQGDEPWREENEHLDLCPAQTPSSWLLDKQQAKQMFLRQGLIGLSWSKSKGAVP

SEQ ID NO: 6232 - protein, 81 aa, Hylobates moloch
LLSSAQRTLYREVMLENYSHLVSVGIAFSKPKLIKQLEQGDEPWREENEHLDLCPESRSVAQAGVQWHDLGSLQPLPPGFK

SEQ ID NO: 6233 - protein, 81 aa, Hylobates moloch
YREVMLENYSHLVSVGIAFSKPKLIKQLEQGDEPWREENEHLDLCPGEWEALGRRACRAVRSSAGKEGGAVFEVLGGSSSG

SEQ ID NO: 6234 - protein, 81 aa, Hylobates moloch
LENYSHLVSVGIAFSKPKLIKQLEQGDEPWREENEHLDLCPGEWEALGRRACRAVRSSAGKEGGAVFEVLGGSSSGLLGHW

SEQ ID NO: 6235 - protein, 81 aa, Hylobates moloch
MTKSLESVSFKDITVDFSRDEWQQLDLAQKSLYREVMLENYFNLISVGCQVPKPEVIFSLEQEEPCMLDGEIPSQSRLDGD

SEQ ID NO: 6236 - protein, 81 aa, Hylobates moloch
MAVDLLPTQEHVTFRDVAVFFSQDEWLHLDSAQRALYREVMLENYSSLVSLGIPFSMPKLIHQLQQGEDPCMVEREVSADT

SEQ ID NO: 6237 - protein, 81 aa, Hylobates moloch
MARRLLPAQVQESVTFRDVAVFFSQDEWLHLDSAQRALYREVMLENYSILVSLGILFSKPKVISQLEQGEDPWMVESGVPQ

SEQ ID NO: 6238 - protein, 81 aa, Hylobates moloch
MAVSHLPTMVQESVTFKDVAVLFTQEEWGQLSPAQRALYRDVMLENYSNLVSLGLLGPKPDMFSQLEKREVWMPEDTPGGF

SEQ ID NO: 6239 - protein, 81 aa, Hylobates moloch
MAAGQREARPQVSLTFEDVAVLFTRDEWRKLAPSQRNLYRDVMLENYRNLVSLGLSFTKPKVISLLQQGEDPWKVEKDSSG

SEQ ID NO: 6240 - protein, 81 aa, Hylobates moloch
MLENYSHLVSMGYPVSKPDVISKLEQGEEPWIIKGDISNWIYPDEYQADGRQDRKSKLHNSQACILGTVSFHHKILKGVTR

SEQ ID NO: 6241 - protein, 81 aa, Hylobates moloch
ADPSSSGPLEEQKMMKSQGLVSFKDVAVDFTQEEWQQLDPSQRTLYRDVMLENYSHLVSMGYPVSKPDVISKLEQGEEPWI

SEQ ID NO: 6242 - protein, 81 aa, Hylobates moloch
MGLVSFKDVAVDFTQEEWQQLDPSQRTLYRDVMLENYSHLVSMGYPVSKPDVISKLEQGEEPWIIKGDISNWIYPDEYQAD

SEQ ID NO: 6243 - protein, 81 aa, Hylobates moloch
MLENYGNVASLGFPLLKPAVISQLEGGGDLGGPSPLAAGTGLQGLRTDIQTDNDLTKEMYEGKENVSFVLQRDFSQETDFS

SEQ ID NO: 6244 - protein, 81 aa, Hylobates moloch
MAAIHLTAWPQKSVTFEDVAVYFTQAEWDGLSPAQRTLYRDVMLENYGNVASLGFPLLKPAVISQLEGGGDLGGPSPLAAG

SEQ ID NO: 6245 - protein, 81 aa, Hylobates moloch
MLENYGNVASLGFPLLKPAVISQLEGGGDLGGPSPLAAGTGLQGLRTDGVSLCHPNWSAVARTWLTATSVSWVRAILLPQP

SEQ ID NO: 6246 - protein, 81 aa, Hylobates moloch
IHLTAWPQKSVTFEDVAVYFTQAEWDGLSPAQRTLYRDVMLENYGNVASLGFPLLKPAVISQLEGGGDLGGPSPLAAGTGL

SEQ ID NO: 6247 - protein, 81 aa, Hylobates moloch
MLENYGNVASLGFPLLKPAVISQLEGGVDIQTDNDLTKEMYEGKENVSFVLQRDFSQETDFSEASLLEKQQEFYSARNIKK

SEQ ID NO: 6248 - protein, 81 aa, Hylobates moloch
QLEGGVDIQTDNDLTKEMYEGKENVSFVLQRDFSQETDFSEASLLEKQQEFYSARNIKKEKSNTIDGTVKDETSPVEECFF

SEQ ID NO: 6249 - protein, 81 aa, Hylobates moloch
MAAMPLKARYQEMVTFEDVAVHFTKTEWTGLSPAQRALYRSVMLENFGNLTALGYPVPKPALISLLEGGDMDWGLEAQDDP

SEQ ID NO: 6250 - protein, 81 aa, Hylobates moloch
MVTFEDVAVHFTKTEWTGLSPAQRALYRSVMLENFGNLTALGYPVPKPALISLLEGGDMDWGLEAQDDPPAERTKNVCKVI

SEQ ID NO: 6251 - protein, 81 aa, Hylobates moloch
MPLKARYQEMVTFEDVAVHFTKTEWTGLSPAQRALYRSVMLENFGNLTALGYPVPKPALISLLEGGDMDWGLEAQDDPPAE

SEQ ID NO: 6252 - protein, 81 aa, Hylobates moloch
MGLFSFRDVAVEFSLEEWEHLEPAQKNLYQDVMLENYRNLVSLGLVVSKPDLITFLEQRKESWNVKSEETVAIQPDVFSHY

SEQ ID NO: 6253 - protein, 81 aa, Hylobates moloch
MLENYRNLVSLGLVVSKPDLITFLEQRKESWNVKSEETVAIQPDVFSHYNKDLLTEHCTEASFQKVISRRHGNCDRENLHL

SEQ ID NO: 6254 - protein, 81 aa, Hylobates moloch
MGLLTFRDVAIEFSREEWEHLDSNQKLLYGDVMLENYRNLVSLGLAVSKPDLITFLEQRKEPWNVKSEETVAIQPEIFSHD

SEQ ID NO: 6255 - protein, 81 aa, Hylobates moloch
MGLLTFRDVAIEFSREEWEHLDSNQKLLYGDVMLENYRNLVSLGLAVSKPDLITFLEQRKEPWNVKSEETVAIQPEVKVNT

SEQ ID NO: 6256 - protein, 81 aa, Hylobates moloch
EVTEHLTGWAPAPVPSVEGLLTFRDVAIEFSREEWEHLDSNQKLLYGDVMLENYRNLVSLGLAVSKPDLITFLEQRKEPWN

SEQ ID NO: 6257 - protein, 81 aa, Hylobates moloch
PDLITFLEQRKEPWNVKSEETVAIQPEIFSHDTQVLLRKKLIEASFQKVILDGYGSCGPQNLNLRKEWESEEKNQYNKSDT

SEQ ID NO: 6258 - protein, 81 aa, Hylobates moloch
PAQGPGEARPSRKRGRRPRALKFVDVAVYFSPEEWGCLRPAQRALYRDVMRETYGHLGALGCAGPKPALISWLERNTDDWE

SEQ ID NO: 6259 - protein, 81 aa, Hylobates moloch
PAHVPGEAGPRRTRESRLGAVSFADVAVDFSPEEWGCLRPAQRALYRDVMRETFGHLGALGFSGPKPAFISWMEGEVEAWS

SEQ ID NO: 6260 - protein, 81 aa, Hylobates moloch
ALLLAPRPGETRPGCRKPGAVSFADVAVYFSPEEWGCLRPAQRALYRDVMRETYGHLGALGFPGPKPALISWMEQESEAWS

SEQ ID NO: 6261 - protein, 81 aa, Hylobates moloch
APLPPRDPNGAGPKWREPGAVNFADVAVYFCREEWGCLRPAQRALYRDVMRDTYGHLSALGIGGHKPALISWVEEEAELWG

SEQ ID NO: 6262 - protein, 81 aa, Hylobates moloch
SPLPPRDPNRAGLEWRKPGAVSFADVAVYFSREEWGCLRPAQRALYRDVMRETYGHLGALGESPNCSPGPCALTGPAAPLG

SEQ ID NO: 6263 - protein, 81 aa, Hylobates moloch
SPLPPRDPNRAGLEWRKPGAVSFADVAVYFSREEWGCLRPAQRALYRDVMRETYGHLGALGVGGSKPALISWVEEKAELWG

SEQ ID NO: 6264 - protein, 81 aa, Hylobates moloch
EAGSLHSGHQEQLNRKREHRPLPKNARPSPWVPALADEWNTLDQEVTTTQLPAGSQEPVKDIHVARGFSYKKNVHQIPAHR

SEQ ID NO: 6265 - protein, 81 aa, Hylobates moloch
TLDQEVTTTQLPAGSQEPVKDIHVARGFSYKKNVHQIPAHRDLYRDFRKENIGNVVSLGSTVSTSNKITRLEQRKEPWTLG

SEQ ID NO: 6266 - protein, 81 aa, Hylobates moloch
GGRQMSSEHVQDKPNQVQGSVSFTDVTVDFTQEEWEQLDPSQRILYMDVMLENYSNLLSVEVWKADDQMERDHRNPDEQAR

SEQ ID NO: 6267 - protein, 81 aa, Hylobates moloch
EQTQAAGMVAGCLINCYQDLVTFDDVAVDFTQEEWTLLDPSQRDLYRDVMLENYENLASVGHDLFKPNVICWLEEEEELRA

SEQ ID NO: 6268 - protein, 81 aa, Hylobates moloch
MAAPDLAHGGHVSRDSICLHEEQTQAAGMVAGCLINCYQDLVTFDDVAVDFTQEEWTLLDPSQRDLYRDVMLENYENLASV

SEQ ID NO: 6269 - protein, 81 aa, Hylobates moloch
MLENYENLASVGHDLFKPNVICWLEEEEELRAGRRGVLQEWRLKTKGPALWQDRSWLRTSNETQTARSHNGGQLCDCTQCG

SEQ ID NO: 6270 - protein, 81 aa, Hylobates moloch
MEPLTFRDVAIEFSPEEWKCLDPAQQNLFRDVMLENYRNLVSLAVCSHFTQDHWPVQGIEDSFHKLILRRYEKCGHDNLQL

SEQ ID NO: 6271 - protein, 81 aa, Hylobates moloch
AIEFSPEEWKCLDPAQQNLFRDVMLENYRNLVSLAVCSHFTQDHWPVQGIEDSFHKLILRRYEKCGHDNLQLRKGCKSLNE

SEQ ID NO: 6272 - protein, 81 aa, Hylobates moloch
MLENYRNLVSLAMCSHFTQDFLPVQGIEDSFHKLILRRYEKYGHDNLQLRKDCKSMSVCKVQKGVYSGINQCLSNTQSKIF

SEQ ID NO: 6273 - protein, 81 aa, Hylobates moloch
MLENYRNLVSLGVAISNPDLVTCLEQRKEPYNVKIHKIVARPPAMCSHFTQDFLPVQGIEDSFHKLILRRYEKYGHDNLQL

SEQ ID NO: 6274 - protein, 81 aa, Hylobates moloch
MELLTFRDVAIEFSPEEWKCLDPAQQNLYRDVMLENYRNLVSLGVAISNPDLVTCLEQRKEPYNVKIHKIVARPPAMCSHF

SEQ ID NO: 6275 - protein, 81 aa, Hylobates moloch
MELLTFRDVAIEFSPEEWKCLDSAQQSLYRDVMLENYRNLVSLGVAISNPDLVIYLEQRKEPYKVKIHETVAKHPAMCSHF

SEQ ID NO: 6276 - protein, 81 aa, Hylobates moloch
ELLTFRDVAIEFSPEEWKCLDSAQQSLYRDVMLENYRNLVSLGVAISNPDLVIYLEQRKEPYKVKIHETVAKHPAMCSHFT

SEQ ID NO: 6277 - protein, 81 aa, Hylobates moloch
MELLTFRDVAIEFSPEEWKCLDPAQQNLYRDVMLENYRNLVSLGVTISNPDLVTCLEQRKEPYNLKIHETAARPPGHYRKT

SEQ ID NO: 6278 - protein, 81 aa, Hylobates moloch
MELLTFRDVAIEFSPEEWKCLDPAQQNLYRDVMLENYRNLVSLGVTISNPDLVTCLEQRKEPYNLKIHETAARPPAVCSHF

SEQ ID NO: 6279 - protein, 81 aa, Hylobates moloch
MLENYRNLVSLGVTISNPDLVTCLEQRKEPYNLKIHETAARPPAVCSHFTQNLWTVQGIEDSFQELIPKGHEKRGHENLRK

SEQ ID NO: 6280 - protein, 81 aa, Hylobates moloch
MELLTFRDVAIEFSPEEWKCLDPAQQNLYRDVMLENYRNLVSLAICSPFSQDLSPVQGTEDSFHRLILRRYEKCGHENLQL

SEQ ID NO: 6281 - protein, 81 aa, Hylobates moloch
MNMSQASVSFQDVTVEFTQEEWQHLGPVERTLYREVMLENYSRLVSVGYCITKPMIYKLEQGAEPWSLDDEFLNQRYPGYF

SEQ ID NO: 6282 - protein, 81 aa, Hylobates moloch
MLENYSRLVSVGYCITKPMIYKLEQGAEPWSLDDEFLNQRYPGYFKVDHIKGIREKQEKPLWQEIFINDADKTLNKEGQVL

SEQ ID NO: 6283 - protein, 81 aa, Hylobates moloch
GSSGDQEMTATLLTAGFQTLEKIEDMAVSLIREEWLLDPSQKDLNRDNRPENFRNVFSLGGETRNENRELASKQVISTGIQ

SEQ ID NO: 6284 - protein, 81 aa, Hylobates moloch
GGCCREDAMVASRLTPGSQGLLKMEDVALTLTPGWTQLDSSQVNLYRDEKQENHSSLVSLGDGIQTKSRDLPPVKKLPEKE

SEQ ID NO: 6285 - protein, 81 aa, Hylobates moloch
GGCCREDAVVASRLTLESQGLLKVEDVALTLTPEWTQQDSSQGNLYRDEKQENHGSLVSLGDEKQTKSRDLPPAEELPEKE

SEQ ID NO: 6286 - protein, 81 aa, Hylobates moloch
GSQGNLPQADITLMSQAQESVTFEDVAVNFTNREWQCLTYAQRHLYKDVMLENYRNMASLGFPFPKPPLISHLEREVDPCV

SEQ ID NO: 6287 - protein, 81 aa, Hylobates moloch
ADITLMSQAQDSRSILFQESVTFEDVAVNFTNREWQCLTYAQRHLYKDVMLENYRNMASLGFPFPKPPLISHLEREVDPCV

SEQ ID NO: 6288 - protein, 81 aa, Hylobates moloch
EQLKPVEPRDCWREAWVKKKPVTFEDVAVNFTQEEWDCLDASQRVLYQDVMSETFKNLTSVARIFLHKPELITKLEQEEEQ

SEQ ID NO: 6289 - protein, 81 aa, Hylobates moloch
PVQKMLPWVGEVSATLQEAMKRDCWREAWVKKKPVTFEDVAVNFTQEEWDCLDASQRVLYQDVMSETFKNLTSVGVKDLSH

SEQ ID NO: 6290 - protein, 81 aa, Hylobates moloch
DVSDSEVWLDSHLGSPGLKVAGSTFQNDCLSEETVVPKTFKDLAQGCKELGSSGLDCQPLESQKESAEGTSRRCEGCGKGV

SEQ ID NO: 6291 - protein, 81 aa, Hylobates moloch
MEVVTFGDVAVHFSREEWQCLDPGQRALYREVMLENHSSVAGLAFSDPTLWFGYLCPCFPHDGNLWAWPSRGSAAFPGFLV

SEQ ID NO: 6292 - protein, 81 aa, Hylobates moloch
MAMALPMPGPQEAVVFEDVAVYFTRIEWGCLAPDQQALYRDVMLENYGNLASLGFLVAKPALISLLEQGEEPGALILQVAE

SEQ ID NO: 6293 - protein, 81 aa, Hylobates moloch
MAMALPMPGPQEAVVFEDVAVYFTRIEWGCLAPDQQALYRDVMLENYGNLASLALISLLEQGEEPGALILQVAEQSVAKAS

SEQ ID NO: 6294 - protein, 81 aa, Hylobates moloch
ENYGNLASLALISLLEQGEEPGALILQVAEQSVAKASLCTDSRMEAGIMESPLQRKLSRQAGLPGTVWGCLPRGHPAPPHP

SEQ ID NO: 6295 - protein, 81 aa, Hylobates moloch
LRKPNPQAMAALFLSAPPQAEVTFEDVAVFLSREEWGRLGPAQRGLYRDVMLETYGNLVSLALGTRTEYKELTSRKTFGEE

SEQ ID NO: 6296 - protein, 81 aa, Hylobates moloch
MAALFLSAPPQAEVTFEDVAVFLSREEWGRLGPAQRGLYRDVMLETYGNLVSLGVGPAGPKPGVISQLEQGDEPWVLDVQG

SEQ ID NO: 6297 - protein, 81 aa, Hylobates moloch
RKPNPQAMAALFLSAPPQAEVTFEDVAVFLSREEWGRLGPAQRGLYRDVMLETYGNLVSLGVGPAGPKPGVISQLEQGDEP

SEQ ID NO: 6298 - protein, 81 aa, Hylobates moloch
MAALFLSAPPQAEVTFEDVAVFLSREEWGRLGPAQRGLYRDVMLETYGNLVSLALGTRTEYKELTSRKTFGEEDPQGSEPV

SEQ ID NO: 6299 - protein, 81 aa, Hylobates moloch
MAATLQLPGHQEMPLTFQDVAVYFSQAEGQQLGPQQRALYRDVMLENYGNVASLGFPVPKPELISQLEQGKELWVLNLLGA

SEQ ID NO: 6300 - protein, 81 aa, Hylobates moloch
AAHAHRMAATLQLPGHQEMPLTFQDVAVYFSQAEGQQLGPQQRALYRDVMLENYGNVASLGFPVPKPELISQLEQGKELWV

SEQ ID NO: 6301 - protein, 81 aa, Hylobates moloch
MDVAQEPVTFRDVAIYFSREEWACLEPSQRALYRDVMLDNFSSVAALGFCSPRPDLVSRLEQWEEPWVEDQERPELQAVQR

SEQ ID NO: 6302 - protein, 81 aa, Hylobates moloch
MDVAQEPVTFRDVAIYFSREEWACLEPSQRALYRDVMLDNFSSVAALAPDQTSSLAWNSGRSRGLKTRRDLSSRQCRGGPG

SEQ ID NO: 6303 - protein, 81 aa, Hylobates moloch
FPVSSRCFQEQQETKKSLDMVSFEEVAVHFTWEEWQNLDDAQRTLYRDVMLETYSSLVSLGHHITKPEMIFKLEQGAEPWI

SEQ ID NO: 6304 - protein, 81 aa, Hylobates moloch
MAATLLMAGSQAPVTFEDMAMYLTREEWRPLDPAQRDLYRDVMQENYGNVVSLDFEIRSENEVNPKQEISEDVQFGTTSER

SEQ ID NO: 6305 - protein, 81 aa, Hylobates moloch
MGPLQFRDVAIEFSLEEWHCLDTAQRNLYRNVMLENYRNLVFLGIVISKPDLITCLEQGKKPLTMKKHEMVANPSVMCSHF

SEQ ID NO: 6306 - protein, 81 aa, Hylobates moloch
MGPLQFRDVAIEFSLEEWHCLDTAQRNLYRNVMLENYRNLVFLGIVISKPDLITCLEQGKKPLTMKKHEMVANPSETGFHH

SEQ ID NO: 6307 - protein, 81 aa, Hylobates moloch
MGPLQFRDVAIEFSLEEWHCLDTAQRNLYRDVMLENYRNLVFLGITVSKPDLITCLEQGKKPLTMKRNEMIAKPPVMCSHF

SEQ ID NO: 6308 - protein, 81 aa, Hylobates moloch
MGPLQFRDVAIEFSLEEWHCLDTAQRNLYRDVMLENYRNLVFLGITVSKPDLITCLEQGKKPLTMKRNEMIAKPPVSFLQV

SEQ ID NO: 6309 - protein, 81 aa, Hylobates moloch
MGPLQFRDVAIEFSLEEWHCLDTAQRNLYRNVMLENYRNLVFLGIVVSKPDLITRLEQGKKPSTMKRCEMVANPSEMVFHH

SEQ ID NO: 6310 - protein, 81 aa, Hylobates moloch
MGPLQFRDVAIEFSLEEWHCLDTAQRNLYRNVMLENYRNLVFLGIVVSKPDLITRLEQGKKPSTMKRCEMVANPSVLCSHF

SEQ ID NO: 6311 - protein, 81 aa, Hylobates moloch
GPLQFRDVAIEFSLEEWHCLDTAQRNLYRNVMLENYRNLVFLGIVVSKPDLITRLEQGKKPSTMKRCEMVANPSEMVFHHV

SEQ ID NO: 6312 - protein, 81 aa, Hylobates moloch
MGPLSFRDVAIEFSLKEWQCLDTAQQNLYRNVMLENYRNLVFLGIAVSKPDLITCLEQGKEAWSMKRHEIMVAKPAVVCSH

SEQ ID NO: 6313 - protein, 81 aa, Hylobates moloch
MLENYRNLVFLGIAVSKPDLITCLEQGKEAWSMKRHEIMVAKPAVVCSHFAQDLWPEQNIKDYFQKATLKRYGKCRHENLP

SEQ ID NO: 6314 - protein, 81 aa, Hylobates moloch
MGPLSFRDVAIEFSLKEWQCLDTAQQNLYRNVMLENYRNLVFLDLITCLEQGKEAWSMKRHEIMVAKPAVVCSHFAQDLWP

SEQ ID NO: 6315 - protein, 80 aa, Hylobates moloch
MGPLSFRDVAIEFSLKEWQCLDTAQQNLYRNVMLENYRNLVFLGIAVSKPDLITCLEQGKEAWSMKRHEIMVAKPAAYFV

SEQ ID NO: 6316 - protein, 81 aa, Hylobates moloch
MGPLSFRDVAIEFSLKEWQCLDTAQQNLYRNVMLENYRNLVFLGIAVSKPDLITCLEQGKEAWSMKRHEIMVAKPADGVSR

SEQ ID NO: 6317 - protein, 81 aa, Hylobates moloch
MGPLSFRDVAIEFSLKEWQCLDTAQQNLYRNVMLENYRNLVFLGIAVSKPDLITCLEQGKEAWSMKRHEIMVAKPAGGLSK

SEQ ID NO: 6318 - protein, 81 aa, Hylobates moloch
SGCPGADRNLLVYSFYEKGPLTFRDVAIEFSLEEWQCLDTAQQDLYRKVMLENYRNLVFLGIAVSKPDLITCLEQGKEPWN

SEQ ID NO: 6319 - protein, 81 aa, Hylobates moloch
MNVMLENYKNLVFLAGIAVSKQDPITSLEQEKEPWNMKRREMVDESPAMCSYFTRDLWPEQDIKDSFQQVILRRYRKCEHE

SEQ ID NO: 6320 - protein, 81 aa, Hylobates moloch
MNVMLENYKNLVFLGIAVSKQDPITSLEQEKEPWNMKRREMVDESPGQVWWLTPVIPALWEARAGALLEPRSLIPAWSTWK

SEQ ID NO: 6321 - protein, 81 aa, Hylobates moloch
MNVMLENYKNLVFLGIAVSKQDPITSLEQEKEPWNMKRREMVDESPGYMCRMCSYVFLFYERPLARARHKRFFSTSDTEKI

SEQ ID NO: 6322 - protein, 81 aa, Hylobates moloch
MNVMLENYKNLVFLGIAVSKQDPITSLEQEKEPWNMKRREMVDESPAMCSYFTRDLWPEQDIKDSFQQVILRRYRKCEHEN

SEQ ID NO: 6323 - protein, 81 aa, Hylobates moloch
METLTFRDVAIEFSLEEGECLNPAQRNLYMNVMLENYKNLVFLAMCSYFTRDLWPEQDIKDSFQQVILRRYRKCEHENLQL

SEQ ID NO: 6324 - protein, 81 aa, Hylobates moloch
SGCPGAERNLLVYSYFEKETLTFRDVAIEFSLEEWQCLSPAQQNLYMNVMLENYKNLVFLDIAVSKQDPVTCLEQEKEPWN

SEQ ID NO: 6325 - protein, 81 aa, Hylobates moloch
SRAQVILLPQPPELGLQETLTFRDVAIEFSLEEWQCLSPAQQNLYMNVMLENYKNLVFLDIAVSKQDPVTCLEQEKEPWNM

SEQ ID NO: 6326 - protein, 81 aa, Hylobates moloch
ASGCPGAERNLLVYSYFEKETLTFRDVAIEFSLEEWQCLSPAQQNLYMNVMLENYKNLVFLADIAVSKQDPVTCLEQEKEP

SEQ ID NO: 6327 - protein, 81 aa, Hylobates moloch
MNVMLENYKNLVFLADIAVSKQDPVTCLEQEKEPWNMKRHEMVDEPPAMCSYFTKDLWPEQDIKDSFQQVILRRYGKCEHE

SEQ ID NO: 6328 - protein, 81 aa, Hylobates moloch
MGPLTFMDVAIEFSLEEWQCLDTAQQNLYRTVMLENYRNLVFLGIAVSNLDLITCLEQGKEPWNMKRHEMVAKPPAMCSHF

SEQ ID NO: 6329 - protein, 81 aa, Hylobates moloch
SGYPGAERNLLEYSYFEKGPLTFRDVVIEFSQEEWQCLDTAQQDLYRKVMLENFRNLVFLGIAVSKPDLVTCLEQGRDPWN

SEQ ID NO: 6330 - protein, 81 aa, Hylobates moloch
ASGYPGAERNLLEYSYFEKGPLTFRDVVIEFSQEEWQCLDTAQQDLYRKVMLENFRNLVFLAGIAVSKPDLVTCLEQGRDP

SEQ ID NO: 6331 - protein, 81 aa, Hylobates moloch
TPGLPESLEMGPLTFRDVAIEFSLEEWQCLDTAQQDLYRKVMLENYRNLVFLAGIAVSKPDLVTCLEQGKDPWNMKRHSMV

SEQ ID NO: 6332 - protein, 81 aa, Hylobates moloch
MGPLTFRDVAIEFSLEEWQCLDTAQQDLYRKVMLENYRNLVFLAGIAVSKPDLVTCLEQGKDPWNMKRHSMVVKPPGRVSL

SEQ ID NO: 6333 - protein, 81 aa, Hylobates moloch
MGPLTFRDVAIEFSLEEWQCLDTAQQDLYRKVMLENYRNLVFLGIAVSKPDLVTCLEQGKDPWNMKRHSMVVKPPVICSHF

SEQ ID NO: 6334 - protein, 81 aa, Hylobates moloch
TPGLPESLEMGPLTFRDVAIEFSLEEWQCLDTAQQDLYRKVMLENYRNLVFLGIAVSKPDLVTCLEQGKDPWNMKRHSMVV

SEQ ID NO: 6335 - protein, 81 aa, Hylobates moloch
EFSLEEWQCLDTAQQDLYRKVMLENYRNLVFLAGIAVSKPDLVTCLEQGKDPWNMKRHSMVVKPPGGDCSIFLMEHQGDVT

SEQ ID NO: 6336 - protein, 81 aa, Hylobates moloch
MGPLTFTDVAIEFSLEEWQCLDTAQQNLYRNVMLENYRNLVFLGIAVSKPDLITCLEKEKEPCNIKRHEMVDEPPVVCSHF

SEQ ID NO: 6337 - protein, 81 aa, Hylobates moloch
MGPLTFTDVAIEFSLEEWQCLDTAQQNLYRNVMLENYRNLVFLGIAVSKPDLITCLEKEKEPCNIKRHEMVDEPPDGVSLL

SEQ ID NO: 6338 - protein, 81 aa, Hylobates moloch
RRYDKRGHENLQLRKGYKTVGDCKLYKVGYNGLNQCLTLTQSKMYHCDIYVKVFYAFSNADRYKRRHTGKKPFQCKKCGKS

SEQ ID NO: 6339 - protein, 81 aa, Hylobates moloch
ASGCPGAERSLLVQSSFEKGPLTFRDVAIEFSLEEWQCLDTAQQGLYRKVMLENYRNLVFLAGIAVTKPDLITCLEQGKEP

SEQ ID NO: 6340 - protein, 81 aa, Hylobates moloch
MLENYRNLVFLGIAVTKPDLITCLEQGKEPWNMKRHEMVAKPPVICSHFPQDLWPEQDIKDSFQEAILKKYGKYGHDNLQL

SEQ ID NO: 6341 - protein, 81 aa, Hylobates moloch
SGCPGAERSLLVQSSFEKGPLTFRDVAIEFSLEEWQCLDTAQQGLYRKVMLENYRNLVFLGIAVTKPDLITCLEQGKEPWN

SEQ ID NO: 6342 - protein, 81 aa, Hylobates moloch
MPGHPGSWEMGPLTFMDVAIEFCLEEWQCLDTAQQNLYRTVMLENYRNLVFLGIAVSKPDLITCLEQEKEPWEPMRRHEMV

SEQ ID NO: 6343 - protein, 81 aa, Hylobates moloch
MDVAIEFCLEEWQCLDTAQQNLYRTVMLENYRNLVFLGIAVSKPDLITCLEQEKEPWEPMRRHEMVAKPPVMCSHFTQDFW

SEQ ID NO: 6344 - protein, 81 aa, Hylobates moloch
MGPLTFMDVAIEFCLEEWQCLDTAQQNLYRTVMLENYRNLVFLGIAVSKPDLITCLEQEKEPWEPMRRHEMVAKPPVMCSH

SEQ ID NO: 6345 - protein, 81 aa, Hylobates moloch
MDVAIEFCLEEWQCLDTAQQNLYRTVMLENYRNLVFLGIAVSKPDLITCLEQEKEPWEPMRRHEMVAKPPGGIVSLLNVFD

SEQ ID NO: 6346 - protein, 81 aa, Hylobates moloch
MGPLTIRDVTVEFSLEEWQCLDIVQQNLYSDVMLENYRNLVFLGIAVSKRDLITCLKQGKEPWNMKRHEMVAKPPVMCSHI

SEQ ID NO: 6347 - protein, 81 aa, Hylobates moloch
MLENYRNLVFVGIAASKPDLITCLEQGKEPWNVKRHEMVAEPPVVCSYFAQDLWPKQGKKKYFQKVILRRYKKCGRENLQL

SEQ ID NO: 6348 - protein, 81 aa, Hylobates moloch
MPGPPGSLEMGVLTFRDVAIEFSLEEWQCLDITQQNLYRNVMLENYRNLVFVGIAASKPDLITCLEQGKEPWNVKRHEMVA

SEQ ID NO: 6349 - protein, 81 aa, Hylobates moloch
MELLTFRDVAIEFSPEEWKCLDPAQQNLYRDVMLENYRNLVSLAVYSYYKQGIVPEQGIEDSFKKATLGRYGSCGLENICL

SEQ ID NO: 6350 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPGY

SEQ ID NO: 6351 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPAM

SEQ ID NO: 6352 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPEM

SEQ ID NO: 6353 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPGP

SEQ ID NO: 6354 - protein, 81 aa, Hylobates moloch
VSVDKFTAMSSHFTQDVLPEQGIQDAFPKTILRGYGNCGLDNSHLRKDWRSLDEYKLQKDYNGLNQCSSTTHSKIFQCNKY

SEQ ID NO: 6355 - protein, 81 aa, Hylobates moloch
MTLLTFRDVAIEFSLEEWKCLDLAQQNLYRDVMLENYRNLFSIGLTVSKPGLITCLEQRKEPWNVKRQEAVDGHPEFHSIT

SEQ ID NO: 6356 - protein, 81 aa, Hylobates moloch
MTLLTFRDVAIEFSLEEWKCLDLAQQNLYRDVMLENYRNLFSIGLTVSKPGLITCLEQRKEPWNVKRQEAVDGHPAMSSHF

SEQ ID NO: 6357 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPAL

SEQ ID NO: 6358 - protein, 81 aa, Hylobates moloch
SHFTQDVLPEQGIQDAFPKTILRGYGNCGLDNSHLRKDWRSLDEYKLQKDYNGLNQCSSTTHSKIFQCNKYVKIFDNFSNV

SEQ ID NO: 6359 - protein, 81 aa, Hylobates moloch
VSKPGLITCLEQRKEPWNVKRQEAVDGHPAMSSHFTQDVLPEQGIQDAFPKTILRGYGNCGLDNSHLRKDWRSLDEYKLQK

SEQ ID NO: 6360 - protein, 81 aa, Hylobates moloch
MAGTQTLLTFRDVAIEFSLEEWKCLDLAQQNLYRDVMLENYRNLFSIGLTVSKPGLITCLEQRKEPWNVKRQEAVDGHPDI

SEQ ID NO: 6361 - protein, 80 aa, Hylobates moloch
MTLLTFRDVAIEFSLEEWKCLDLAQQNLYRDVMLENYRNLFSIGLTVSKPGLITCLEQRKEPWNVKRQEAVDGHPASTNI

SEQ ID NO: 6362 - protein, 81 aa, Hylobates moloch
MPLAERNLLVYSSSKETLLTFRDVAIEFSLEEWKCLDLAQQNLYRDVMLENYRNLFSIGLTVSKPGLITCLEQRKEPWNVK

SEQ ID NO: 6363 - protein, 80 aa, Hylobates moloch
MWAPREQLLGWATEALPAKDSAWSWKEKPRYLGPVTFEDVAVLFTEAEWKRLSLEQRNLYKEVMLENLRNLVLLVLSYQI

SEQ ID NO: 6364 - protein, 81 aa, Hylobates moloch
EALPAKDSAWSWKEKPRYLGPVTFEDVAVLFTEAEWKRLSLEQRNLYKEVMLENLRNLVLLVLELGSPRSGLLPLDLNLDL

SEQ ID NO: 6365 - protein, 81 aa, Hylobates moloch
ALPAKDSAWSWKEKPRYLGPVTFEDVAVLFTEAEWKRLSLEQRNLYKEVMLENLRNLVLLESKPEVHTCSSCPLAFGSQQF

SEQ ID NO: 6366 - protein, 81 aa, Hylobates moloch
EALPAKDSAWSWKEKPRYLGPVTFEDVAVLFTEAEWKRLSLEQRNLYKEVMLENLRNLVLLAESKPEVHTCSSCPLAFGSQ

SEQ ID NO: 6367 - protein, 81 aa, Hylobates moloch
MTRENWAHSALRQEGLVKGKDDTWKWGTSFQGSSSSVWETSHLHFRQLRYHETSGPQEALSRLRELCRRWLRPEARTKAQI

SEQ ID NO: 6368 - protein, 81 aa, Hylobates moloch
TLPQVGNSGDQAGATVLRMVRPQDAVAYEDLSVDYTQKKWKGLPLSQRALQWNMMPENDRSMASLDGETGTEEELIPKHHS

SEQ ID NO: 6369 - protein, 81 aa, Hylobates moloch
DFAQCTSPVPTLPQVGNSGDQAGATVLRMVRPQDAVAYEDLSVDYTQKKWKGLPLSQRALQWNMMPENDRSMASLGWSTMA

SEQ ID NO: 6370 - protein, 81 aa, Hylobates moloch
GNSGDQAGATVLRMVRPQDAVAYEDLSVDYTQKKWKGLPLSQRALQWNMMPENDRSMASLGENMMKGSELTPKQEIFKGSE

SEQ ID NO: 6371 - protein, 81 aa, Hylobates moloch
VGNSGDQAGATVLRMVRPQDAVAYEDLSVDYTQKKWKGLPLSQRALQWNMMPENDRSMASLAGENMMKGSELTPKQEIFKG

SEQ ID NO: 6372 - protein, 81 aa, Hylobates moloch
MVRPQDTVAYEDLSEDYTQKKWKGLPLSQRALHWNMMLENDRSMASLGRNMMESSELTPKQEIFKGSESSNSTSGGLFGVV

SEQ ID NO: 6373 - protein, 81 aa, Hylobates moloch
VHQRTHTGEKPYKCNSCGKAFSDSSQLTVHQRVHTGRNLMNVLSVGKPLVSVPLLITTSELMLERSPQVWLGHLLKAWFSE

SEQ ID NO: 6374 - protein, 81 aa, Hylobates moloch
MVRPQDTVAYEDLSEDYTQKKWKGLPLSQRALHWNMMLENDRSMASLAGRNMMESSELTPKQEIFKGSESSNSTSGGLFGV

SEQ ID NO: 6375 - protein, 81 aa, Hylobates moloch
EDYTQKKWKGLPLSQRALHWNMMLENDRSMASLAGRNMMESSELTPKQEIFKGSESSNSTSGGLFGVVPGGTETGDVCEDT

SEQ ID NO: 6376 - protein, 81 aa, Hylobates moloch
TPAAQMPALFQREGCPGDQETMTFKDVEVTFSQDEWGWLDSAQRNLYRDVMLENYRNMASLVGPFTKPALISWLEAREPWG

SEQ ID NO: 6377 - protein, 81 aa, Hylobates moloch
MMTAVSLTTRPQESVAFEDVAVYFTAKEWDIMVPAERALYRDVMLENYEAVAFVVPPTSKPALVSHLEQGKESCFTRPQGV

SEQ ID NO: 6378 - protein, 81 aa, Hylobates moloch
YEAVAFVVPPTSKPALVSHLEQGKESCFTRPQGVLCRNDWRAGLIGYLELRRYTYLAKALLRTVVSKIFQNRQSWEDRRKA

SEQ ID NO: 6379 - protein, 81 aa, Hylobates moloch
LGLVLELLPGQPALPRARRESVTFEDVAVYFSENEWIGLGPAQRALYRDVMLENYGAVASLAFPFPKPALISQLERGEAPW

SEQ ID NO: 6380 - protein, 81 aa, Hylobates moloch
MLQTTWPQESVTFEDVAVYFTQNQWASLDPAQRALYREVMLENYANVASLVAFPFPKPALISHLERGEAPWGPDPWDTEIP

SEQ ID NO: 6381 - protein, 81 aa, Hylobates moloch
MLQTVWFQGLSKNLLFQEPVTFEDVAVYFTQNEWASLHLKQRALYREVMLENYENVTSLSAFPFPKPDLIFQLEQGEAAGP

SEQ ID NO: 6382 - protein, 81 aa, Hylobates moloch
MLQTVWFQGLSKNLLFQEPVTFEDVAVYFTQNEWASLHLKQRALYREVMLENYENVTSLYPTAGGFPLGTERTEKVPGALS

SEQ ID NO: 6383 - protein, 81 aa, Hylobates moloch
MLQTVWFQGLSKNLLFQEPVTFEDVAVYFTQNEWASLHLKQRALYREVMLENYENVTSCRARWLKPVIPALWEAEAGGSQE

SEQ ID NO: 6384 - protein, 81 aa, Hylobates moloch
GLSKNLLFQEPVTFEDVAVYFTQNEWASLHLKQRALYREVMLENYENVTSCRARWLKPVIPALWEAEAGGSQAAFPFPKPD

SEQ ID NO: 6385 - protein, 81 aa, Hylobates moloch
MLQTVWFQGLSKNLLFQEPVTFEDVAVYFTQNEWASLHLKQRALYREVMLENYENVTSCRARWLKPVIPALWEAEAGGSQA

SEQ ID NO: 6386 - protein, 81 aa, Hylobates moloch
EEAAQKRKEKDPSMVLPQGHLTFRDVGIEFSLEEWKCLDPAPRALYRAVMLENYRNLHSVDISSKCMLKKFSSTGQGNTEV

SEQ ID NO: 6387 - protein, 81 aa, Hylobates moloch
KKVTFEDVAIDFTQEEWAMMDTSKRKLYRDVMLENISHLVSLGYQMSKSYIILQLEQGKELWREGREFLQGQNPDRESAVK

SEQ ID NO: 6388 - protein, 81 aa, Hylobates moloch
MPSLDSMTFEDIVVDFTQEEWALLDTSQRKLFQDVMLENISHLVSIGKQLCKSTVLSHLEQVEKFSTQRISLLQGREVDIK

SEQ ID NO: 6389 - protein, 81 aa, Hylobates moloch
VDIKHQEIPFIQHIYQKGTSTISTLRSHTQEDPFLCNDIGEDFTQHIALTQNVITYMRKKHFESGRSCEHQSVVTATSIKT

SEQ ID NO: 6390 - protein, 81 aa, Hylobates moloch
TQRISLLQGREVDIKHQEIPFIQHIYQKGTSTISTLRSHTQEDPFLCNDIGEDFTQHIALTQNVITYMRKKHFVSKKFGKT

SEQ ID NO: 6391 - protein, 81 aa, Hylobates moloch
STVLSHLEQVEKFSTQRISLLQGREVDIKHQEIPFIQHIYQKGTSTISTLRSHTQEDPFLCNDIGEDFTQHIALTQNVITY

SEQ ID NO: 6392 - protein, 81 aa, Hylobates moloch
QEENVRDTQQVTTLQLPPNRVSPFKDMILCFSEEDWSLLDPAQTGFYGEFIIGEDYGVSVPPNDLAAQPDLSQGGENEPRV

SEQ ID NO: 6393 - protein, 81 aa, Hylobates moloch
GSGGKKAQIISVLSQIYVNRVSPFKDMILCFSEEDWSLLDPAQTGFYGEFIIGEDYGVSVPPNDLAAQPDLSQGGENEPRV

SEQ ID NO: 6394 - protein, 81 aa, Hylobates moloch
MAGSQGLLIFKDVAIEFSPEEWSYLDPAQQNLYRDVMLENYRNLVSLGIAVSKPDLITCLEQRNEPWNVKKHETVARHPAV

SEQ ID NO: 6395 - protein, 81 aa, Hylobates moloch
MSGHPGRWETNSVAFEDVAVNFTQEEWALLDPSQKNLYRDVMQETFRNLASIGNKGEDQSIEDQYKNSSRNLSSFQIHQRS

SEQ ID NO: 6396 - protein, 81 aa, Hylobates moloch
MSGHPGRWETNSVAFEDVAVNFTQEEWALLDPSQKNLYRDVMQETFRNLASIGNKGEDQSIEDQYKNSSRNLRHIIPHSGN

SEQ ID NO: 6397 - protein, 81 aa, Hylobates moloch
MSGHPGRWETNSVAFEDVAVNFTQEEWALLDPSQKNLYRDVMQETFRNLASIGNKGEDQSIEDQYKNSSRNLRHKRIHTGE

SEQ ID NO: 6398 - protein, 81 aa, Hylobates moloch
RHFRRPEPSREPRASPTQDSVAFEDVAVNFTQEEWALLNSSQKNLYREVMQETCRNLASVGSKWKDQNIEDHFEKPGKNIR

SEQ ID NO: 6399 - protein, 81 aa, Hylobates moloch
MDSVAFEDVAVNFTQEEWALLNSSQKNLYREVMQETCRNLASVGSKWKDQNIEDHFEKPGKNIRKHMVQKLCESKEGSQYG

SEQ ID NO: 6400 - protein, 81 aa, Hylobates moloch
AELLHPVCTCGRHFRRPEPSREPRASPTQDSVAFEDVAVNFTQEEWALLNSSQKNLYREVMQETCRNLASVENIWYRNCVK

SEQ ID NO: 6401 - protein, 81 aa, Hylobates moloch
MGLLAFRDVALEFSPEEWECLDPAQRSLYRDVMLENYRNLFSLGLAVSKPELIMCLEARKEPWNVNTERTAKHSVETRFHH

SEQ ID NO: 6402 - protein, 81 aa, Hylobates moloch
MGLLAFRDVALEFSPEEWECLDPAQRSLYRDVMLENYRNLFSLGLAVSKPELIMCLEARKEPWNVNTERTAKHSALSSYLT

SEQ ID NO: 6403 - protein, 81 aa, Hylobates moloch
EARKEPWNVNTERTAKHSALSSYLTEDILPEQGLQVSFQKVMLRRYERCCLEKLRLRNDWEIVVETRFHRVSQDGLDLLTS

SEQ ID NO: 6404 - protein, 81 aa, Hylobates moloch
MDSVSFEDVAVAFTQEEWALLDHSQKNLYRDVMQEIFRNLASVGNKSEDQNIQDDFKNPGRNLSSHVVERLFEIKEGSQYG

SEQ ID NO: 6405 - protein, 81 aa, Hylobates moloch
MGLLAFRDVALEFSPEEWECLDPAQRSLYRDVMLENYRNLFSLGEDNFNMQFLFHSLAVSKPELIMCLEARKEPWNVNTER

SEQ ID NO: 6406 - protein, 81 aa, Hylobates moloch
RKEPWNVNTERTAKHSALSSYLTEDILPEQGLQVSFQKVMLRRYERCCLEKLRLRNDWEIPCEYVLASRLPSAMIVSFLRL

SEQ ID NO: 6407 - protein, 81 aa, Hylobates moloch
FSLGLAVSKPELIMCLEARKEPWNVNTERTAKHSALSSYLTEDILPEQGLQVSFQKVMLRRYERCCLEKLRLRNDWEIVAM

SEQ ID NO: 6408 - protein, 81 aa, Hylobates moloch
LFHSLAVSKPELIMCLEARKEPWNVNTERTAKHSALSSYLTEDILPEQGLQVSFQKVMLRRYERCCLEKLRLRNDWEIVAM

SEQ ID NO: 6409 - protein, 81 aa, Hylobates moloch
NSLPQVILLPNPPKVLRLQGLLAFSDVVIEFSPEEWACLDPAQRNLYRDVMFENYRNLVSLAILSYSIQDLLPEQDMKDLC

SEQ ID NO: 6410 - protein, 81 aa, Hylobates moloch
AQRNLYRDVMFENYRNLVSLAILSYSIQDLLPEQDMKDLCQKVTLTRHRSWGLDNLHLVKDRRTVNEGKGQKEYYNRLTQC

SEQ ID NO: 6411 - protein, 81 aa, Hylobates moloch
SQEESPEEDTERTEQKPTVKDAFKDISIYFTKEEWAEMGDWEKTRYRNVKRNYNALITIGLRATRPAFMCHRRQAIKLQVD

SEQ ID NO: 6412 - protein, 81 aa, Hylobates moloch
RQAIKLQVDDTEDSDEEWTPRQQVKPPWMALRMEQRKHQKGMPKASFSNESSLKELSGAANLLNASGSEQAQKPVSPPGEA

SEQ ID NO: 6413 - protein, 81 aa, Hylobates moloch
SGDPSGEGTSGSGSVSIRKPVSEMQLQVQSQQEELEQLKKDLSSQKELVRLLQQTVRSSQYDKYFTSSRLCEGVPKDTLEL

SEQ ID NO: 6414 - protein, 81 aa, Hylobates moloch
SSGDPSGEGTSGSGSVSIRKPVSEMQLQVQSQQEELEQLKKDLSSQKELVRLLQQTVRSSQYDKYFTSSRLCEGVPKDTLE

SEQ ID NO: 6415 - protein, 81 aa, Hylobates moloch
KENLEDISAWGLPEARSKESVSFKDVAVDFTQEEWGQLDSPQRALYRDVMLENYQNLLALGAGPPLHKPDVISHLERGEEP

SEQ ID NO: 6416 - protein, 81 aa, Hylobates moloch
VDRRRSAGTTKEAGRPLEMAVSEPEASAAEWKQLDPAQRNLYNDVMLENYSNQASMAPKPDMISKLEKGEAPWLGKRKRPS

SEQ ID NO: 6417 - protein, 81 aa, Hylobates moloch
KEAGRPLEMAVSEPEASAAVSVTFKHVTMAFTQKEWKQLDPAQRNLYNDVMLENYSNQASMAPKPDMISKLEKGEAPWLGK

SEQ ID NO: 6418 - protein, 81 aa, Hylobates moloch
MAAGLLTAGPRGSTFFSSVTVAFAQKGWRCLVSTPRDKFKEGIPGKCRNLVLLGLPVSQPGMNSQLEQREGTWMLEGEDLR

SEQ ID NO: 6419 - protein, 81 aa, Hylobates moloch
ENTGEEGMAAGLLTAGPRGSTFFSSVTVAFAQKGWRCLVSTPRDKFKEGIPGKCRNLVLLGLPVSQPGMNSQLEQREGTWM

SEQ ID NO: 6420 - protein, 81 aa, Hylobates moloch
GDDAFAKRPRDDAKTSEKRSKALDDIATYFSKKEWENMKYSEKISYVYMKRNYEAMTKLGFNVTLPPFMCNKQATDFQGND

SEQ ID NO: 6421 - protein, 81 aa, Hylobates moloch
MIESQEPVTFEDVAVDFTQEEWQQLNPAQKTLHRDVMLETYNHLVSVGCSGIKPDVIFKLEHGEDPWIIESELSRWIYPDL

SEQ ID NO: 6422 - protein, 81 aa, Hylobates moloch
MPANEDAPQPGEHGSACEVSVSFEDVTVDFSREEWQQLDSTQRRLYQDVMLENYSHLLSVGFKVPKPEVIFKLEQGEGPWT

SEQ ID NO: 6423 - protein, 81 aa, Hylobates moloch
SPPWSPALAAEGRGSSCEASVSFEDVTVDFSREEWQHLDPAQRRLYWDVTLENYSHLLSVGYQVPKSEATFKLEQGEGPWT

SEQ ID NO: 6424 - protein, 81 aa, Hylobates moloch
AAHVSADHAALNRIVSLQASVSFEDVTVDFSREEWQHLDPAQRRLYWDVTLENYSHLLSVGYQVPKSEATFKLEQGEGPWT

SEQ ID NO: 6425 - protein, 81 aa, Hylobates moloch
EGEAPHQSCSGGAIGKMQQQGIPGGIFFHCERFDQPIGEDSLCSILEELWQDNNQLEQRQENQNNLLSHVKVLIKERGYEP

SEQ ID NO: 6426 - protein, 81 aa, Hylobates moloch
RPWLQRDVAAHVRIVSLQASVSFEDVTVDFSREEWQHLDPAQRRLYWDVTLENYSHLLSVGYQVPKSEATFKLEQGEGPWT

SEQ ID NO: 6427 - protein, 81 aa, Hylobates moloch
MAMSQESLTFKDVFVDFTLEEWQQLDSAQKNLYRDVMLENYSHLVSVGYLVVKPDVIFRLGPGEESWMADGGTPVRTCAGE

SEQ ID NO: 6428 - protein, 81 aa, Hylobates moloch
MAMSQESLTFKDVFVDFTLEEWQQLDSAQKNLYRDVMLENYSHLVSVGYLVVKPDVIFRLGPGEESWMADGGTPVRTCAVE

SEQ ID NO: 6429 - protein, 81 aa, Hylobates moloch
MAMSQESLTFKDVFVDFTLEEWQQLDSAQKNLYRDVMLENYSHLVSVGYLVVKPDVIFRLGPGEESWMADGGTPVRTCAVW

SEQ ID NO: 6430 - protein, 81 aa, Hylobates moloch
MAMSQESLTFKDVFVDFTLEEWQQLDSAQKNLYRDVMLENYSHLVSVGYLVVKPDVIFRLGPGEESWMADGGTPVRTCAEV

SEQ ID NO: 6431 - protein, 81 aa, Hylobates moloch
MSMSQESLTFKDVFVDFTLEEWQQLDSAQKNLYRDVMLENYSHLVSVGYLVVKPDVIFRLGPGEESWMADGGTPVRTCAGT

SEQ ID NO: 6432 - protein, 81 aa, Hylobates moloch
MSMSQESLTFKDVFVDFTLEEWQQLDSAQKNLYRDVMLENYSHLVSVGYLVVKPDVIFRLGPGEESWMADGGTPVRTCAGE

SEQ ID NO: 6433 - protein, 81 aa, Hylobates moloch
MSMSQESLTFKDVFVDFTLEEWQQLDSAQKNLYRDVMLENYSHLVSVGYLVVKPDVIFRLGPGEESWMADGGTPVRTCAEV

SEQ ID NO: 6434 - protein, 81 aa, Hylobates moloch
VVKPDVIFRLGPGEESWMADGGTPVRTCAGEDRPGESGQGKGTRLVGESLASGMRSGALLRAPDLWTCLGSDERNCCHVQM

SEQ ID NO: 6435 - protein, 81 aa, Hylobates moloch
KNSWAGTLTKKPSLYMKESLLTFEDVAVYFSEEEWQLLNPLEKTLYNDVMQDIYETVISLGLKLKNDTGNDHPISVSTSEI

SEQ ID NO: 6436 - protein, 81 aa, Macaca mulatta
LQEENVRDTQQVTTLQLPPNRVSPFKDMILCFSEEDWSLLDPAQTGFYGEFIIGEDCGVSIPPNELAAQPDLSQREENEPR

SEQ ID NO: 6437 - protein, 81 aa, Macaca mulatta
LGSGGKKAQIISVLSQIYMNRVSPFKDMILCFSEEDWSLLDPAQTGFYGEFIIGEDCGVSIPPNELAAQPDLSQREENEPR

SEQ ID NO: 6438 - protein, 81 aa, Macaca mulatta
MGLLIFRDVAIEFSPEEWSYLDPAQQNLYRDVMLENYRNLVSLGIAVSKPDLITCLEQRNEPWNVKKHETIGRHPAVSSHF

SEQ ID NO: 6439 - protein, 81 aa, Macaca mulatta
MSGHPGSWEMNSVAFEDVAVNFTQEEWALLDPSQKNLYRDVMQETFRNLASIGNKGKDQSIEDQYKNSSRNLSSFQMHQRN

SEQ ID NO: 6440 - protein, 81 aa, Macaca mulatta
MSGHPGSWEMNSVAFEDVAVNFTQEEWALLDPSQKNLYRDVMQETFRNLASIGNKGKDQSIEDQYKNSSRNLRHIISHSGT

SEQ ID NO: 6441 - protein, 81 aa, Macaca mulatta
MDSVAFEDVAVNFTQEEWALLDSSQKNLYREVMQETCRNLASVGNKWKDQNIEDHFEKPGKDIRNDMVQRLCESKEGSQCG

SEQ ID NO: 6442 - protein, 81 aa, Macaca mulatta
MGLLAFRDVALEFSPEEWECLDPAQRNLYRDVMLENYRNLFSLGLAMSKPELIIYLEARKEPWNVNTEKTAKHSVETFRHV

SEQ ID NO: 6443 - protein, 81 aa, Macaca mulatta
MGLLAFRDVALEFSPEEWECLDPAQRNLYRDVMLENYRNLFSLGLAMSKPELIIYLEARKEPWNVNTEKTAKHSALSSYLT

SEQ ID NO: 6444 - protein, 81 aa, Macaca mulatta
EARKEPWNVNTEKTAKHSALSSYLTEDILPEQGLQISFQKVMLRRYERCCLEKLRLRNDWEIVVETGFHHVSQDGLHLLTS

SEQ ID NO: 6445 - protein, 81 aa, Macaca mulatta
MDSVSFEDVAVAFTQEEWALLDPSQKNLYRDVMQEIFRNLASVGNKSEDQNIQDDFKNPGGNLSSHVVERLFEIKEGSQYG

SEQ ID NO: 6446 - protein, 81 aa, Macaca mulatta
MGLLAFRDVALEFSPEEWECLDPAQRNLYRDVMLENYRNLFSLGEDHFNMQFLFHRLAMSKPELIIYLEARKEPWNVNTEK

SEQ ID NO: 6447 - protein, 81 aa, Macaca mulatta
RKEPWNVNTEKTAKHSALSSYLTEDILPEQGLQISFQKVMLRRYERCCLEKLRLRNDWEIPCEEVLASPLPSAMIVSFMRP

SEQ ID NO: 6448 - protein, 81 aa, Macaca mulatta
FSLGLAMSKPELIIYLEARKEPWNVNTEKTAKHSALSSYLTEDILPEQGLQISFQKVMLRRYERCCLEKLRLRNDWEIVAM

SEQ ID NO: 6449 - protein, 81 aa, Macaca mulatta
LFHRLAMSKPELIIYLEARKEPWNVNTEKTAKHSALSSYLTEDILPEQGLQISFQKVMLRRYERCCLEKLRLRNDWEIVAM

SEQ ID NO: 6450 - protein, 81 aa, Macaca mulatta
QKALYREVMRMNYETVLSLEFPFPKPDMITRLEGEEESQNSDEWQLHGGTSAENEESDVKPPDWPHPMNATSQFPQPQHFD

SEQ ID NO: 6451 - protein, 81 aa, Macaca mulatta
SLPQVILLPNPPKVFKLGLLAFSDVVIEFSPEEWACLDPAQRNLYRDVMFENYRNLVSLAILSYSIQDLLPEQDMKDLCQK

SEQ ID NO: 6452 - protein, 81 aa, Macaca mulatta
RNLYRDVMFENYRNLVSLAILSYSIQDLLPEQDMKDLCQKVTLTRHRSWGLDNLHLVKDWRTVNEGKGQKECYNRLTQCSS

SEQ ID NO: 6453 - protein, 81 aa, Macaca mulatta
MPGHTEIRKTGLLAFSDVVIEFSPEEWACLDPAQRNLYRDVMFENYRNLVSLAILSYSIQDLLPEQDMKDLCQKVTLTRHR

SEQ ID NO: 6454 - protein, 81 aa, Macaca mulatta
QRNLYRDVMFENYRNLVSLAILSYSIQDLLPEQDMKDLCQKVTLTRHRSWGLDNLHLVKDWRTVNEGKGQKECYNRLTQCS

SEQ ID NO: 6455 - protein, 81 aa, Macaca mulatta
MIHPPWPPKVLGLQGLLAFSDVVIEFSPEEWACLDPAQRNLYRDVMFENYRNLVSLGPANSLCTLCFCEFHRFGFSIQDFQ

SEQ ID NO: 6456 - protein, 81 aa, Macaca mulatta
VCAFEGANTSTSSYKLVYTAILSYSIQDLLPEQDMKDLCQKVTLTRHRSWGLDNLHLVKDWRTVNEGKGQKECYNRLTQCS

SEQ ID NO: 6457 - protein, 81 aa, Macaca mulatta
MINFQESVTFQDVAVDFTAEEWQLLDCTERTLYWDVMLENYRNLISVGCPINKTKVILKVEQGQEPWMVEGVNLHQSSPES

SEQ ID NO: 6458 - protein, 81 aa, Macaca mulatta
MINFQESVTFQDVAVDFTAEEWQLLDCTERTLYWDVMLENYRNLISVGCPINKTKVILKVEQGQEPWMVEGVNLHQSSPGC

SEQ ID NO: 6459 - protein, 81 aa, Macaca mulatta
RESVEDEVTPGLPTAESHELLTFKDISVDFTQEEWGQLAPAYQNLYREVMLENYSNLVSVGYQLSKPSVISQLEKGEEPWM

SEQ ID NO: 6460 - protein, 81 aa, Macaca mulatta
EEPWMAEKEGPGDPSSDLKSKMETIESSAKSAISQERLYHGIMMERFMRDDIIYSTLRKASTYDDVLERHQETCVRDVRQA

SEQ ID NO: 6461 - protein, 81 aa, Macaca mulatta
IRFGDQRISKQIQRRLLIKELLTFKDISVDFTQEEWGQLAPAYQNLYREVMLENYSNLVSVAGYQLSKPSVISQLEKGEEP

SEQ ID NO: 6462 - protein, 81 aa, Macaca mulatta
GDSLDSRVALGPLTAESQELLTFKDVSVDFTQEEWGQLAPAHRNLYREVMLENYGNLVSVGYQLSKPGVISQLEKGEEPWL

SEQ ID NO: 6463 - protein, 81 aa, Macaca mulatta
MAATLLMAGSQAPVTFEDMAMYLTREEWRPLDPAQRDLYRDVMQENYGNVVSLDFEIRSENEVNPKQEISEDVQFGTSERP

SEQ ID NO: 6464 - protein, 81 aa, Macaca mulatta
QFGTSERPAENAEENPESEEGFESGDRSERQWGDLTAEEWVSYPLQQVTDLLVHKEVHTGIRYHICSHCGKAFSQISDLNR

SEQ ID NO: 6465 - protein, 81 aa, Macaca mulatta
LPECSVRFHNQQTVNKSLGLVSFEEVAVHFTWEEWQDLDDAQRTLYRDVMLETYSSLVSLGHCITKPEVIFKLEQGAEPWL

SEQ ID NO: 6466 - protein, 81 aa, Macaca mulatta
KENPEDISGWGLPEARSKESVSFKDVAVDFTQEEWGQLDSPQRALYRDVMLENYQNLLALGPPLHKPDVISHLERGEEPWS

SEQ ID NO: 6467 - protein, 81 aa, Macaca mulatta
KENPEDISGWGLPEARSKESVSFKDVAVDFTQEEWGQLDSPQRALYRDVMLENYQNLLALEWQLKAVPSQQQGICKEEPAQ

SEQ ID NO: 6468 - protein, 81 aa, Macaca mulatta
LKENPEDISGWGLPEARSKESVSFKDVAVDFTQEEWGQLDSPQRALYRDVMLENYQNLLALAGPPLHKPDVISHLERGEEP

SEQ ID NO: 6469 - protein, 81 aa, Macaca mulatta
MAFRDVAVDFTQDEWRLLSPAQRTLYREVMLENYSNLVSLGISFSKPELITQLEQGKETWREEKNCSPATCPADPEPELYL

SEQ ID NO: 6470 - protein, 81 aa, Macaca mulatta
MAFRDVAVDFTQDEWRLLSPAQRTLYREVMLENYSNLVSLGISFSKPELITQLEQGKETWREEKNCSPATCPDPEPELYLD

SEQ ID NO: 6471 - protein, 81 aa, Macaca mulatta
MAHMAFRDVAVDFTQDEWRLLSPAQRTLYREVMLENYSNLVSLGISFSKPELITQLEQGKETWREEKNCSPATCPADPEPE

SEQ ID NO: 6472 - protein, 81 aa, Macaca mulatta
MAFRDVAVDFTQDEWRLLSPAQRTLYREVMLENYSNLVSLGISFSKPELITQLEQGKETWREEKNCSPATCPDHQKYGNNC

SEQ ID NO: 6473 - protein, 81 aa, Macaca mulatta
LPSNDTDWPQEKEGKAQIVVPVTFRDVAVIFTEAEWKRLSPEQRNLYKEVMLENYRNLLSLAEPKPEIYPCSSCLLAFSCQ

SEQ ID NO: 6474 - protein, 81 aa, Macaca mulatta
AKGLPSNDTDWPQEKEGKAQIVVPVTFRDVAVIFTEAEWKRLSPEQRNLYKEVMLENYRNLLSLGHGIETILANMVKPHLY

SEQ ID NO: 6475 - protein, 81 aa, Macaca mulatta
PSNDTDWPQEKEGKAQIVVPVTFRDVAVIFTEAEWKRLSPEQRNLYKEVMLENYRNLLSLDRISLLLPRLECNGAISAHHN

SEQ ID NO: 6476 - protein, 81 aa, Macaca mulatta
KNGENVETMKKLIQNHKAKGLPSNDTDWPQEKEGKAQIVVPVTFRDVAVIFTEAEWKRLSPEQRNLYKEVMLENYRNLLSL

SEQ ID NO: 6477 - protein, 81 aa, Macaca mulatta
IQNHKAKGLPSNDTDWPQEKEGKAQIVVPVTFRDVAVIFTEAEWKRLSPEQRNLYKEVMLENYRNLLSLDGGQKQQDAAAY

SEQ ID NO: 6478 - protein, 81 aa, Macaca mulatta
MALSLGHFRWSRIGLLQGSVLFEDVSVDFTQKEWQLLNPAQRLLYRDVMLENYRHLVSMGHCVTKPELIVKLKQGEESWIL

SEQ ID NO: 6479 - protein, 81 aa, Macaca mulatta
MENEKERSVSFQDLTVNFTQEEWQQLDPAQRLLYRDVMLENYSNLVSVGYHVSKPDVIFKLEQGEEPWIVEEFSNQNYPEV

SEQ ID NO: 6480 - protein, 81 aa, Macaca mulatta
LKMNKFQRSVSFQDLTVNFTQEEWQQLDPAQRLLYRDVMLENYSNLVSVGYHVSKPDVIFKLEQGEEPWIVEEFSNQNYPE

SEQ ID NO: 6481 - protein, 81 aa, Macaca mulatta
MLENYSNLVSVGYHVSKPDVIFKLEQGEEPWIVEEFSNQNYPEVNDALEKNKEIQDKHLTQTVFFGNKTLITERENVFGKT

SEQ ID NO: 6482 - protein, 81 aa, Macaca mulatta
MIQSQISFEDVAVDFTLEEWQLLNPTQKNLYRDVMLENYSNLIFLEVWLDNPKMWLRDNQDNLKSMERGHKYDVFGKIFNS

SEQ ID NO: 6483 - protein, 81 aa, Macaca mulatta
MIQSQISFEDVAVDFTLEEWQLLNPTQKNLYRDVMLENYSNLIFLGYQILKPKLEQQDPWIIGQEILNNFSEVWLDNPKMW

SEQ ID NO: 6484 - protein, 81 aa, Macaca mulatta
MATSFRTASCWGLLSFKDISMEFTWDEWQLLDSTQKYLYRDVILENYHNLLSVGYHGTKPDLIFKLEQGEDPWIINAKISR

SEQ ID NO: 6485 - protein, 80 aa, Macaca mulatta
MATSFRTASCWGLLSFKDISMEFTWDEWQLLDSTQKYLYRDVILENYHNLLSVDGWEEWYQNNQDELESIERSYACSVLG

SEQ ID NO: 6486 - protein, 81 aa, Macaca mulatta
FRNLLGVLWAQGNSALPEGLLSFKDISMEFTWDEWQLLDSTQKYLYRDVILENYHNLLSVGYHGTKPDLIFKLEQGEDPWI

SEQ ID NO: 6487 - protein, 81 aa, Macaca mulatta
RDVILENYHNLLSVGYHGTKPDLIFKLEQGEDPWIINAKISRQSCPDGWEEWYQNNQDELESIERSYACSVLGRLNLSKTH

SEQ ID NO: 6488 - protein, 81 aa, Macaca mulatta
NGRMEECTMTFYHTKYAKESFSFDDLSVDFTQKEWQLLDPSQKNLYKDVMLENYSSLVSLGYEVMKPDVIFKLEQGEEPWV

SEQ ID NO: 6489 - protein, 81 aa, Macaca mulatta
MSQGSVTFRDVAIDFSQEEWKWLQPAQRDLYRCVMLENYGHLVSLGLSISKPDVVSLLEQGKEPWLGKRNVNRDLFSVSES

SEQ ID NO: 6490 - protein, 81 aa, Macaca mulatta
MLENYGHLVSLGLSISKPDVVSLLEQGKEPWLGKRNVNRDLFSVSESSGDIKDFSPKNVIYDDSSQYLIMERILSQGPVYS

SEQ ID NO: 6491 - protein, 81 aa, Macaca mulatta
MSQGSVTFRDVAIDFSQEEWKWLQPAQRDLYRCVMLENYGHLVSLAGLSISKPDVVSLLEQGKEPWLGKRNVNRDLFSVRV

SEQ ID NO: 6492 - protein, 81 aa, Macaca mulatta
MSQGSVTFRDVAIDFSQEEWKWLQPAQRDLYRCVMLENYGHLVSLGLSISKPDVVSLLEQGKEPWLGKRNVNRDLFSVLKE

SEQ ID NO: 6493 - protein, 81 aa, Macaca mulatta
REFGSMGPGHADICVSFQGSVTFRDVAIDFSQEEWKWLQPAQRDLYRCVMLENYGHLVSLGLSISKPDVVSLLEQGKEPWL

SEQ ID NO: 6494 - protein, 81 aa, Macaca mulatta
RNAEEERMITIFLTTWLQEPMTFKDVAVEFTQDEWMMLDSAQRSLYRDVMLENYRNLTSVEYQLCKLTVISPLDQEEIRNM

SEQ ID NO: 6495 - protein, 81 aa, Macaca mulatta
MHAKSLTAWSQTLVTFKDVFVDFTREEWKLLDTAQQIVYRNVMLENYKNLVSLGYQLTKPDVILRLEKGEEPWLVERGIHQ

SEQ ID NO: 6496 - protein, 81 aa, Macaca mulatta
VLEWLFISQEQPKITTSWGPLSFMDVFVDFTWEEWQLLDPAQKCLYRNVMLENYSNLVSLGYQHTKPDIIFKLEQGEELCV

SEQ ID NO: 6497 - protein, 81 aa, Macaca mulatta
MPELTPGHPGSRGTDSVAFEDVAVNFTQQEWALLDSSQKNLYREVMQETYRNLASVEILWYRDCVKAKKVVSMDKLSATFQ

SEQ ID NO: 6498 - protein, 81 aa, Macaca mulatta
MTFEDVAVEFTQGEWGQLNPAQKDLYREVMLENFRNLAFLGLPVSKPYVICQLEEGGEPFIVEREISTGAYSDWERRSKSK

SEQ ID NO: 6499 - protein, 81 aa, Macaca mulatta
MAAVSPTTRCQESVTFEDVAVVFTDEEWSHLVPIQRDLYKEVMLENYNSIVSLGLPVPQPDVIFQLKRGDKPWVVDLHGSE

SEQ ID NO: 6500 - protein, 81 aa, Macaca mulatta
TLLTFRDVAIEFSLEEWKCLDPAQQNLYRDVMLENYRNLFSIGLTVSKPGLITCLEQRKEPWNVKRQEAVDGHPAMSSHVT

SEQ ID NO: 6501 - protein, 81 aa, Macaca mulatta
MAGAQTLLTFRDVAIEFSLEEWKCLDPAQQNLYRDVMLENYRNLFSIGLTVSKPGLITCLEQRKEPWNVKRQEAVDGHPEM

SEQ ID NO: 6502 - protein, 81 aa, Macaca mulatta
MTLLTFRDVAIEFSLEEWKCLDPAQQNLYRDVMLENYRNLFSIGLTVSKPGLITCLEQRKEPWNVKRQEAVDGHPEMGFHH

SEQ ID NO: 6503 - protein, 81 aa, Macaca mulatta
MAVTFEDVTIVFTWEEWKFLDSSQKRLYREVMWENYTNVMSVENWNKSYKSQEEKFRYLEYENFSCWQGWWNAGAQMCANQ

SEQ ID NO: 6504 - protein, 81 aa, Macaca mulatta
SRKNLSMEKEQKLIVQRSYIPVEEALPQYVGVICQKDLLKDSMEENYCGCNKCKEIYCWNSRCIFHKRNQPGENLCQCSIH

SEQ ID NO: 6505 - protein, 81 aa, Macaca mulatta
QMGNIKEKMKAGSRTGKPQEPVTFKDVVVEFSKEEWGQLDSAVKNLYRNVMLENFRNLNSLRKAYLLSKPVESLKLESKKK

SEQ ID NO: 6506 - protein, 81 aa, Macaca mulatta
MGNIKEKMKAGSRTGKPQEPVTFKDVVVEFSKEEWGQLDSAVKNLYRNVMLENFRNLNSLRKAYLLSKPVESLKLESKKKR

SEQ ID NO: 6507 - protein, 81 aa, Macaca mulatta
ERSSGDSEMVALLTALSQGLVTFKDVAVCFSQDQWSDLDPTQKEFYGEYVLEEDCGIVVSLDRSKDEEECLEQEDLSLEDI

SEQ ID NO: 6508 - protein, 81 aa, Macaca mulatta
ENTGEEGMAAGLLTAGPRGSTFFSSVTVAFAQEGWRCLVSTPRERYKEGIPEKSRNLVLLGLPVSQPGMNSQLEQREGTWM

SEQ ID NO: 6509 - protein, 81 aa, Macaca mulatta
MAAGLLTAGPRGSTFFSSVTVAFAQEGWRCLVSTPRERYKEGIPEKSRNLVLLGLPVSQPGMNSQLEQREGTWMLEGEDVR

SEQ ID NO: 6510 - protein, 81 aa, Macaca mulatta
DRRRSAGTIKEAGRPLEMAVSEPETSAAEWKQLDPAQRNVYHDVMLENYSNQASMGYQAPKPDLISKLEKGEAPWLGKGKR

SEQ ID NO: 6511 - protein, 81 aa, Macaca mulatta
RRRSAGTIKEAGRPLEMAVSEPETSAAKEWKQLDPAQRNVYHDVMLENYSNQASMGYQAPKPDLISKLEKGEAPWLGKGKR

SEQ ID NO: 6512 - protein, 81 aa, Macaca mulatta
EAGRPLEMAVSEPETSAAVSVTFKHVTMTFTQKEWKQLDPAQRNVYHDVMLENYSNQASMGYQAPKPDLISKLEKGEAPWL

SEQ ID NO: 6513 - protein, 81 aa, Macaca mulatta
ENSKEDKMVAVCPNTESRESITLKDVAVNFSRGEWKKLEPFQKELYKEVLLENFRNLEFLDFPVSKLELISQLKWVELPWL

SEQ ID NO: 6514 - protein, 81 aa, Macaca mulatta
MMENYGNLVSLDVLNRDKDEEPTVKQEIEEIEEEVEPQGVIVTRIKSEIDQDPMSRETFELVGRLDKQRGIFLWEIPRESL

SEQ ID NO: 6515 - protein, 81 aa, Macaca mulatta
MASPSPPPESKEEWDYLDPAQRSLYKDVMMENYGNLVSLGLTVLLRLVCSDANMACCSLNLLGLSDQSSHLSYLSSWDYRC

SEQ ID NO: 6516 - protein, 81 aa, Macaca mulatta
MAPGLLTTREEALMAFRDVAVAFTQKEWKLLSSAQRTLYREVMLENYSHLVSLGIAFSKPKLIEQLEQGNEPWREENEHLL

SEQ ID NO: 6517 - protein, 81 aa, Macaca mulatta
LENYSHLVSLGIAFSKPKLIEQLEQGNEPWREENEHLLDLCPGEWGTLGRRGCRAVRSTAGKEGGAVFGVLGGSSSSSGLL

SEQ ID NO: 6518 - protein, 81 aa, Macaca mulatta
MTKSLESVSFKDVTVDFSRDEWQQLDLAQKSLYREVMLENYFNLISVGCQVPKPEVIFSLEQEEPCMLDGEISGQSHPDGD

SEQ ID NO: 6519 - protein, 81 aa, Macaca mulatta
SPPISAPLSEEPKMTKSLESVSFKDVTVDFSRDEWQQLDLAQKSLYREVMLENYFNLISVGCQVPKPEVIFSLEQEEPCML

SEQ ID NO: 6520 - protein, 81 aa, Macaca mulatta
MTKSLESVSFKDVTVDFSRDEWQQLDLAQKSLYREVMLENYFNLISVGCQVPKPEVIFSLEQEEPCMLDGEISGQSHPAPS

SEQ ID NO: 6521 - protein, 81 aa, Macaca mulatta
MNISQASVSFQDVTVEFTQEEWQHLGPVERTLYRDVMLENYSHLISVGYCITKPKVISRLEQGEEPWSLEDEFLNQKHQGY

SEQ ID NO: 6522 - protein, 81 aa, Macaca mulatta
MLENYSHLISVGYCITKPKVISRLEQGEEPWSLEDEFLNQKHQGYFKVDHIKGIWEKQEKPLWQEIFISDADKTLSKEREK

SEQ ID NO: 6523 - protein, 81 aa, Macaca mulatta
MNTFQASVSFKDVTVEFTQEEWQHMGPVERTLYRDVMLENYSHLVSVGYCFTKPELIFTLEQGEDPWLLEKEKGFLSRNSP

SEQ ID NO: 6524 - protein, 81 aa, Macaca mulatta
PLRFSTLFQEQQKMNISQASVSFKDVTIEFTQEEWQQMAPVQKNLYRDVMLENYSNLVSVGYCHFKPEVIFKLEQGEEPWF

SEQ ID NO: 6525 - protein, 81 aa, Macaca mulatta
EFTQEEWQQMAPVQKNLYRDVMLENYSNLVSVGYCHFKPEVIFKLEQGEEPWFSEEEFSNQSHPSELLSSSRHNSVGVVRL

SEQ ID NO: 6526 - protein, 81 aa, Macaca mulatta
VLSQEATAFEDMTKYWNYLEAFQKDCYRDTMLDSYENTVPQASFLQFSMMPQRAGNDPPGVSNVNEMEMEISNMRETFLMS

SEQ ID NO: 6527 - protein, 81 aa, Macaca mulatta
LQGKYGNVTKEVIVLYLTLCKQCHQKNPVPKKGLPPKPLTFKDIDSTCQVEILDMQSSADGEFKFILYYQDHLTKFIILRP

SEQ ID NO: 6528 - protein, 81 aa, Macaca mulatta
LLLIPGPQTVWSLWQQPVLSQEATAFEDMTKYWNYLEAFQKDCYRDTMLDSYENTVPQASFLQFSMMPQRAGNDPPGVSNV

SEQ ID NO: 6529 - protein, 81 aa, Macaca mulatta
ASQPARPEERLIRDQDLGASLLPAAPQEQWRHLDSTQKEQYWDLMLETYGKMVSGAGISHSKPDLTNSIEYGEELAGLYLH

SEQ ID NO: 6530 - protein, 81 aa, Macaca mulatta
ASQPARPEERLIRDQDLGASLLPAAPQEQWRHLDSTQKEQYWDLMLETYGKMVSGGISHSKPDLTNSIEYGEELAGLYLHV

SEQ ID NO: 6531 - protein, 81 aa, Macaca mulatta
ASQPARPEERLIRDQDLGASLLPAAPQEQWRHLDSTQKEQYWDLMLETYGKMVSGGDRQENDKENLNLENHRDQELLHASC

SEQ ID NO: 6532 - protein, 81 aa, Macaca mulatta
AASQPARPEERLIRDQDLGASLLPAAPQWRHLDSTQKEQYWDLMLETYGKMVSGGISHSKPDLTNSIEYGEELAGLYLHVN

SEQ ID NO: 6533 - protein, 81 aa, Macaca mulatta
EGEVAALRLTARSQETVTFKDVAMDFTPEEWGKLDPAQRDVMLENYRNLVSLWLPVSKPENYNLENGKEPLKLERKTPKSS

SEQ ID NO: 6534 - protein, 81 aa, Macaca mulatta
TQPDEDLHLHAEETKLVKESVTFKDVAIDFTLEEWRLMDPTQRNLHKDVMLENYRNLVSLGLAVSKPDMISHLENGKEPWV

SEQ ID NO: 6535 - protein, 81 aa, Macaca mulatta
TQPDEDLHLQAEETKLVKESVTFKDVAIDFTLEEWRLMDPTQRNLHKDVMLENYRNLVSLGLAVSKPDMISHLENGKGPWV

SEQ ID NO: 6536 - protein, 81 aa, Macaca mulatta
PEVTQPDEDLHLQAEETKLVKESVTFKDVAIDFTLEEWRLMDPTQRNLHKDVMLENYRNLVSLGLAVSKPDMISHLENGKG

SEQ ID NO: 6537 - protein, 81 aa, Macaca mulatta
PRGKHAFQAGWLNDLVTKESMTFKDVAVDITQEDWELMRPVQKELYKTVTLQNYWNMVSLGLTVYRPTVIPMLEEPWMVIK

SEQ ID NO: 6538 - protein, 81 aa, Macaca mulatta
MVTCAHLGRRARLPAAQLSDCPGTRFSQEERMAAGYLPCRSQELVTFEDVSVDFSQEEWELLEPAQKNLYREVMLENYRNV

SEQ ID NO: 6539 - protein, 81 aa, Macaca mulatta
RFSQEERMAAGYLPCRSQELVTFEDVSVDFSQEEWELLEPAQKNLYREVMLENYRNVVSLEALKNQCTDAGIKKGSLSPAQ

SEQ ID NO: 6540 - protein, 81 aa, Macaca mulatta
MLETFRNLASVDDETQFKASGSVSQQDIYGEKIPKESKIAAFTRNVSWASVLGKIWDSLSIEDQPTKQGRNLSRNHVLERV

SEQ ID NO: 6541 - protein, 81 aa, Macaca mulatta
EKIPKESKIAAFTRNVSWASVLGKIWDSLSIEDQPTKQGRNLSRNHVLERVCESNDQCGEAFSQIPHLNLYKKIPPGVKQC

SEQ ID NO: 6542 - protein, 81 aa, Macaca mulatta
MDTVVFEDVVVGFTLEEWALLNPAQRNLYREVMLETFKHLASVDNEAQPKTNGSISQQDTSGEKLSLKLKIEKFTRKHTWA

SEQ ID NO: 6543 - protein, 81 aa, Macaca mulatta
MDSVVFEDVAVDFTLEEWALLDSAQRNLYRDVMLETFRNLASVDNKTHFKASGSVSQQDTYREEKSKEQTIPNFTRNNSCA

SEQ ID NO: 6544 - protein, 81 aa, Macaca mulatta
MDSVVFEEVAVNFTPEEWALLDHAQRSLYRDVMLETCRNLACCIYVRTSGSSSQRDVLGNGISNDEEIVKFTSDYWSIFGE

SEQ ID NO: 6545 - protein, 81 aa, Macaca mulatta
GGAGRAPGPRERGHSGRPDSVVFEEVAVNFTPEEWALLDHAQRSLYRDVMLETCRNLASLDCCIYVRTSGSSSQRDVLGNG

SEQ ID NO: 6546 - protein, 81 aa, Macaca mulatta
MDSVVFEEVAVNFTPEEWALLDHAQRSLYRDVMLETCRNLASLDCCIYVRTSGSSSQRDVLGNGISNDEEIVKFTSDYWSI

SEQ ID NO: 6547 - protein, 81 aa, Macaca mulatta
GHTEGGGLVNELLTSWLKGLVTFEDVAVEFTQEEWALLDPAQRTLYRDVMLENFRNVASLGDQVDKPGLITQLEQEDEVMT

SEQ ID NO: 6548 - protein, 81 aa, Macaca mulatta
MLENFRNVASLGDQVDKPGLITQLEQEDEVMTEERGILPDVENPFKAKGLTPKLHVFQKEQSGNMKMERNHLGAEFSECNQ

SEQ ID NO: 6549 - protein, 81 aa, Macaca mulatta
GHTESGELVDELLTSWLRGLVTFEDVAVEFTQEEWALLDPAQRTLYRDVMLENCRNLASLGCRVNKPSLISQLEQDKKVMT

SEQ ID NO: 6550 - protein, 81 aa, Macaca mulatta
SSKDRSCPQNLDLFACSGLEPHTPSVGSQESVTFQDVAVDFTEKEWPLLDSSQRKLYKDVMLENYSNLTSLEILAPPLCCS

SEQ ID NO: 6551 - protein, 81 aa, Macaca mulatta
MEEERTTVELQKNSIQDSVVFEDVAVDFTQEEWALLDLAQRNLYREVMLENFQNLASLGYLLHTPHLICQWEQEEDLQTVK

SEQ ID NO: 6552 - protein, 81 aa, Macaca mulatta
MAAGWLTTWSQNSVTFQEVAVDFSQEEWALLDPAQKNLYKDVMLENFRNLASVGYQLCRHSLISKVDQEELKTDERGILQG

SEQ ID NO: 6553 - protein, 81 aa, Macaca mulatta
MVAGWLTSYSQDSVTFEDVAVDFTQEEWTLLDQTQRNLYRDVMLENYNNLVAVDWESHINTKWSAPQQNFLQGKTSSVVEM

SEQ ID NO: 6554 - protein, 81 aa, Macaca mulatta
EKTEVERVVAGCLTSCYQDSVTFDDLAVDFTPEEWTLLDPTQRNLYRDVMLENYKNLATVGYQLFKPSLISWLEQEESRTV

SEQ ID NO: 6555 - protein, 81 aa, Macaca mulatta
MAYFLTNCYQDLLIFEDTAVDFTQEEWTLLDPVQRNLYRDVMLENYENVAKVGFQLLKPSVISWLEEEELRTLQQGVLQDR

SEQ ID NO: 6556 - protein, 81 aa, Macaca mulatta
SALQQDFWKIQISNGIQTDLVTFDSVAVEFTQEEWTLLDPTQRNLYCDVMLENYKNLSSVGYQLFKPSLISWLEEEEELST

SEQ ID NO: 6557 - protein, 81 aa, Macaca mulatta
EKTPAGRIASDCLTGCYQDSVTFDDVAVDFTQEEWTLLDPTQRSLYSDVMLENYKNLATVGGQIIKPSLISWLEQEESRTV

SEQ ID NO: 6558 - protein, 81 aa, Macaca mulatta
MDSVTFDDVAVDFTQEEWTLLDPTQRSLYSDVMLENYKNLATVGGQIIKPSLISWLEQEESRTVRGGVLQGWEMQLETQWS

SEQ ID NO: 6559 - protein, 81 aa, Macaca mulatta
EKTKAERMVEDYLANSYQDSVTFDDVAVDFTPEEWALLDTTEKYLYRDVMLENYMNLASVEWEIQPRIKRSSFQQGFLKNQ

SEQ ID NO: 6560 - protein, 81 aa, Macaca mulatta
EKTKVERMVEDYLANSYQDSVTFDDVAVEFTPEEWVLLDTTQKYLYRDVMLENYMNLASVDFFFCLTSEWEIQPRTKRSSL

SEQ ID NO: 6561 - protein, 81 aa, Macaca mulatta
MVEDYLANSYQDSVTFDDVAVEFTPEEWVLLDTTQKYLYRDVMLENYMNLASVDFFFCLTSEWEIQPRTKRSSLQQGFLKN

SEQ ID NO: 6562 - protein, 81 aa, Macaca mulatta
MDSSQHLVTFEDVAVDFTQEEWTLLDQTQRDLYRDVMLENYKNLIILAGSEFCKPSLMSELEQMEELRTGVTGVLQGEKQY

SEQ ID NO: 6563 - protein, 81 aa, Macaca mulatta
MDSSQHLVTFEDVAVDFTQEEWTLLDQTQRDLYRDVMLENYKNLIILAGSEFCKPSLMSELEQMEELRTGVTGVLQELDLQ

SEQ ID NO: 6564 - protein, 81 aa, Macaca mulatta
MDSSQHLVTFEDVAVDFTQEEWTLLDQTQRDLYRDVMLENYKNLIILGSEFCKPSLMSELEQMEELRTGVTGVLQELDLQL

SEQ ID NO: 6565 - protein, 81 aa, Macaca mulatta
MDSVAFEDVAVNFTLEEWALLDPSQKNLYRDVMRETFRNLASIGKQWEDQNIEDPFKIPRRNISHIPERLCEGKEGSQGEE

SEQ ID NO: 6566 - protein, 81 aa, Macaca mulatta
MDSVAFEDVAVNFTQEEWALLGPSQKSLYRNVMQETIRNLDCIETKWEDQNIGDQCQNPRRNLRSHTCEIKDDSQCGETFG

SEQ ID NO: 6567 - protein, 81 aa, Macaca mulatta
MDPVAFEDVAVNFTQEEWALLDIFQKNLYREVMLETFRNLTSIGNSWKDQNIEYEYQNPRRNFRSLIEEKVNEIKENSHCG

SEQ ID NO: 6568 - protein, 81 aa, Macaca mulatta
PPVLSLSPILLYTCEMFQDPVAFEDVAVNFTQEEWALLDIFQKNLYREVMLETFRNLTSIGNSWKDQNIEYEYQNPRRNFR

SEQ ID NO: 6569 - protein, 81 aa, Macaca mulatta
MFQDPVAFEDVAVNFTQEEWALLDIFQKNLYREVMLETFRNLTSIGNSWKDQNIEYEYQNPRRNFRSLIEEKVNEIKENSH

SEQ ID NO: 6570 - protein, 81 aa, Macaca mulatta
MMFQDPVAFEDVAVNFTQEEWALLDIFQKNLYREVMLETFRNLTSIGNSWKDQNIEYEYQNPRRNFRSLIEEKVNEIKENS

SEQ ID NO: 6571 - protein, 81 aa, Macaca mulatta
CSHRRCREDPGTSESQEMDPVAFEDVAVNFTREEWALLDIFQKNLYREVMLETFRNLTSIGKSWKDQNIEYEYQNPRRNFR

SEQ ID NO: 6572 - protein, 81 aa, Macaca mulatta
MPCCSHRRCREDPGTSESQEMEEWALLDIFQKNLYREVMLETFRNLTSIGKSWKDQNIEYEYQNPRRNFRSLIEEKVNEIK

SEQ ID NO: 6573 - protein, 81 aa, Macaca mulatta
NKVVSSCPTGRWSPECSCDPVAFEDVAVNFTQEEWTLLDISQKNLFREVMLETFRNLTSIGKKWKDKNIEYEYKIPRRSFR

SEQ ID NO: 6574 - protein, 81 aa, Macaca mulatta
RFQSADVCFNVKMDQWLCDSVAFEDVAVTFTQEEWALLDPSQKTLYRDVMQETFRNLASVGKKWKAQNMYVEYENLKRNLR

SEQ ID NO: 6575 - protein, 81 aa, Macaca mulatta
MDSVAFEDVAVTFTQEEWALLDPSQKTLYRDVMQETFRNLASVGKKWKAQNMYVEYENLKRNLRTFVGERLFESKEGHQHG

SEQ ID NO: 6576 - protein, 81 aa, Macaca mulatta
LLVLPILLYTCEMFQDSVAFEDVAVTFTQEEWALLDPSQKTLYRDVMQETFRNLASVGKKWKAQNMYVEYENLKRNLRTFV

SEQ ID NO: 6577 - protein, 81 aa, Macaca mulatta
MDSVAFEDVAVNFTQEEWALLDPSQKNLYREVMQETLRNLASIGKKWNNQYIEDEHQNPRRNLRRLTKERLSESEESHQHG

SEQ ID NO: 6578 - protein, 81 aa, Macaca mulatta
MDSVAFEDVAVNFTQEEWSLLDPSQKNLYREVMQETLRNLASIGEKWKDENIEDQYKNPRNNLRSLLGERVDENTEENHCG

SEQ ID NO: 6579 - protein, 81 aa, Macaca mulatta
MDSVAFEDVAVSFTQDEWALLDPSQKNLYRDVMQETFKNLTSVGKTWKIQNMEDKYKNPRRNLRWSFTLVAQAGVQWCDLG

SEQ ID NO: 6580 - protein, 81 aa, Macaca mulatta
MMFQDSVAFEDVAVSFTQDEWALLDPSQKNLYRDVMQETFKNLTSVGKTWKIQNMEDKYKNPRRNLSLMREKLFESKESHH

SEQ ID NO: 6581 - protein, 81 aa, Macaca mulatta
MDSVAFEDVAVSFTQDEWALLDPSQKNLYRDVMQETFKNLTSVGKTWKIQNMEDKYKNPRRNLSLMREKLFESKESHHCGE

SEQ ID NO: 6582 - protein, 81 aa, Macaca mulatta
MDSVAFEDVDVNFTQDEWALLDPSQKNLYRDVMQETFRNLASVGKKWKDQKIEDEYKNSRRNLRGLMGERLLESKKDHQHG

SEQ ID NO: 6583 - protein, 81 aa, Macaca mulatta
NRHHRADTGHKTYEYQEYGQKPYKCTYCKKAFSDLPYFRTHEWAHTGGKPYDCEECGKSFISRSSIRRHRIMHSGDGPYKC

SEQ ID NO: 6584 - protein, 81 aa, Macaca mulatta
DSVAFEDVDVNFTQDEWALLDPSQKNLYRDVMQETFRNLASVGKKWKDQKIEDEYKNSRRNLSLRKWSWLYPRQTRLNSPV

SEQ ID NO: 6585 - protein, 81 aa, Macaca mulatta
MDSVAFEDVDVNFTQEEWALLDPSQKNLYRDVMWETMRNLASIGKKWKDKNIKDHYKHRRRNLRSHMLERFYQSKDGSQRG

SEQ ID NO: 6586 - protein, 81 aa, Macaca mulatta
TLPRGQSEVLGWGLPKDQDSVAFEDVAVNFTHEEWALLGPSQKNLYRDVMRETIRNLNCVGMKWENQNIDDQYQNLRRNPS

SEQ ID NO: 6587 - protein, 81 aa, Macaca mulatta
QKNLYRDVMRETIRNLNCVGMKWENQNIDDQYQNLRRNPSISVTLQNFMLIHYGHLVALSDGGLQFSTGQGLPVTQAGVQW

SEQ ID NO: 6588 - protein, 81 aa, Macaca mulatta
MDSVTFEDVAVNFTQEEWALLDPSQKKLYRDVMWETFRNLASIGTKQKEWNTEEQYKNQGRNLRNHMVERLCESEEGSHGE

SEQ ID NO: 6589 - protein, 81 aa, Macaca mulatta
MDSVAFEDVAVNFTHEEWALLGPSQKNLYRDVMRETIRNLNCVGMKWENQNIDDQYQNLRRNPRCDVVERFGKSKDGSQCE

SEQ ID NO: 6590 - protein, 81 aa, Macaca mulatta
MDTVAFEDVAVNFTQEEWALLGPSQKNLYRYVMQETIRNLDCIRKIWEGQNTEDQKKNPRRNLRCHMLERFSESKDSSQCG

SEQ ID NO: 6591 - protein, 81 aa, Macaca mulatta
HTHKQRGKAFSYHHSFPSRGRPHTGKKRYECKECGKTFSSRRNLRRHMVVQGGNRPYKFPIDMRECTLGRNRMNVSSVLRP

SEQ ID NO: 6592 - protein, 81 aa, Macaca mulatta
RNDFFLPDSQTSEERKQYDSVAFEDVAVNFTREEWALLGPSQKTLYRDVMWETIRNLNCIGMKWEDTDVEDQHKNPRRSLR

SEQ ID NO: 6593 - protein, 81 aa, Macaca mulatta
MASVALGDVAVNFTREEWALLGPCQKNLYKDVMQETIRNLDCVGMKWKDQFLFKDQIEDQYKYPRKNLRCRMLERFGESKD

SEQ ID NO: 6594 - protein, 81 aa, Macaca mulatta
MDSVASEDVAVNFTLEEWALLDPSQKKLYRDVMRETFRNLACVGKKWEDQSIEDWYKNQGRILSNHTEEGLSESKEYDQCG

SEQ ID NO: 6595 - protein, 81 aa, Macaca mulatta
VLQMQNSEHHGQSIKTQTDSISLEDVAVNFTLEEWALLDPGQRNIYRDVMRATFKNLACIGEKWKDQDVEDDPKNQGRKPS

SEQ ID NO: 6596 - protein, 81 aa, Macaca mulatta
MDSISLEDVAVNFTLEEWALLDPGQRNIYRDVMRATFKNLACIGEKWKDQDVEDDPKNQGRKPSSPMVETLCENKEDRPCG

SEQ ID NO: 6597 - protein, 81 aa, Macaca mulatta
LRLQDSISLEDVAVNFTLEEWALLDPGQRNIYRDVMRATFKNLACIGEKWKDQDVEDDPKNQGRKPSSPMVETLCENKEDR

SEQ ID NO: 6598 - protein, 81 aa, Macaca mulatta
MDSVAFEDVSVSFSQEEWALLAPSQKKLYRDVMQETFKNLASIGEKWEDQNVEDQHKNQGRNLRSHMGERLCEGKESSQCA

SEQ ID NO: 6599 - protein, 81 aa, Macaca mulatta
MDSVAFEDVSVSFSQEEWALLAPSQKKLYRDVMQETFKNLASIGEKWEDQNVEDQHKNQGRNLSKTVSGRSLRRYSRKKAL

SEQ ID NO: 6600 - protein, 81 aa, Macaca mulatta
MESVTLEDVAVEFIQEWALLDSARRSLCRYGMLDQCRTLTSRGTPPCKPSRVSQLGPRAEPRATERGILHATGVAWESQLK

SEQ ID NO: 6601 - protein, 81 aa, Macaca mulatta
EDRVEEEAMAPGLPTACSQEPVTFADVAVVFTPEEWVFLDSTQRSLYRDVMLENYRNLASVADQLCKPNASSYLEQRGEQW

SEQ ID NO: 6602 - protein, 81 aa, Macaca mulatta
MESVTLEDVAVEFIQEWALLDSARRSLCRYGMLDQCRTLTSRGAGAVPEDAAGALRRSEGDTIDSRGPASSPGAALVSGIH

SEQ ID NO: 6603 - protein, 81 aa, Macaca mulatta
MDSVAFEDVAVNFTQEEWALLSPSQKNLYRDVMLEAFRNLASVGIQWKDQDTENLYQNLGIKLRSLVERLCGRKEGSEHRE

SEQ ID NO: 6604 - protein, 81 aa, Macaca mulatta
WALLSPSQKNLYRDVMLEAFRNLASVGIQWKDQDTENLYQNLGIKLRSLVERLCGRKEGSEHRETFRQIPDCHLNKKVILE

SEQ ID NO: 6605 - protein, 81 aa, Macaca mulatta
MDSVAFEDVAVNFTQEEWALLSPSQKNLYRDVMLEAFRNLASVGIQWKDQDTENLYQNLGIKLRHMRAHAGHTRSECGGEW

SEQ ID NO: 6606 - protein, 81 aa, Macaca mulatta
MNSVSFEDVAVNFTLEEWALLDSSQKKLYEDVMQETFKNLVCLGKKWEDQDIEDDHRNQGRNRRGHMVERLCESRKGSKCG

SEQ ID NO: 6607 - protein, 81 aa, Macaca mulatta
PASESRVTGITSVHHHAWGPLQFRDVAIEFSLEEWHCLDTAQRNLYRDVMLENYRNLVFLGIVVSKPDLITCLEQGKKPLT

SEQ ID NO: 6608 - protein, 81 aa, Macaca mulatta
LRRYEKCGHDNLQLKKGCESVDECPVHKRGYNGLKQCLTTTQRKIFHCDEYVKFLPKFSNSNRHKIRIRDTGKKPFKCIEY

SEQ ID NO: 6609 - protein, 81 aa, Macaca mulatta
MGPLQFRDVAIEFSLEEWHCLDTAQRNLYRDVMLENYRNLVFLVICSHFAQDVWSEQSIKDSFQKVILRRYEKCGHDNLQL

SEQ ID NO: 6610 - protein, 81 aa, Macaca mulatta
MGPLQFRDVAIEFSLEEWHCLDTAQRNLYRDVMLENYRNLVFLGIVVSKPDLVTCLEQGKKPMERHEMIAKPPVMSSHFAQ

SEQ ID NO: 6611 - protein, 81 aa, Macaca mulatta
KRYEKCRHDNLQFKKGCKSMGEHKVHKRGYNGLNQCLTTTQKKIFQCDKYGKVFPKFSNSNTYKIRHTGINLFKCIICGKA

SEQ ID NO: 6612 - protein, 81 aa, Macaca mulatta
GPLQFRDVAIEFSLEEWHCLDTAQRNLYRDVMLENYRNLVFLGIVVSKPDLVTCLEQGKKPMERHEMIAKPPVMSSHFAQD

SEQ ID NO: 6613 - protein, 81 aa, Macaca mulatta
MGPLQFRDVAIEFSLEEWHCLDTAQRNLYKNVMLENYSNLVFLGIVVSKPDLITRLEQGKKPLTVKRHEMVAKPPVMCSHF

SEQ ID NO: 6614 - protein, 81 aa, Macaca mulatta
MGPLQFRDVAIEFSLEEWHCLDTAQRNLYKNVMLENYSNLVFLGIVVSKPDLITRLEQGKKPLTVKRHEMVAKPPGSRLLS

SEQ ID NO: 6615 - protein, 81 aa, Macaca mulatta
MELLTFRDVTIEFSLEEWEFLKPAQQNLYRKVMLENYRNLVSLGLTVSKPELISCLEQRQEPWNVKRRETIAKPSGTYRCG

SEQ ID NO: 6616 - protein, 81 aa, Macaca mulatta
MLENYRNLVSLGLTVSKPELISCLEQRQEPWNVKRRETIAKPSAVSSHCTEDFLPEQGMKDSFQKVILRRYGSCGLEDLHL

SEQ ID NO: 6617 - protein, 81 aa, Macaca mulatta
MELLTFRDVTIEFSLEEWEFLKPAQQNLYRKVMLENYRNLVSLGLTVSKPELISCLEQRQEPWNVKRRETIAKPSAVSSHC

SEQ ID NO: 6618 - protein, 81 aa, Macaca mulatta
EQGMKDSFQKVILRRYGSCGLEDLHLRKDGENVGECKDQKEIYNGLNQCLSTLPSKIFPYNKCVKVFSKSSSLKRQSIRHT

SEQ ID NO: 6619 - protein, 81 aa, Macaca mulatta
MELLTFRDVTIEFSLEEWEFLKPAQQNLYRKVMLENYRNLVSLGLTVSKPELISCLEQRQEPWNVKRRETIAKPSDYHLTI

SEQ ID NO: 6620 - protein, 81 aa, Macaca mulatta
MEPLQFRDVAIEFSLEEWHCLDTAQQNLYRHVMLENYRNLVFLGIVVSKPDLITRLEQGENPLTVKRHKMTANPSVMCSHF

SEQ ID NO: 6621 - protein, 81 aa, Macaca mulatta
MGPLQFRDVAIEFSLEEWHCLDTAQRNLYRNVMLENYRNLVFLGIVVSKPDLITCLEQGEKPLTMKKHEMVANPSVLCSHF

SEQ ID NO: 6622 - protein, 81 aa, Macaca mulatta
MGPLQFRDVAIEFSLEEWHCLDTAQRNLYRNVMLENYRNLVFLGIVVSKPDLITCLEQGEKPLTMKKHEMVANPSGRTDHK

SEQ ID NO: 6623 - protein, 81 aa, Macaca mulatta
GIGRSTAKTPGPPGSLEMGPLQFRDVAIEFSLEEWHCLDTAQRNLYRDVMLENYRNLVFLGIIVSKPDLITRLEQGKKPLT

SEQ ID NO: 6624 - protein, 81 aa, Macaca mulatta
MGPLQFRDVAIEFSLEEWHCLDTAQRNLYRDVMLENYRNLVFLGIIVSKPDLITRLEQGKKPLTMKRHEMVGKPPVLCSHF

SEQ ID NO: 6625 - protein, 81 aa, Macaca mulatta
MLENYRNLVFLGIIVSKPDLITRLEQGKKPLTMKRHEMVGKPPVLCSHFTQDLWPEQSIKNSFQKLILRRYEKYGHDNLQF

SEQ ID NO: 6626 - protein, 81 aa, Macaca mulatta
MGPLTFRDVAIEFSLKEWQCLDTAQRNLYRNVMLENYRNLVFLGIAVSKPDLITCLEQGKEAWSMKRHEIMVAKSPVMCSH

SEQ ID NO: 6627 - protein, 81 aa, Macaca mulatta
GPLTFRDVAIEFSLKEWQCLDTAQRNLYRNVMLENYRNLVFLGIAVSKPDLITCLEQGKEAWSMKRHEIMVAKSPVMCSHF

SEQ ID NO: 6628 - protein, 81 aa, Macaca mulatta
ANGCPGAERNLLVYSFYEKGPLTFRDVAIEFSLEEWQCLDTAQQDLYRKVMLENYRNLVFLAGIAVSNPDLITCLEQGKEP

SEQ ID NO: 6629 - protein, 81 aa, Macaca mulatta
NGCPGAERNLLVYSFYEKGPLTFRDVAIEFSLEEWQCLDTAQQDLYRKVMLENYRNLVFLGIAVSNPDLITCLEQGKEPWN

SEQ ID NO: 6630 - protein, 81 aa, Macaca mulatta
SGSVGAERKLLVHSYFEKETLTFRDVAVEFSLEEWECLNPAQQNLYRNVMLENYKNLVFLGIDISKQDPITSLEQEKEPWN

SEQ ID NO: 6631 - protein, 81 aa, Macaca mulatta
RNVMLENYKNLVFLGIDISKQDPITSLEQEKEPWNMKRHEMVDESPGQVWLTPVISALWEARAGGLLEPRSLRPAWSTWKN

SEQ ID NO: 6632 - protein, 81 aa, Macaca mulatta
RNVMLENYKNLVFLGIDISKQDPITSLEQEKEPWNMKRHEMVDESPAVCSYFTKDLWPEQDIKDSFQQVILRRYRKCEHEN

SEQ ID NO: 6633 - protein, 81 aa, Macaca mulatta
ASGSVGAERKLLVHSYFEKETLTFRDVAVEFSLEEWECLNPAQQNLYRNVMLENYKNLVFLAVCSYFTKDLWPEQDIKDSF

SEQ ID NO: 6634 - protein, 81 aa, Macaca mulatta
SGCPAAERNLLVYSYFEKETLTFRDVAIEFSLEEWECLNPAQQNLYMNVMLENYKNLVFLGIAVSKQDPVTCLEQEKEPWN

SEQ ID NO: 6635 - protein, 81 aa, Macaca mulatta
ASGCPAAERNLLVYSYFEKETLTFRDVAIEFSLEEWECLNPAQQNLYMNVMLENYKNLVFLAGIAVSKQDPVTCLEQEKEP

SEQ ID NO: 6636 - protein, 81 aa, Macaca mulatta
MGLLTFMDVAVEFSLEEWQCLDTAQQNLYRNVMLENYRNLVFLGIAVSNLDLITCLEQGKEPWNMKRHEMVAKPPAMCSHF

SEQ ID NO: 6637 - protein, 81 aa, Macaca mulatta
GGYPGAERNLLEYSYFEKGPLTFRDVVIEFSQEEWQCLDTAQQDLYRKVMLENFRNLVFLGIDVSKPDLITCLEQGKDPWN

SEQ ID NO: 6638 - protein, 81 aa, Macaca mulatta
SQSAPQSAPEFSLPSSASGPLTFRDVAIEFSLEEWQCLDTAQQDLYRKVMLENYRNLVLAGIDVSKPNLITCLEQGKYPWN

SEQ ID NO: 6639 - protein, 81 aa, Macaca mulatta
MPGPPESLEMGPLTFRDVAIEFSLEEWQCLDTAQQDLYRKVMLENYRNLVLAGIDVSKPNLITCLEQGKYPWNMKRHSMVV

SEQ ID NO: 6640 - protein, 81 aa, Macaca mulatta
MPGPPESLEMGPLTFRDVAIEFSLEEWQCLDTAQQDLYRKVMLENYRNLVLGIDVSKPNLITCLEQGKYPWNMKRHSMVVK

SEQ ID NO: 6641 - protein, 81 aa, Macaca mulatta
MGPLTFRDVAIEFSLEEWQCLDTAQQDLYRKVMLENYRNLVLAGIDVSKPNLITCLEQGKYPWNMKRHSMVVKPPVICSHF

SEQ ID NO: 6642 - protein, 81 aa, Macaca mulatta
EFSLEEWQCLDTAQQDLYRKVMLENYRNLVLAGIDVSKPNLITCLEQGKYPWNMKRHSMVVKPPGGDCSIFLIEHQGDVTL

SEQ ID NO: 6643 - protein, 81 aa, Macaca mulatta
MGPLTFTDVAVEFSLEEWQCLDTAQQNLYRNVMLENYRNLVFLGITVSKPDLITCLEKEKEPWNMKRYEMVDEPPVICSHF

SEQ ID NO: 6644 - protein, 81 aa, Macaca mulatta
RRYDKCGPENLQLRKGYKTVGDCKLYKGDYNGLNQCLTPTQSKMYHCDIYVKVFYAFSNSDRYKTRLTGKKPFQCKKCDKS

SEQ ID NO: 6645 - protein, 81 aa, Macaca mulatta
MGPLTFTDVAVEFSLEEWQCLDTAQQNLYRNVMLENYRNLVFLGGVSLLLPRLECSGTISAHYNLHLPGSSDYPASASVAG

SEQ ID NO: 6646 - protein, 81 aa, Macaca mulatta
MGPLTFTDVAVEFSLEEWQCLDTAQQNLYRNVMLENYRNLVFLGITVSKPDLITCLEKEKEPWNMKRYEMVDEPPDNLKCF

SEQ ID NO: 6647 - protein, 81 aa, Macaca mulatta
MPSLTFMDVAIEFSLEEWQCLDTAQQNLYRNVMLENYRNLVFLGIVASKPDLITCLEKEKEPWNMKQHEIVDEPPVMRSHF

SEQ ID NO: 6648 - protein, 81 aa, Macaca mulatta
ASGCPGAERNLLVHSYFEKGPLTFRDVAIEFSLEEWQCLDTAQQGLYRKVMLENYRNLVFLAGIAVTKPDLITCLEQRKEP

SEQ ID NO: 6649 - protein, 81 aa, Macaca mulatta
MLENYRNLVFLGIAVTKPDLITCLEQRKEPWNIKRHEMVAKPSVICSHFAQDLWPERDIKDSFQESILKKYRNYEHDNLQL

SEQ ID NO: 6650 - protein, 81 aa, Macaca mulatta
SGCPGAERNLLVHSYFEKGPLTFRDVAIEFSLEEWQCLDTAQQGLYRKVMLENYRNLVFLGIAVTKPDLITCLEQRKEPWN

SEQ ID NO: 6651 - protein, 81 aa, Macaca mulatta
MGPLTFMDVAIEFCLEEWQCLDTAQQNLYRNVMLENYRNLVFLGIAVSKPDLITCLEQEKEPWEPMRRHEMVAKPSVMCSH

SEQ ID NO: 6652 - protein, 81 aa, Macaca mulatta
MDVAIEFCLEEWQCLDTAQQNLYRNVMLENYRNLVFLGIAVSKPDLITCLEQEKEPWEPMRRHEMVAKPSVMCSHVAQDFW

SEQ ID NO: 6653 - protein, 81 aa, Macaca mulatta
VLGDPQLKTPGPSGSLEMGPLTFMDVAIEFCLEEWQCLDTAQQNLYRNVMLENYRNLVFLGIAVSKPDLITCLEQEKEPWE

SEQ ID NO: 6654 - protein, 81 aa, Macaca mulatta
MDVAIEFCLEEWQCLDTAQQNLYRNVMLENYRNLVFLGIAVSKPDLITCLEQEKEPWEPMRRHEMVAKPSGGIVSLLNVFF

SEQ ID NO: 6655 - protein, 81 aa, Macaca mulatta
MGPLTFRDVTVEFSLEEWQCLDTAQQNLYRDVMLENYRNLVFLGIAVSKPDLVTCLEQGKEPWNMKRHEMVAKTPVMCSHI

SEQ ID NO: 6656 - protein, 81 aa, Macaca mulatta
RRYDKCGRDNLQLRLGCKSVDECKVCKGDCNRLNQCLTTTQRKIYQCDEYEKVFYKFSNVDRHKIRHTEKKTCKCKECGKS

SEQ ID NO: 6657 - protein, 81 aa, Macaca mulatta
MGSLTFRDVAIELSLEEWQCLDTAQQNLYRNVMLENYRNLVFLGIAAFKPDLIIFLEQGKEPWNMKRHEMVEEPPVICSHF

SEQ ID NO: 6658 - protein, 81 aa, Macaca mulatta
MGPLTFRDVTVEFSLEEWQCLDTVQQNLYRDVMLENYRNLVFLGIAVSKPDLITCLEEGKEPWNMNRHEMVATPPGSHSVT

SEQ ID NO: 6659 - protein, 81 aa, Macaca mulatta
MGPLTFRDVTVEFSLEEWQCLDTVQQNLYRDVMLENYRNLVFLGIAVSKPDLITCLEEGKEPWNMNRHEMVATPPDRVSLF

SEQ ID NO: 6660 - protein, 81 aa, Macaca mulatta
MGPLTFRDVTVEFSLEEWQCLDTVQQNLYRDVMLENYRNLVFLGIAVSKPDLITCLEEGKEPWNMNRHEMVATPPVVCSHI

SEQ ID NO: 6661 - protein, 81 aa, Macaca mulatta
RRHDKCEHENLQLRKGCKSVDECKVCKGSYNGLNQCLITTQRKIYQCDKYVKVFYKFSNSDRHQIRHTEKKTCKCKECGKS

SEQ ID NO: 6662 - protein, 81 aa, Macaca mulatta
MGPLTFRDVTVEFSLEEWQCLDTVQQNLYRDVMLENYRNLVFLGIAVSKPDLITCLEEGKEPWNMNRHEMVATPPAFYLMG

SEQ ID NO: 6663 - protein, 81 aa, Macaca mulatta
MGSLTFRDVAVEFSLEEWQFLDTAQQNLYRNVMLENYRNLVFLGIAAFKPDLIIFLEQGKEPWNVKRYEMVEEPPVICSHF

SEQ ID NO: 6664 - protein, 81 aa, Macaca mulatta
MGSLRFRDVAIEFSVEEWQCLDTAQRNLYRNVMLENYRNLVFLGIAVPKPDLIIFLEQGKEPWNMKRHEMAEETPVICSHF

SEQ ID NO: 6665 - protein, 81 aa, Macaca mulatta
GPLTFQDVTIEFSLEEWQCLDTAQQTLYRDVMLENYRNLVFLGIAVSKLDLIACLKQGKESWNMKRHEMVTKPPVTRSHFT

SEQ ID NO: 6666 - protein, 81 aa, Macaca mulatta
IACLKQGKESWNMKRHEMVTKPPVTRSHFTQDLWPDQSMKDCFQEVILRTYTRCGRKNLQLRKDCKSANECKMHKEGYNKL

SEQ ID NO: 6667 - protein, 81 aa, Macaca mulatta
LIACLKQGKESWNMKRHEMVTKPPVTRSHFTQDLWPDQSMKDCFQEVILRTYTRCGRKNLQLRKDCKSANECKMHKEGYNK

SEQ ID NO: 6668 - protein, 81 aa, Macaca mulatta
GVLTFRDVAIEFSLEEWQCLDTAQQNLYRNVMLENYRNLVFLGIAASKPDLITCLEQGKEPWNVKRHEMGAELPVVCSYFA

SEQ ID NO: 6669 - protein, 81 aa, Macaca mulatta
MLENYRNLVFLGIAASKPDLITCLEQGKEPWNVKRHEMGAELPVVCSYFAQDLWPKQGIKNYFQKVILRRYKKYGHENLQL

SEQ ID NO: 6670 - protein, 81 aa, Macaca mulatta
MGPLTFMDVVIKFSPEEWQFLDTAQQNLYRDVMLENYRNLVFLGIGVPKPDLITCLEQGKEPWNMKRHKMVAKPPVVYSHF

SEQ ID NO: 6671 - protein, 81 aa, Macaca mulatta
GIGRSTAKSPGPPGSLDMGSLTFRDVAIEFSVEEWQCLDTAQQNLYRNVMLENYRNLVFLGIAVPKPDLIIFLEQGKEPWN

SEQ ID NO: 6672 - protein, 81 aa, Macaca mulatta
MGLLTFRDVAIEFSLEEWQRLDAAQQNLYRNVMLENYRNLAFLGIAVSKPDLITCLEQGKEPWNMKRHEMVDKAPAICPHF

SEQ ID NO: 6673 - protein, 81 aa, Macaca mulatta
MGLLTFRDVAIEFSLEEWQCLDTAQKNLYRNVMLENYRNLAFLGVAVSKPDLIICLEKDKEPWNMKRHEMVDEPPGLTVSN

SEQ ID NO: 6674 - protein, 81 aa, Macaca mulatta
MEPLKFRDVAVEFSLEEWQCLDTIQQNLYRNVMLENYRNLVFLGIAVSKPDLITCLEQEKEPWTRKRHRMVAKPVTCSHFA

SEQ ID NO: 6675 - protein, 81 aa, Macaca mulatta
FLGIAVSKPDLITCLEQEKEPWTRKRHRMVAKPVTCSHFAQDFSPEQNIKDSFQKVTLRRHGKCEHENLQLRKCGKSVDEC

SEQ ID NO: 6676 - protein, 81 aa, Macaca mulatta
MGLLTFRDVAVEFSLEEWQCLDTAQRNLYKNVILENYRNLVFLGIAVSKPDLITCLEQEKEPLTMQRHEMVDEPPALDKHH

SEQ ID NO: 6677 - protein, 81 aa, Macaca mulatta
MGLLTFRDVAVEFSLEEWQCLDTAQRNLYKNVILENYRNLVFLGIAVSKPDLITCLEQEKEPLTMQRHEMVDEPPVMCSHF

SEQ ID NO: 6678 - protein, 81 aa, Macaca mulatta
MGLLTFRDVAVEFSLEEWQCLDTAQRNLYKNVILENYRNLVFLGIAVSKPDLITCLEQEKEPLTMQRHEMVDEPPESHSVT

SEQ ID NO: 6679 - protein, 81 aa, Macaca mulatta
MGLLTFRDVAIEFSLEEWQHLDIAQQNLYRNVMLENYRNLAFLGIAVSKPDLIICLEQGKEPWNMTQHEMVDESPGICPRF

SEQ ID NO: 6680 - protein, 81 aa, Macaca mulatta
MPGPPRGLEMGLLTFRDVAIEFSLEEWQHLDIAQQNLYRNVMLENYRNLAFLGIAVSKPDLIICLEQGKEPWNMTQHEMVD

SEQ ID NO: 6681 - protein, 81 aa, Macaca mulatta
MGLLTFRDVAIEFSLEEWQHLDIAQQNLYRNVMLENYRNLAFLGIAVSKPDLIICLEQGKEPWNMTQHEMVDESPGGVLLC

SEQ ID NO: 6682 - protein, 81 aa, Macaca mulatta
MAQVTFSDVAIDFSHEEWAWLDSAQRDLYKDVMVQNYENLVSVAGLSITKPYVIMLLEDGKEPWMVEKKLSKVYPFPLSHS

SEQ ID NO: 6683 - protein, 81 aa, Macaca mulatta
MAQVTFSDVAIDFSHEEWAWLDSAQRDLYKDVMVQNYENLVSVAGLSITKPYVIMLLEDGKEPWMVEKKLSKGMIPDWESR

SEQ ID NO: 6684 - protein, 81 aa, Macaca mulatta
MAQVTFSDVAIDFSHEEWAWLDSAQRDLYKDVMVQNYENLVSVAGLSITKPYVIMLLEDGKEPWMVEKKLSKDWESRWENK

SEQ ID NO: 6685 - protein, 81 aa, Macaca mulatta
MAQVTFSDVAIDFSHEEWAWLDSAQRDLYKDVMVQNYENLVSVGLSITKPYVIMLLEDGKEPWMVEKKLSKGMIPVYPFPL

SEQ ID NO: 6686 - protein, 81 aa, Macaca mulatta
MAQVTFSDVAIDFSHEEWAWLDSAQRDLYKDVMVQNYENLVSVGLSITKPYVIMLLEDGKEPWMVEKKLSKDWESRWENKE

SEQ ID NO: 6687 - protein, 81 aa, Macaca mulatta
NEELVGQNHGMKGEACTGGDVTFSDVAIDFSHEEWAWLDSAQRDLYKDVMVQNYENLVSVGLSITKPYVIMLLEDGKEPWM

SEQ ID NO: 6688 - protein, 81 aa, Macaca mulatta
MAQVTFSDVAIDFSHEEWAWLDSAQRDLYKDVMVQNYENLVSVGLSITKPYVIMLLEDGKEPWMVEKKLSKVYPFPLSHSV

SEQ ID NO: 6689 - protein, 81 aa, Macaca mulatta
MSQVTFSDVAIDFSHEEWGWLDSAQRDLYKDVMVQNYENLVSVGLSVTKPYVIMLLEDGKEPWMVEKKLSKGMIPDWESRW

SEQ ID NO: 6690 - protein, 81 aa, Macaca mulatta
MSQVTFSDVAIDFSHEEWGWLDSAQRDLYKDVMVQNYENLVSVAGLSVTKPYVIMLLEDGKEPWMVEKKLSKGMIPDWESR

SEQ ID NO: 6691 - protein, 81 aa, Macaca mulatta
MAAPALALVSFEDVVVTFTGEEWGHLDLAQRTLYQEVMLETCRLLVSLGHPVPKPELIYLLEHGQDLWTVKRGLSQSTCAG

SEQ ID NO: 6692 - protein, 81 aa, Macaca mulatta
MAAPALALVSFEDVVVTFTGEEWGHLDLAQRTLYQEVMLETCRLLVSLGHPVPKPELIYLLEHGQDLWTVKRGLSQSTCAA

SEQ ID NO: 6693 - protein, 81 aa, Macaca mulatta
MAHKYVGLQFQGSVTFEDVAIAFSQQEWESLDSSQRGLYRDVMLENYRNLVSMAGHSLSKPHVIALLERWKEPKVTERKDG

SEQ ID NO: 6694 - protein, 81 aa, Macaca mulatta
MAHKYVGLQFQGSVTFEDVAIAFSQQEWESLDSSQRGLYRDVMLENYRNLVSMGHSLSKPHVIALLERWKEPKVTERKDGR

SEQ ID NO: 6695 - protein, 81 aa, Macaca mulatta
MAHFQGSVTFEDVAIAFSQQEWESLDSSQRGLYRDVMLENYRNLVSMGHSLSKPHVIALLERWKEPKVTERKDGRRWCTDL

SEQ ID NO: 6696 - protein, 81 aa, Macaca mulatta
MAHFQGSVTFEDVAIAFSQQEWESLDSSQRGLYRDVMLENYRNLVSMAGHSLSKPHVIALLERWKEPKVTERKDGRRWCTD

SEQ ID NO: 6697 - protein, 81 aa, Macaca mulatta
MAEAALRDPAQGCVTFEDVTIYFSQEEWGLLDEAQRLLYCDVMLENFALIASLGLISFRSHIVSQLEMGKEPWVPDSVDMT

SEQ ID NO: 6698 - protein, 81 aa, Macaca mulatta
ESREIRAGQIVLKAMAQGLVTFRDVAIEFSLEEWKCLEPAQRDLYREVTLENFGHLASLGLSISKPDVVSLLEQGKEPWMI

SEQ ID NO: 6699 - protein, 81 aa, Macaca mulatta
MAHGSVTFRDVAIDFSQEEWEFLDPAQRDLYRDVMWENYSNFISLGPSISKPDVITLLDEEGKEPGMVVREGTRRYCPDLE

SEQ ID NO: 6700 - protein, 81 aa, Macaca mulatta
MAHGSVTFRDVAIDFSQEEWEFLDPAQRDLYRDVMWENYSNFISLAGPSISKPDVITLLDEEGKEPGMVVREGTRRYCPGE

SEQ ID NO: 6701 - protein, 81 aa, Macaca mulatta
MAQESVMFSDVSIDFSQEEWECLNDDQRDLYRDVMLENYSNLVSMGHSISKPNVISYLEQGKEPWLVDRELTRGQWPVLES

SEQ ID NO: 6702 - protein, 81 aa, Macaca mulatta
MAQESVMFSDVSIDFSQEEWECLNDDQRDLYRDVMLENYSNLVSMAGHSISKPNVISYLEQGKEPWLVDRELTRGQWPVLE

SEQ ID NO: 6703 - protein, 81 aa, Macaca mulatta
MPEVEFPDQFFTVLTMDHELVTLRDVVINFSQEEWEYLDSAQRNLYWDVMMENYSNLLSLDLESRSETKHLSVGKDIIKNT

SEQ ID NO: 6704 - protein, 81 aa, Macaca mulatta
MMENYSNLLSLDLESRSETKHLSVGKDIIKNTGSQWEVMESSKLRGLESSICRNDWQSKSKIEVQGPEVGYFSQMKIISEN

SEQ ID NO: 6705 - protein, 81 aa, Macaca mulatta
TVLTMDHELVTLRDVVINFSQEEWEYLDSAQRNLYWDVMMENYSNLLSLDLESRSETKHLSVGKDIIKNTGSQWEVMESSK

SEQ ID NO: 6706 - protein, 81 aa, Macaca mulatta
MPLQGSVSFKDVTVDFTQEEWQQLDPAQKALYRDVMLENYCHFVSVGFHMTKPDMIRKLEQGEELWTQRIFPSYSYLEEDG

SEQ ID NO: 6707 - protein, 81 aa, Macaca mulatta
FHMTKPDMIRKLEQGEELWTQRIFPSYSYLEEDGKTEDVLVKFKEYQDRHSRSLIFINHKKLIKERSNIYGKALTLGKNRI

SEQ ID NO: 6708 - protein, 81 aa, Macaca mulatta
MSQGSVSFKDVTVDFTQEEWQQLDPAQKALYRDVMLENYCHFVSVGFHMTKPDMIRKLEQGEELWTQRIFPSYSYLEEDGK

SEQ ID NO: 6709 - protein, 81 aa, Macaca mulatta
MPLQGSVSFKDVTVDFTQEEWQQLDPAQKALYRDVMLENYCHFVSVGFHMTKPDMIRKLEQGEELWTQRIFPSYSYLEDGK

SEQ ID NO: 6710 - protein, 81 aa, Macaca mulatta
GFHMTKPDMIRKLEQGEELWTQRIFPSYSYLEDGKTEDVLVKFKEYQDRHSRSLIFINHKKLIKERSNIYGKALTLGKNRI

SEQ ID NO: 6711 - protein, 81 aa, Macaca mulatta
MAHELVMFRDVAIDVSQEEWECLNPAQRNLYKEVMLENYSNLVSLGLSVSKPAIISSLEQGKEPWMVVREETGRWCPGTWK

SEQ ID NO: 6712 - protein, 81 aa, Macaca mulatta
MAHELVMFRDVAIDVSQEEWECLNPAQRNLYKEVMLENYSNLVSLGLSVSKPAIISSLEQGKEPWMVVREETGRWCPDLAS

SEQ ID NO: 6713 - protein, 81 aa, Macaca mulatta
LTRELVMFRDVAIDVSQEEWECLNPAQRNLYKEVMLENYSNLVSLGLSVSKPAIISSLEQGKEPWMVVREETGRWCPGTWK

SEQ ID NO: 6714 - protein, 81 aa, Macaca mulatta
MAQGSVSFNDVTVDFTQEEWQHLDHAQKTLYMDVMLENYCHLISVGCHMTKPDVILKLERGEEPWTSFSGHTCLEENWKAE

SEQ ID NO: 6715 - protein, 81 aa, Macaca mulatta
MDVMLENYCHLISVGCHMTKPDVILKLERGEEPWTSFSGHTCLEENWKAEDFLLKFKEHQEKYSRSVVSINHKKLVKEKSN

SEQ ID NO: 6716 - protein, 81 aa, Macaca mulatta
MNMEGLVMFQDLFIHFSQEEWECLDAAQKDLYRDVMMENYSSLVSLGLCIPKPDVISLLEQGKEPWMVSRDVLGGWCPDRL

SEQ ID NO: 6717 - protein, 81 aa, Macaca mulatta
MNMEGLVMFQDLFIHFSQEEWECLDAAQKDLYRDVMMENYSSLVSLGLCIPKPDVISLLEQGKEPWMVSRDVLGGWCPDSE

SEQ ID NO: 6718 - protein, 81 aa, Macaca mulatta
MVHLMMFRDVAVDFCQEEWECLDLEQRDLYRDVMLENYSNLVSLGLCIYQPEVFSLLEKGKEPWKILRDETRGPCPDMQSR

SEQ ID NO: 6719 - protein, 81 aa, Macaca mulatta
REIAQLEIMKICKNHSLECLCFRGDWEGNVQFQTLQDNQEECFKQVILTCEKRPTFNQHTAFNLHQRLNTGDKLNEFKELG

SEQ ID NO: 6720 - protein, 81 aa, Macaca mulatta
HQEEAERMHDELLQAVSKGSVMFRDVSIDFSQEEWECLDSGQMNLYKEVMLENFSNLVSVGLSNSKPAVISLLEQGKEPWM

SEQ ID NO: 6721 - protein, 81 aa, Macaca mulatta
YSQESALSEEEEDTTRPLETVTFKDVAVDLTQEEWEQMKPAQRNLYRDVMLENYSNLVTVGCQVTKPDVIFKLEQEEEPWV

SEQ ID NO: 6722 - protein, 81 aa, Macaca mulatta
QEEWEQMKPAQRNLYRDVMLENYSNLVTVGCQVTKPDVIFKLEQEEEPWVMEEEIFGRHCPESRRGENCRASEVMAERSWC

SEQ ID NO: 6723 - protein, 81 aa, Macaca mulatta
MKPAQRNLYRDVMLENYSNLVTVGCQVTKPDVIFKLEQEEEPWVMEEEIFGRHCPEVWEVDEQIKKQQETLVRKVTSISKK

SEQ ID NO: 6724 - protein, 81 aa, Macaca mulatta
HCPESRRGENCRASEVMAEDLKFKDVVIYFSQKEWECLHSAQKDLYRDVMLENYGNLVLLGLSDTKPNVISLLEQKKEPWL

SEQ ID NO: 6725 - protein, 81 aa, Macaca mulatta
MKPAQRNLYRDVMLENYSNLVTVGCQVTKPDVIFKLEQEEEPWVMEEEIFGRHCPESRRGENCRASEVMAEDLKFKDVVIY

SEQ ID NO: 6726 - protein, 81 aa, Macaca mulatta
MAEDLKFKDVVIYFSQKEWECLHSAQKDLYRDVMLENYGNLVLLGLSDTKPNVISLLEQKKEPWLVKRNETKEWCPDWEFG

SEQ ID NO: 6727 - protein, 81 aa, Macaca mulatta
MDLKFKDVVIYFSQKEWECLHSAQKDLYRDVMLENYGNLVLLDWEFGRETKNFSPKENIYEIRSLQQERVRAIREIRCQVE

SEQ ID NO: 6728 - protein, 81 aa, Macaca mulatta
MARKLVMFRDVAIDFSQEEWECLDSAQRDLYRDVMLENYSNLVSLDLPSRCASKDLSPEKNTYETELSQWEMSDRLEKCDL

SEQ ID NO: 6729 - protein, 81 aa, Macaca mulatta
TELSQWEMSDRLEKCDLEESKSRDYLEAKGKMEKQQENQKEYFRQGMIIYDKMSIFNQHTYLSQHSRCHSTEKPYKCKECG

SEQ ID NO: 6730 - protein, 81 aa, Macaca mulatta
LAPEDQGSSYEGSVSFRDVAIDFSREEWRHLDPSQRNLYRDVMLETYSHLLSVGYQVPEAEVVMLEQGKEPWALQGERPRQ

SEQ ID NO: 6731 - protein, 81 aa, Macaca mulatta
REEWRHLDPSQRNLYRDVMLETYSHLLSVGYQVPEAEVVMLEQGKEPWALQGERPRQSCPVTYRLPFPSTMTESFLGLTGS

SEQ ID NO: 6732 - protein, 81 aa, Macaca mulatta
SPQKSSALAPEDQGSSYEGSVSFRDVAINFSREEWQHLDLSQRNLYRDVMLETYSHLLSVGYQVPKPEVVMLEQGKEPWAL

SEQ ID NO: 6733 - protein, 81 aa, Macaca mulatta
SSQKSSALAPEDHGSSCEGSVSFRDVAIDFSREEWRHLDPSQRNLYRDVMLETYSHLLSVGYQVPEAEVVMLEQGKEPWAL

SEQ ID NO: 6734 - protein, 81 aa, Macaca mulatta
DVAIDFSREEWRHLDPSQRNLYRDVMLETYSHLLSVGYQVPEAEVVMLEQGKEPWALQGERPRQSCPAQCLVNSHRLQESF

SEQ ID NO: 6735 - protein, 81 aa, Macaca mulatta
GSVSFRDVAINFSREEWQHLDLSQRNLYRDVMLETYSHLLSVGYQVPKPEVVMLEQGKEPWALQGERPRQSCPGEKLWDHN

SEQ ID NO: 6736 - protein, 81 aa, Macaca mulatta
REEWQHLDLSQRNLYRDVMLETYSHLLSVGYQVPKPEVVMLEQGKEPWALQGERPRQSCPGEKLWDHNQHRKIIGYKPAFS

SEQ ID NO: 6737 - protein, 81 aa, Macaca mulatta
QGSSYEGSVSFRDVAINFSREEWQHLDLSQRNLYRDVMLETYSHLLSVGYQVPKPEVVMLEQGKEPWALQGERPRQSCPGE

SEQ ID NO: 6738 - protein, 81 aa, Macaca mulatta
MAEGSVMFSDVSIDFSQEEWDCLDPVQRDLYRDVMLENYSNLVSMGKGIRTSDSQFSSGMSASSTVNFSAASQDFTLLSLK

SEQ ID NO: 6739 - protein, 81 aa, Macaca mulatta
MLETYNHLVSLEIPSSKPKLIAQLERGEEPWREERKCSLDLCPESKPEIRLCPSCPLIFSNQQALSQHVWLSHLSQLFSSL

SEQ ID NO: 6740 - protein, 81 aa, Macaca mulatta
GEEPWREERKCSLDLCPESKPEIRLCPSCPLIFSNQQALSQHVWLSHLSQLFSSLWAGNPLQLGKHYLEDQKEQQDPFCLS

SEQ ID NO: 6741 - protein, 81 aa, Macaca mulatta
MATGLLRAKKEEEWRLLSPAQRTLHREVMLETYNHLVSLEIPSSKPKLIAQLERGEEPWREERKCSLDLCPAESKPEIRLC

SEQ ID NO: 6742 - protein, 81 aa, Macaca mulatta
KLIAQLERGEEPWREERKCSLDLCPAESKPEIRLCPSCPLIFSNQQALSQHVWLSHLSQLFSSLWAGNPLQLGKHYLEDQK

SEQ ID NO: 6743 - protein, 81 aa, Macaca mulatta
MATGLLRAKKEASVAFRDVAVDFTQEEWRLLSPAQRTLHREVMLETYNHLVSLEIPSSKPKLIAQLERGEEPWREERKCSL

SEQ ID NO: 6744 - protein, 81 aa, Macaca mulatta
PWREERKCSLDLCPESKPEIRLCPSCPLIFSNQQALSQHVWLSHLSQLFSSLWAGNPLQLGKHYLEDQKEQQDPFCLSGKT

SEQ ID NO: 6745 - protein, 81 aa, Macaca mulatta
WREERKCSLDLCPAESKPEIRLCPSCPLIFSNQQALSQHVWLSHLSQLFSSLWAGNPLQLGKHYLEDQKEQQDPFCLSGKT

SEQ ID NO: 6746 - protein, 81 aa, Macaca mulatta
TMSCSRAGGITGCIKYSTASVAFRDVAVDFTQEEWRLLSPAQRTLHREVMLETYNHLVSLEIPSSKPKLIAQLERGEEPWR

SEQ ID NO: 6747 - protein, 81 aa, Macaca mulatta
MAVGLCKAMSQGLVTFRDVALDFSQEEWEWLKPSQKDLYRDVMLENYRNLVWLDWESWCEIKELSPKWFIDEDEISQEMIM

SEQ ID NO: 6748 - protein, 81 aa, Macaca mulatta
MTESQGTVTFKDVAIDFTQEEWKRLDPAQRNLYRNVMLENYNNLITVGYPFTKPDVIFKLEQEEEPWVMEEEVLRRHWKGE

SEQ ID NO: 6749 - protein, 81 aa, Macaca mulatta
MTESQGTVTFKDVAIDFTQEEWKRLDPAQRNLYRNVMLENYNNLITVGYPFTKPDVIFKLEQEEEPWVMEEEVLRRHWKGK

SEQ ID NO: 6750 - protein, 81 aa, Macaca mulatta
KSKEGERMAVGLLKAMYQELVTFRDVAVDFSQEEWDCLDSSQRHLYSNVMLENYRILVSLGLCFSKPSVILLLEQGKAPWM

SEQ ID NO: 6751 - protein, 81 aa, Macaca mulatta
PICETEELTPKQDFYEEHQSQKIIETLTSYNLEYSSLKEEWKCEGYFERQPGNQKACFKEEIITHEEPLVDEREQEYKSWG

SEQ ID NO: 6752 - protein, 81 aa, Macaca mulatta
QGKAPWMVKRELTKGLCSGWEPICETEELTPKQDFYEEHQSQKIIETLTSYNLEYSSLKEEWKCEGYFERQPGNQKACFKE

SEQ ID NO: 6753 - protein, 81 aa, Macaca mulatta
MIEYQTPVSFKDVVVGFTQEEWHRLSPAQRALYRDVMLETYSNLVSVGYEGTKPDVILRLEQEEAPWIGEAACPGCHCWED

SEQ ID NO: 6754 - protein, 81 aa, Macaca mulatta
MIEYQTPVSFKDVVVGFTQEEWHRLSPAQRALYRDVMLETYSNLVSVGYEGTKPDVILRLEQEEAPWIGEAACPGCHCWAI

SEQ ID NO: 6755 - protein, 81 aa, Macaca mulatta
VVVGFTQEEWHRLSPAQRALYRDVMLETYSNLVSVGYEGTKPDVILRLEQEEAPWIGEAACPGCHCWAISKLWPADWPPAL

SEQ ID NO: 6756 - protein, 81 aa, Macaca mulatta
MIEYQTPVSFKDVVVGFTQEEWHRLSPAQRALYRDVMLETYSNLVSVGYEGTKPDVILRLEQEEAPWIGEAACPGCHCWGK

SEQ ID NO: 6757 - protein, 81 aa, Macaca mulatta
EWHRLSPAQRALYRDVMLETYSNLVSVGYEGTKPDVILRLEQEEAPWIGEAACPGCHCWGKCNKSSKRGTEGGWHLWNFVQ

SEQ ID NO: 6758 - protein, 81 aa, Macaca mulatta
YEGTKPDVILRLEQEEAPWIGEAACPGCHCWGKCNKSSKRGTEGGWHLWNFVQRSSLKSLDVPPRTSATLMPLPPCNPNTI

SEQ ID NO: 6759 - protein, 81 aa, Macaca mulatta
SFKDVVVGFTQEEWHRLSPAQRALYRDVMLETYSNLVSVGYEGTKPDVILRLEQEEAPWIGEAACPGCHCWALTFLRELQP

SEQ ID NO: 6760 - protein, 81 aa, Macaca mulatta
FKDVVVGFTQEEWHRLSPAQRALYRDVMLETYSNLVSVGYEGTKPDVILRLEQEEAPWIGEAACPGCHCWALTFLRELQPR

SEQ ID NO: 6761 - protein, 81 aa, Macaca mulatta
MAHALVTFRDVAIDFSQKEWECLDTTQRKLYRDVMLENYSNLVSLGYSGSKPDVITLLEQGKEPCVAVRDVTGRQYPGLLS

SEQ ID NO: 6762 - protein, 81 aa, Macaca mulatta
MAHALVTFRDVAIDFSQKEWECLDTTQRKLYRDVMLENYSNLVSLAGYSGSKPDVITLLEQGKEPCVAVRDVTGRQYPGLL

SEQ ID NO: 6763 - protein, 81 aa, Macaca mulatta
MPHLLVTFRDVAIDFSQEEWECLDPAQRDLYRDVMLENYSNLISLDLESSRATKELSPEKEIYEMESLQWENMGKLINHHL

SEQ ID NO: 6764 - protein, 81 aa, Macaca mulatta
MDLLFQLLVTFRDVAIDFSQEEWECLDPAQRDLYRDVMLENYSNLISLDLESSRATKELSPEKEIYEMESLQWENMGKLIN

SEQ ID NO: 6765 - protein, 81 aa, Macaca mulatta
MARDLVMFRDVAVDFSQEEWECLNSYQRNLYRDVILENYSNLVSLGCSISKPDVITLLEQGKEPWMVMRDEKRRWTLGPTF

SEQ ID NO: 6766 - protein, 81 aa, Macaca mulatta
MARDLVMFRDVAVDFSQEEWECLNSYQRNLYRDVILENYSNLVSLAGCSISKPDVITLLEQGKEPWMVMRDEKRRWTLDLE

SEQ ID NO: 6767 - protein, 81 aa, Macaca mulatta
MARDLVMFRDVAVDFSQEEWECLNSYQRNLYRDVILENYSNLVSLGCSISKPDVITLLEQGKEPWMVMRDEKRRWTLDLES

SEQ ID NO: 6768 - protein, 81 aa, Macaca mulatta
MACESITFGDVAIDFSHQEWEYLNLVQKTLYQEVMMENYDNLVSLAGHSISKPDLITLLEQGKEPWMIVGEETRGECTDLD

SEQ ID NO: 6769 - protein, 81 aa, Macaca mulatta
MACESITFGDVAIDFSHQEWEYLNLVQKTLYQEVMMENYDNLVSLGHSISKPDLITLLEQGKEPWMIVGEETRGECTDLDS

SEQ ID NO: 6770 - protein, 81 aa, Macaca mulatta
MACESITFGDVAIDFSHQEWEYLNLVQKTLYQEVMMENYDNLVSLGHSISKPDLITLLEQGKEPWMIVGEETRGECTAELQ

SEQ ID NO: 6771 - protein, 81 aa, Macaca mulatta
CNWGRSLKFCPTKYMKFQELVTFRDVAIDFSQQEWEYLDPNQRDLYRDVMLENYRNLVSLGGHSISKPVVVDLLEQGKEPW

SEQ ID NO: 6772 - protein, 81 aa, Macaca mulatta
HRVGLIRSYSSKTMTCFQELVTFRDVAIDFSQQEWEYLDPNQRDLYRDVMLENYRNLVSLGGHSISKPVVVDLLEQGKEPW

SEQ ID NO: 6773 - protein, 81 aa, Macaca mulatta
MTCFQELVTFRDVAIDFSQQEWEYLDPNQRDLYRDVMLENYRNLVSLGGHSISKPVVVDLLEQGKEPWMILREETQFTDLD

SEQ ID NO: 6774 - protein, 81 aa, Macaca mulatta
MLENYRNLVSLGGHSISKPVVVDLLEQGKEPWMILREETQFTDLDLQCEIISYIEVPTYETGISSVQLQSIYKREKLYECK

SEQ ID NO: 6775 - protein, 81 aa, Macaca mulatta
HRVGLIRSYSSKTMTCFQELVTFRDVAIDFSQQEWEYLDPNQRDLYRDVMLENYRNLVSLEMRSRCVAQVGLKLLVSDPPT

SEQ ID NO: 6776 - protein, 81 aa, Macaca mulatta
MIQLKAIQEMFQELVTFRDVAIDFSQQEWEYLDPNQRDLYRDVMLENYRNLVSLGGHSISKPVVVDLLEQGKEPWMILREE

SEQ ID NO: 6777 - protein, 81 aa, Macaca mulatta
EPHRVGLIRSYSSKTMTCELVTFRDVAIDFSQQEWEYLDPNQRDLYRDVMLENYRNLVSLGGHSISKPVVVDLLEQGKEPW

SEQ ID NO: 6778 - protein, 81 aa, Macaca mulatta
TCNWGRSLKFCPTKYMKFQELVTFRDVAIDFSQQEWEYLDPNQRDLYRDVMLENYRNLVSLGGHSISKPVVVDLLEQGKEP

SEQ ID NO: 6779 - protein, 81 aa, Macaca mulatta
EEAQGELTSSCRSKTMADVSLAFRDVSIDLSQEEWECLNPAQRDLYKDVMLENYSNLVSLGYTIPKPDVITLLEQQKEPWI

SEQ ID NO: 6780 - protein, 81 aa, Macaca mulatta
MQVDPPLHGPPNDLLIFQIIPLHSLSIMPRLLWILCFSMEEAQGELTSSCRSKTMADVSLAFRDVSIDLSQEEWECLNPAQ

SEQ ID NO: 6781 - protein, 81 aa, Macaca mulatta
MVHGSVTFRDVAIDFSQEEWECLQPDQRTLYRDVMLENYSHLISLGSSISKPDVITLLEQEKEPWIVVRKETSRWYPDLES

SEQ ID NO: 6782 - protein, 81 aa, Macaca mulatta
MVHGSVTFRDVAIDFSQEEWECLQPDQRTLYRDVMLENYSHLISLAGSSISKPDVITLLEQEKEPWIVIWSQNMDLKKYLQ

SEQ ID NO: 6783 - protein, 81 aa, Macaca mulatta
GRSTRKIDQFCNSRNMVHGSVTFRDVAIDFSQEEWECLQPDQRTLYRDVMLENYSHLISLGSSISKPDVITLLEQEKEPWM

SEQ ID NO: 6784 - protein, 81 aa, Macaca mulatta
EESHGALISSCNSRTMTDGLVTFRDVAIDFSQEEWECLDPAQRDLYVDVMLENYSNLVSLGNKMCGFLVFFQIWSQQHTRP

SEQ ID NO: 6785 - protein, 81 aa, Macaca mulatta
MTKSKEPVTFKDVAVVFSEEELRLLNLAQRKLYRDVMLENFRNVVSVGHQSTPDGLPQLEREEKLWMMKMAIQRDNSSGGK

SEQ ID NO: 6786 - protein, 81 aa, Macaca mulatta
MLENFRNVVSVGHQSTPDGLPQLEREEKLWMMKMAIQRDNSSGGKNLKEMETLQEVGLRYPSHEEFFCSQIWQQITRELTK

SEQ ID NO: 6787 - protein, 81 aa, Macaca mulatta
HSGLCKFPEVEGKMTTFKEAVTFKDVAVVFTEDELGLLDPAQRKLYRDVMLENFRNLLSVGNQPFHQDTFHFLRKEKLRMM

SEQ ID NO: 6788 - protein, 81 aa, Macaca mulatta
LRKEKLRMMKTTSQRGGNSGGKIQIEMETVPEAGPHEEWSCQQIWEQIASDLTRSQDSIRNSSELFIEGDVLCQIEAGLSI

SEQ ID NO: 6789 - protein, 81 aa, Macaca mulatta
AQRKLYRDVMLENFRNLLSVGNQPFHQDTFHFLRKEKLRMMKTTSQRGGNSGGKIQIEMETVPEAGPHEEWSCQQIWEQIA

SEQ ID NO: 6790 - protein, 81 aa, Macaca mulatta
MTTFKEAVTFKDVAVFFTEEELGLLDPAQRKLYRDVMLENFRNLLSAGHQPFHQDTFHFLREEKFWMMETVTQREGNSGSK

SEQ ID NO: 6791 - protein, 81 aa, Macaca mulatta
FKDVAVFFTEEELGLLDPAQRKLYRDVMLENFRNLLSAGHQPFHQDTFHFLREEKFWMMETVTQREGNSGSKIQTELESVP

SEQ ID NO: 6792 - protein, 81 aa, Macaca mulatta
FLREEKFWMMETVTQREGNSGSKIQTELESVPEAGTQEEWSCQQIWEQIAKDLTRSQDSIINNSQFFENGDVPSQVEAGLP

SEQ ID NO: 6793 - protein, 81 aa, Macaca mulatta
MIKRSKVLVFCSKIMEEAVTFKDVAVFFTEEELGLLDPAQRKLYRDVMLENFRNLLSAGHQPFHQDTFHFLREEKFWMMET

SEQ ID NO: 6794 - protein, 81 aa, Macaca mulatta
DVMLENFRNLLSAGHQPFHQDTFHFLREEKFWMMETVTQREGNSGSKIQTELESVPEAGTQEEWSCQQIWEQIAKDLTRSQ

SEQ ID NO: 6795 - protein, 81 aa, Macaca mulatta
MTTFKEAVTFKDVAVFFTEEELGLLDPAQRKLYQDVMLENFTNLLSVGYQPFHPFHFLREEKFWMMETATQREGSSGGRTV

SEQ ID NO: 6796 - protein, 81 aa, Macaca mulatta
NNSHFFEQGDVPSQVEAELSIIHTGQKPSQNGKCKQSFSDVAIFDLPQQLHSGEKSHTCKECGKSFCYISALRIHQRVHLR

SEQ ID NO: 6797 - protein, 81 aa, Macaca mulatta
MTTFKEAVTFKDVAVFFTEEELGLLDPAQRKLYQDVMLENFTNLLSVGYQPFHPFHFLREEKFWMMETATQREGSSGKKQA

SEQ ID NO: 6798 - protein, 81 aa, Macaca mulatta
MIDSGEKKPGRRAEEAVTFKDVAVVFTEEELELLDPAQRKLYRDVMLENFRNLLSVGHQPFHGDTFHFLREEKFWVMETTS

SEQ ID NO: 6799 - protein, 81 aa, Macaca mulatta
GRRAEEAVTFKDVAVVFTEEELELLDPAQRKLYRDVMLENFRNLLSVGHQPFHGDTFHFLREEKFWVMETTSQREGTSGPL

SEQ ID NO: 6800 - protein, 81 aa, Macaca mulatta
MITCDEAVTFKDVAVVFTEEELELLDPAQRKLYRDVMLENFRNLLSVGHQPFHGDTFHFLREEKFWVMETTSQREGTSGKI

SEQ ID NO: 6801 - protein, 81 aa, Macaca mulatta
HSGLCKFPKVGGKMTTSKEAVTFKDVVVVFTEEELGLLDLAQRKLYRDVMLENFRNLLSVGHQPFHRDTFHFLREEKFWMM

SEQ ID NO: 6802 - protein, 81 aa, Macaca mulatta
MTTSKEAVTFKDVVVVFTEEELGLLDLAQRKLYRDVMLENFRNLLSVGHQPFHRDTFHFLREEKFWMMDIATQREGNSGGK

SEQ ID NO: 6803 - protein, 81 aa, Macaca mulatta
MTTSKEAVTFKDVVVVFTEEELGLLDLAQRKLYRDVMLENFRNLLSVGHQPFHRDTFHFLREEKFWMMDIATQREGNSGKK

SEQ ID NO: 6804 - protein, 81 aa, Macaca mulatta
TFKDVVVVFTEEELGLLDLAQRKLYRDVMLENFRNLLSVGHQPFHRDTFHFLREEKFWMMDIATQREGNSGKKQATVCPCL

SEQ ID NO: 6805 - protein, 81 aa, Macaca mulatta
MTTSKEAVTFKDVVVVFTEEELGLLDLAQRKLYRDVMLENFRNLLSVGHQPFHRDTFHFLREEKFWMMDIATQREGNSGES

SEQ ID NO: 6806 - protein, 81 aa, Macaca mulatta
MLENFRNLLSVGHQPFHRDTFHFLREEKFWMMDIATQREGNSGGKIQPEMKTVPEAGPHEGLSCQQIWEEIASDLTRPQDS

SEQ ID NO: 6807 - protein, 81 aa, Macaca mulatta
MTMFKEAVTFKDVAVVFTEEELGLLDPAQKKLYRDVMLENFRNLLSVGHQLSYQDTFHFQREEKFWIMETATQKEGNSGGK

SEQ ID NO: 6808 - protein, 81 aa, Macaca mulatta
QREEKFWIMETATQKEGNSGGKIQTELESVPETGPHEEWSCQQVWEQTASELTRPQDSMISSSQFSTQGDVPSQVDAGLSI

SEQ ID NO: 6809 - protein, 81 aa, Macaca mulatta
MTMFKEAMTFKDVAVVFTEEELGLLDLAQRKLYQDVMLENFRNLLSVGHQAFHRDTFHFLREEKIWMMKTATQREGDSGDK

SEQ ID NO: 6810 - protein, 81 aa, Macaca mulatta
LREEKIWMMKTATQREGDSGDKIQTEMETISEAGTDQEWSCQQIWEKIASDLTRSQDLVINSSQFSREGDFPSQSEAGLSV

SEQ ID NO: 6811 - protein, 81 aa, Macaca mulatta
DLAQRKLYQDVMLENFRNLLSVGHQAFHRDTFHFLREEKIWMMKTATQREGDSGDKIQTEMETISEAGTDQEWSCQQIWEK

SEQ ID NO: 6812 - protein, 81 aa, Macaca mulatta
LLSVGHQAFHRDTFHFLREEKIWMMKTATQREGDSGDKIQTEMETISEAGTDQEWSCQQIWEKIASDLTRSQDLVINSSQF

SEQ ID NO: 6813 - protein, 81 aa, Macaca mulatta
MNTLKEVVTFKDVAVVFSEEELRLLDLAQRKLYREVMLENFRNLLSVGHQPLHRDTFHFLKEEKFWMMETVTQREGNLGDK

SEQ ID NO: 6814 - protein, 81 aa, Macaca mulatta
MTTFKEGLTFKDVAVVFTEEELGLLDPVQRNLYRDVMLENFRNLLSVGHHPFKHDVFPLEKEKKLGMMKTATQRKGKSADK

SEQ ID NO: 6815 - protein, 81 aa, Macaca mulatta
MNMFKEAVTFNDVAVAFTEEELGLLGPAQRKLYRDVMVENFRNLLSVGHQPFKQDVSPIERNEQLWIVTTATQRQRNLGEK

SEQ ID NO: 6816 - protein, 81 aa, Macaca mulatta
VGHQPFKQDVSPIERNEQLWIVTTATQRQRNLGEKNQSKLVTIQDRESEEELSCWQIWQQIANDLTRCQDSMINNSQFHKQ

SEQ ID NO: 6817 - protein, 81 aa, Macaca mulatta
MNMFKEAVTFNDVAVAFTEEELGLLGPAQRKLYRDVMVENFRNLLSVGHQPFKQDVSPIERNEQLWIVTTATQRQRNLGKN

SEQ ID NO: 6818 - protein, 81 aa, Macaca mulatta
TFNDVAVAFTEEELGLLGPAQRKLYRDVMVENFRNLLSVGHQPFKQDVSPIERNEQLWIVTTATQRQRNLGKNQTVVSSYS

SEQ ID NO: 6819 - protein, 81 aa, Macaca mulatta
MNMFKEAVTFNDVAVAFTEEELGLLGPAQRKLYRDVMVENFRNLLSVGHQPFKQDVSPIERNEQLWIVTTATQRQRNLDTL

SEQ ID NO: 6820 - protein, 81 aa, Macaca mulatta
AVAFTEEELGLLGPAQRKLYRDVMVENFRNLLSVGHQPFKQDVSPIERNEQLWIVTTATQRQRNLDTLLVKALLLYDLAQT

SEQ ID NO: 6821 - protein, 81 aa, Macaca mulatta
MVENFRNLLSVGHQPFKQDVSPIERNEQLWIVTTATQRQRNLGEKNQSKLVTIQDRESEEELSCWQIWQQIANDLTRCQDS

SEQ ID NO: 6822 - protein, 81 aa, Macaca mulatta
RNEQLWIVTTATQRQRNLGEKNQSKLVTIQDRESEEELSCWQIWQQIANDLTRCQDSMINNSQFHKQGDFPCQVGAELSVQ

SEQ ID NO: 6823 - protein, 81 aa, Macaca mulatta
IERNEQLWIVTTATQRQRNLGEKNQSKLVTIQDRESEEELSCWQIWQQIANDLTRCQDSMINNSQFHKQGDFPCQVGAELS

SEQ ID NO: 6824 - protein, 81 aa, Macaca mulatta
SQDYDLPQKEQEKMTKFQDAVTFKDVAVVFSREELRLLDLTQRKLYRDVMVENFKNLVAVGHLPFQPDMVSQLEAEEKLWM

SEQ ID NO: 6825 - protein, 81 aa, Macaca mulatta
SQDYDLPQKEQEKMTKFQDAVTFKDVAVVFSREELRLLDLTQRKLYRDVMVENFKNLVAVGSKHQNKMETLQKFALKYLSN

SEQ ID NO: 6826 - protein, 81 aa, Macaca mulatta
PSQDYDLPQKEQEKMTKFQDAVTFKDVAVVFSREELRLLDLTQRKLYRDVMVENFKNLVAVGHLPFQPDMVSQLEAEEKLW

SEQ ID NO: 6827 - protein, 81 aa, Macaca mulatta
MTKFQGMVTFKDVAVVFTREELGLLDLAQRKLYQDVMLENFRNLLSVGYHPFKLDVILQLGREDKLWLMETEIQRDGCSGH

SEQ ID NO: 6828 - protein, 81 aa, Macaca mulatta
MTKFQGMVTFKDVAVVFTREELGLLDLAQRKLYQDVMLENFRNLLSVGYHPFKLDVILQLGREDKLWLMETEIQRDGCSGE

SEQ ID NO: 6829 - protein, 81 aa, Macaca mulatta
MTKFRGMVTFKDVAVVFTREELGLLDLAQRKLYQDVMLENFRNLLSVGKHKHLKLLSPLQTRCDTTVGKRRQALADGDRNP

SEQ ID NO: 6830 - protein, 81 aa, Macaca mulatta
MVTFKDVAVVFTREELGLLDLAQRKLYQDVMLENFRNLLSVGKHKHLKLLSPLQTRCDTTVGKRRQALADGDRNPKRWLFR

SEQ ID NO: 6831 - protein, 81 aa, Macaca mulatta
MTKFQEAVTFKDVAVAFTEEELGLLDSAQRKLYRDVMLENFRNLVSVGHQSFKPDMISQLEREEKLWMKEFQTQRGKHSET

SEQ ID NO: 6832 - protein, 81 aa, Macaca mulatta
MTKFQEAVTFKDVAVAFTEEELGLLDSAQRKLYRDVMLENFRNLVSVGHQSFKPDMISQLEREEKLWMKEFQTQRGKHSVW

SEQ ID NO: 6833 - protein, 81 aa, Macaca mulatta
MTKFQEAVTFKDVAVAFTEEELGLLDSAQRKLYRDVMLENFRNLVSVGHQSFKPDMISQLEREEKLWMKEFQTQRGKHSGF

SEQ ID NO: 6834 - protein, 81 aa, Macaca mulatta
MTKFQEAVTFKDVAVAFTEEELGLLDSAQRKLYRDVMLENFRNLVSVGHQSFKPDMISQLEREEKLWMKEFQTQRGDRNQN

SEQ ID NO: 6835 - protein, 81 aa, Macaca mulatta
MTKFQEAVTFKDVAVAFTEEELGLLDSAQRKLYRDVMLENFRNLVSVGHQSFKPDMISQLEREEKLWMKEFQTQRGKHSGD

SEQ ID NO: 6836 - protein, 81 aa, Macaca mulatta
PGTLPFPGRKRGKMTKFQEAVTFKDVAVAFTEEELGLLDSAQRKLYRDVMLENFRNLVSVGHQSFKPDMISQLEREEKLWM

SEQ ID NO: 6837 - protein, 81 aa, Macaca mulatta
MVTFKDVAVVFTEEELGLLDSVQRKLYRDVMLENFRNLLLVAHQPFKPDLISQLEREEKLLMVETETPKDGCSGRKNQQKM

SEQ ID NO: 6838 - protein, 81 aa, Macaca mulatta
MTKFQEMVTFKDVAVVFTEEELGLLDSVQRKLYRDVMLENFRNLLLVAHQPFKPDLISQLEREEKLLMVETETPKDGCSGR

SEQ ID NO: 6839 - protein, 81 aa, Macaca mulatta
SLPFSRTRKRKMTKFQEMVTFKDVAVVFTEEELGLLDSVQRKLYRDVMLENFRNLLLVAHQPFKPDLISQLEREEKLLMVE

SEQ ID NO: 6840 - protein, 81 aa, Macaca mulatta
HQPFKPDLISQLEREEKLLMVETETPKDGCSGRKNQQKMESIQEVTVSYLSPKELSSCQTWQQSAGGLIRCQDFLKVFQGK

SEQ ID NO: 6841 - protein, 81 aa, Macaca mulatta
MMKFQMVTFKDVAVVFTEEELGLLDSVQRKLYRDVMLENFRNLLLVAHQPFKPDLISQLEREEKLLMVETETPKDGCSGRK

SEQ ID NO: 6842 - protein, 81 aa, Macaca mulatta
EREEKLLMVETETPKDGCSGRKNQQKMESIQEVTVSYLSPKELSSCQTWQQSAGGLIRCQDFLKVFQGKNSQLQEQGDSLC

SEQ ID NO: 6843 - protein, 81 aa, Macaca mulatta
MMKFQERVTFKDVAVVFTKEELALLDKAQINLYQDVMLENFRNLISVGDGIKNNILNLQEKGLSYLSQEVLRCWQIWKQRI

SEQ ID NO: 6844 - protein, 81 aa, Macaca mulatta
HSQASALSQDRKDKTMFQEPLSFKDVAVVFTEEELGLLDSTQRQLYRDVMLENFRNLLSVGERNPPGDKNGRDMEYIQDEE

SEQ ID NO: 6845 - protein, 81 aa, Macaca mulatta
HSQASALSQDRKDKTMFQEPLSFKDVAVVFTEEELGLLDSTQRQLYRDVMLENFRNLLSVGDKNGRDMEYIQDEELRLFSH

SEQ ID NO: 6846 - protein, 81 aa, Macaca mulatta
IIIKVEGEDTGSLTIPSQEGVNFKIVTVDFTQEEQGTWNPAQRTLDRDVILENHRDLVSWDLTTAVGKKDPTSKQSIFDEE

SEQ ID NO: 6847 - protein, 81 aa, Macaca mulatta
SMAEQDEKPPEPPKACAQEGVNFKIVTVDFTQEEQGTWNPAQRTLDRDVILENHRDLVSWDLTTAVGKKDPTSKQSIFDEE

SEQ ID NO: 6848 - protein, 81 aa, Macaca mulatta
GNTGEPGLAVASVTKMSQDSVTFADVAVNFTKEEWTLLDPAQRNLYRDVMLENSRNLAFIDWATPCETKDAAPQPDILPKR

SEQ ID NO: 6849 - protein, 81 aa, Macaca mulatta
MSQDSVTFADVAVNFTKEEWTLLDPAQRNLYRDVMLENSRNLAFIDWATPCETKDAAPQPDILPKRTYPEANSVCLTSISS

SEQ ID NO: 6850 - protein, 81 aa, Macaca mulatta
DEIDTGANRHQQNPFGKAFHEDGSLRAHNTRVREKMYDFTQGENTSRNNSVHAVQMQSYTAETNKKDCQTGATSANAPNSG

SEQ ID NO: 6851 - protein, 81 aa, Macaca mulatta
PSSASRVAGTTGAHPHSRDSVTFADVAVNFTKEEWTLLDPAQRNLYRDVMLENSRNLAFIDWATPCETKDAAPQPDILPKR

SEQ ID NO: 6852 - protein, 81 aa, Macaca mulatta
MTEEFVTLKDVGMDFTLEDWEQLGLEQGDVFWDTALDNCQDLLLLDPPRPNLTSHPDGGEDLEPLPGGSPEATGPDATETK

SEQ ID NO: 6853 - protein, 81 aa, Macaca mulatta
MDFTLEDWEQLGLEQGDVFWDTALDNCQDLLLLDPPRPNLTSHPDGGEDLEPLPGGSPEATGPDATETKNSPLMEDFLEEG

SEQ ID NO: 6854 - protein, 81 aa, Macaca mulatta
AHAQDPAMANGTLMAEGQESVTFKDVAVDFTLEEWGWLEPDQRELYRDVMLENYRNLLSLGAGLPGSKPDVISRLERGEEP

SEQ ID NO: 6855 - protein, 81 aa, Macaca mulatta
LSQKPQVLGPEEQDGSCEASLSFEDVTVDFSREEWQQLDPAQRRLYQDVTLELYSHLFSVGYHIPNPDVIFRMLKEKEPCV

SEQ ID NO: 6856 - protein, 81 aa, Macaca mulatta
NATIVMSVRREQGSSSGEGSLSFEDVAVDFTREEWQFLDWSQKVLYKEVMLENYSNLVSVGYQGTKPDSLFKLEQGEPPWI

SEQ ID NO: 6857 - protein, 81 aa, Macaca mulatta
MTEAQESLTLRDVAVDFTWEEWQLLGPAQKHLYRDVMLENYSNLVSVGFQASKPDALTKLEQGEPLWALEDEIHSPTHPEI

SEQ ID NO: 6858 - protein, 81 aa, Macaca mulatta
MLENYSNLVSVGYQASKPDALSKLEQGEPWTVENEIHSQICPEIKKVDNHLQMHSQNQRCLKRVEQCHKHNAFGNIIHQRK

SEQ ID NO: 6859 - protein, 81 aa, Macaca mulatta
YSNLVSVGYQASKPDALSKLEQGEPWTVENEIHSQICPEIKKVDNHLQMHSQNQRCLKRVEQCHKHNAFGNIIHQRKSDFP

SEQ ID NO: 6860 - protein, 81 aa, Macaca mulatta
MIKSQESLTLEDVAVEFTWEEWQLLGPAQKDLYRDVMLENYSNLVSVGYQASKPDALSKLEQGEPWTVENEIHSQICPEIK

SEQ ID NO: 6861 - protein, 81 aa, Macaca mulatta
MIQAQESVTLEDVAVDFTWEEWQLLGPAQKDLYRDVMLENYSNLVAVGYQASKPDVFFKLEQGEPPWTTEDGIHSGACSEI

SEQ ID NO: 6862 - protein, 81 aa, Macaca mulatta
AYMSCLVKHKRIHTREKQDAVKVEIPPAERHSILHTSDVMQEKNSANGVTTQVSSVTPQTSLNISGLLANRNIVLVGQPVV

SEQ ID NO: 6863 - protein, 81 aa, Macaca mulatta
MLENYSNLVAVGYQASKPDVFFKLEQGEPPWTTEDGIHSGACSEIWKVDDHVLKRLHSETLVNRRKQCHEHDAFENIVHCS

SEQ ID NO: 6864 - protein, 81 aa, Macaca mulatta
MMQAQESLTLEDVALDFTWEEWQFLSPAQKDLYRDVMLENYSNLVAVGYQASKPDALSKLEQGEEPCTTEDEIYTRICCEI

SEQ ID NO: 6865 - protein, 81 aa, Macaca mulatta
MRPEPTKFWEESLTLEDVALDFTWEEWQFLSPAQKDLYRDVMLENYSNLVAVGYQASKPDALSKLEQGEEPCTTEDEIYTR

SEQ ID NO: 6866 - protein, 81 aa, Macaca mulatta
MESLTLEDVALDFTWEEWQFLSPAQKDLYRDVMLENYSNLVAVGYQASKPDALSKLEQGEEPCTTEDEIYTRICCEIRKID

SEQ ID NO: 6867 - protein, 81 aa, Macaca mulatta
MIKTQESLTLEDVAVEFSWEEWQLLDTAQKNLYRDVMVENYNHLVSLGYQTSKPDVLSKLAHGQEPWITVAKIQNKNCPGI

SEQ ID NO: 6868 - protein, 80 aa, Macaca mulatta
MIKTQESLTLEDVAVEFSWEEWQLLDTAQKNLYRDVMVENYNHLVSLGYQTSKPDVLSKLAHGQEPWITVAKIQNKNCPD

SEQ ID NO: 6869 - protein, 81 aa, Macaca mulatta
MINAQELLTLEDVTVEFTWEEWQLLDPFQKGLYRDVMLEIYSNLVSMGYQVSKPDALSRLERGEEPWTMEDERHSQICPEN

SEQ ID NO: 6870 - protein, 81 aa, Macaca mulatta
ALSRLERGEEPWTMEDERHSQICPENNKVDDHLQDHLENQRMLKSVEQYHERNAFGNTASQTKSHCLFRENHDTFELYIKA

SEQ ID NO: 6871 - protein, 81 aa, Macaca mulatta
LVSMGYQVSKPDALSRLERGEEPWTMEDERHSQICPENNKVDDHLQDHLENQRMLKSVEQYHERNAFGNTASQTKSHCLFR

SEQ ID NO: 6872 - protein, 81 aa, Macaca mulatta
MINAQELLTLEDVTVEFTWEEWQLLDPFQKGLYRDVMLEIYSNLVSMGYQVSKPDALSRLERGEEPWTMEDERHSQICPGM

SEQ ID NO: 6873 - protein, 81 aa, Macaca mulatta
MALPQGSLTFRDVAIEFSQEEWKCLDPIQKALYRDVMLENYRNLGFLGLCLPDLNIISMLEQGKEPWTVVSQVKIARNPNW

SEQ ID NO: 6874 - protein, 81 aa, Macaca mulatta
MATQGPLTFKDVAIEFSQEEWKCLEPVQKALYKDVMLENYRNLVFLGISPKCVIKELPPTENSNTGERFQTVALERHQSCD

SEQ ID NO: 6875 - protein, 81 aa, Macaca mulatta
AQKRKNRKEKESGMALTQGPLTFRDVAIEFSQEEWKSLDPVQKALYWDVMLENYRNLVFLGILPKCMTKELPPIGNSNTGE

SEQ ID NO: 6876 - protein, 81 aa, Macaca mulatta
MALTQGPLTFRDVAIEFSQEEWKSLDPVQKALYWDVMLENYRNLVFLGILPKCMTKELPPIGNSNTGEKFQTVMLERHECY

SEQ ID NO: 6877 - protein, 81 aa, Macaca mulatta
LDPVQKALYWDVMLENYRNLVFLGILPKCMTKELPPIGNSNTGEKFQTVMLERHECYDIENFSLREIQKNLQDLEFQWKDG

SEQ ID NO: 6878 - protein, 81 aa, Macaca mulatta
MAQLRRGHLTFRDVAIEFSQEEWKCLDPVQKALYRDVMLENYRNLVSLGICLPDLSIISMMKQRTEPWTVENEMKVAKNPV

SEQ ID NO: 6879 - protein, 81 aa, Macaca mulatta
EGEAQKRKAKESGMPLTQGHLTFRDVAIEFSQEEWKCLDPVQKALYRDVMLENYRNLVSLGICLPDLSIISMMKQRTEPWT

SEQ ID NO: 6880 - protein, 81 aa, Macaca mulatta
MLENYRNLVSLGICLPDLSIISMMKQRTEPWTVENEMKVAKNPVRWEGIKDINTGRCCAMRSKAGNKPITNQLGLTFQLPL

SEQ ID NO: 6881 - protein, 81 aa, Macaca mulatta
MGHLTFRDVAIEFSQEEWKCLDPVQKALYRDVMLENYRNLVSLGICLPDLSIISMMKQRTEPWTVENEMKVAKNPVRWEGI

SEQ ID NO: 6882 - protein, 81 aa, Macaca mulatta
AQKRRKRKAKESGTALPQGHLTFRDVAIEFSQAEWKCLDLAQRALYKDVMLENYRNLVSLGISLPDLNINSMLEQRREPWS

SEQ ID NO: 6883 - protein, 81 aa, Macaca mulatta
DEEAQKREAKESGMALPQGHLTFMDVAIEFSQEEWKCLDPGQRALYRDVMLENYRNLVSLGICLPDLSIISMLKQRREPLT

SEQ ID NO: 6884 - protein, 81 aa, Macaca mulatta
DEEAQKREAKESGMALPQGHLTFMDVAIEFSQEEWKCLDPGQRALYRDVMLENYRNLVSLGRSCILGSNAENKPIKNQLGF

SEQ ID NO: 6885 - protein, 81 aa, Macaca mulatta
VSWRPGSRLRGVTVMLRRGLLTFRDVAIEFSQEEWKCLDPAQRTLYRDVMLENYRNLVFLGICLPDLSIISMLEQRRDPRN

SEQ ID NO: 6886 - protein, 81 aa, Macaca mulatta
MLRRGLLTFRDVAIEFSQEEWKCLDPAQRTLYRDVMLENYRNLVFLGICLPDLSIISMLEQRRDPRNLQSEVKIANNPDGR

SEQ ID NO: 6887 - protein, 81 aa, Macaca mulatta
KEATRKMKEKESGMALTQGPLKFMDVAIEFSQEEWKCLEPAQRTLYRDVMLENYRNLVSLGICLPDLSVISTLEQKKDPWI

SEQ ID NO: 6888 - protein, 81 aa, Macaca mulatta
MALTHGQLLFRDVAIEFSQEEWKCLNPGQKALYRDVMLENYRNLISLGICLPDLSVISILEQKRDPWTLQSDVKVANNPNG

SEQ ID NO: 6889 - protein, 81 aa, Macaca mulatta
MALTHGQLLFRDVAIEFSQEEWKCLNPGQKALYRDVMLENYRNLISLGEDNVPPEAWICSGICLPDLSVISILEQKRDPWT

SEQ ID NO: 6890 - protein, 81 aa, Macaca mulatta
MALPQGRLTFRDVAIEFSLAEWKCLNPAQRALYREVMLENYRNLESVDISSKCMMKEILSTGQGNTEVFHTGTLQRHESHH

SEQ ID NO: 6891 - protein, 81 aa, Macaca mulatta
TGVSHCTWPLCFQGLTSKDLVREEKTRKRKAKAGMAIPQGLLTFRDVAIEFSQEEWKCLDPAQRTLYRDVMLENYRNLVSL

SEQ ID NO: 6892 - protein, 81 aa, Macaca mulatta
MAIPQGLLTFRDVAIEFSQEEWKCLDPAQRTLYRDVMLENYRNLVSLGQGNTEVIHTGTLQRQASHHIGDICFQEIGKDIH

SEQ ID NO: 6893 - protein, 81 aa, Macaca mulatta
MALPQGLLTFRDVAIEFSQEEWKCLDPAQRTLYRNVMLENYRNLVSLDMHHHHTWLIFVFLIATRFCHVGQIGLELPTSVS

SEQ ID NO: 6894 - protein, 81 aa, Macaca mulatta
SDSPASASKVAGITGIFSKYEIKELPTKKESNTGEIFQTVMLERHESHDIEDFCFSETQKNVHDSQCRWRHDERHYKRVCV

SEQ ID NO: 6895 - protein, 81 aa, Macaca mulatta
MALPQGLLTFRDVAIEFSQEEWKCLDPAQRTLYRNVMLENYRNLVSLGIFSKYEIKELPTKKESNTGEIFQTVMLERHESH

SEQ ID NO: 6896 - protein, 81 aa, Macaca mulatta
DPAQRTLYRNVMLENYRNLVSLGIFSKYEIKELPTKKESNTGEIFQTVMLERHESHDIEDFCFSETQKNVHDSQCRWRHDE

SEQ ID NO: 6897 - protein, 81 aa, Macaca mulatta
AIEFSQEEWKCLDPAQRTLYRNVMLENYRNLVSLGIFSKYEIKELPTKKESNTGEIFQTVMLERHESHDIEDFCFSETQKN

SEQ ID NO: 6898 - protein, 81 aa, Macaca mulatta
MALPQGLLTFRDVAIEFSQEEWKCLDPAQRTLYRNVMLENYRNLVSLGHDLILFFSFLFEMEFRSYSHVSLLLYAQASCWK

SEQ ID NO: 6899 - protein, 81 aa, Macaca mulatta
NYRNLVSLGHDLILFFSFLFEMEFRSYSHVSLLLYAQASCWKNSPFWGANLTNFCNVFFLNMRSRNYQQKRRVIQEKYSRQ

SEQ ID NO: 6900 - protein, 81 aa, Macaca mulatta
MALPQGLLTFRDVAIEFSQEEWKCLDPAQRTLYRNVMLENYRNLVSLETGFHQFGQDGLLVIHLPRPPKDMISFFFFLFFS

SEQ ID NO: 6901 - protein, 81 aa, Macaca mulatta
MALPQGRVTFRDVAIEFSLAEWKCLNPAQRALYREVMLENYRNLESVDISSKCMMKEVLSTGQGNTEVFYPGTLQRPESHH

SEQ ID NO: 6902 - protein, 81 aa, Macaca mulatta
MALPQGRVTFRDVAIEFSLAEWKCLNPAQRALYREVMLENYRNLESVDISSKCIMKEFSSTGQCNTEVIHTGTLQRHESHH

SEQ ID NO: 6903 - protein, 81 aa, Macaca mulatta
MALPQGLLTFRDVAIEFSQDEWKCLDPAQRSLYRDVMLENYRNLVSLVDIWAEVIVADISSKCMLKTLSSTGQGNTEVILI

SEQ ID NO: 6904 - protein, 81 aa, Macaca mulatta
MALPQGLLTFRDVAIEFSQDEWKCLDPAQRSLYRDVMLENYRNLVSLAISSKCMLKTLSSTGQGNTEVILTGTLQRQASHH

SEQ ID NO: 6905 - protein, 81 aa, Macaca mulatta
MALPQGLLTFRDVAIEFSQEEWKCLDPAQRTLYRDVMLENYRNLVSLDISSKCMMNTLSSTGQGNTEVFHTGILQRQASYH

SEQ ID NO: 6906 - protein, 81 aa, Macaca mulatta
MAPPQGLLTFRDVAIEFSQEEWKCLDPAQRTLYRDVMLENYRNLVSLAISSKCMMKKFSSTGQGNTEVIHTGTLQRQASHH

SEQ ID NO: 6907 - protein, 81 aa, Macaca mulatta
EEATKKSKEKYPGMAPPQGRLTFRDVAIEFSFMEWKCLNPAQRALYREVMLENYRNLEFVDSSLKSMMEFSSHEHSNTGEG

SEQ ID NO: 6908 - protein, 81 aa, Macaca mulatta
GRLTFRDVAIEFSFMEWKCLNPAQRALYREVMLENYRNLEFVDSSLKSMMEFSSHEHSNTGEGFHTGTLERHKSYHIGDFC

SEQ ID NO: 6909 - protein, 81 aa, Macaca mulatta
EEATKKSKEKYPGMAPPQGRLTFRDVAIEFSFMEWKCLNPAQRALYREVMLENYRNLEFVESCSCCPGWSAMSWSPHAATS

SEQ ID NO: 6910 - protein, 81 aa, Macaca mulatta
EEATKKSKEKYPGMAPPQGRLTFRDVAIEFSFMEWKCLNPAQRALYREVMLENYRNLEFVGEENVPSDMRSLLLSILALSG

SEQ ID NO: 6911 - protein, 81 aa, Macaca mulatta
MALPQGLLTFRDVAIEFSQEEWKCLDPAQRTLYRDVMLENYRNLVSLAISSKCMTRKFSSTGQGNTEVIHTGTLQRQASHH

SEQ ID NO: 6912 - protein, 81 aa, Macaca mulatta
MALTQVRLTFRDVAIEFSQEEWKCLDPAQRTLYRDVMLENYWNLVSLGLCHFDMNIISMLEEGKEPWTVKNCVKIARKPRM

SEQ ID NO: 6913 - protein, 81 aa, Macaca mulatta
KPRMRECVKGVITDIPPKCTTKDLLPEEKSSTEAVFHTVMLERHESPDIEDFSFKELQKNMHDFECQWRDDTGNYKGVLMT

SEQ ID NO: 6914 - protein, 81 aa, Macaca mulatta
MLENYWNLVSLGLCHFDMNIISMLEEGKEPWTVKNCVKIARKPRMRECVKGVITDIPPKCTTKDLLPEEKSSTEAVFHTVM

SEQ ID NO: 6915 - protein, 81 aa, Macaca mulatta
RKPRMRECVKGVITDIPPKCTTKDLLPEEKSSTEAVFHTVMLERHESPDIEDFSFKELQKNMHDFECQWRDDTGNYKGVLM

SEQ ID NO: 6916 - protein, 81 aa, Macaca mulatta
KIARKPRMRECVKGVITDIPPKCTTKDLLPEEKSSTEAVFHTVMLERHESPDIEDFSFKELQKNMHDFECQWRDDTGNYKG

SEQ ID NO: 6917 - protein, 81 aa, Macaca mulatta
MAFTQLTFRDVAIEFSQEEWKCLNSTQRTLYRDVMLENYRNLVSLDLSRNCMIKELAPQRESNREEVFHTVTLEQHEKHDI

SEQ ID NO: 6918 - protein, 81 aa, Macaca mulatta
MAFTQLTFRDVAIEFSQEEWKCLNSTQRTLYRDVMLENYRNLVSLEYYLMWEHRKEPWTMESQVQIARKPKGWEWIKGVKI

SEQ ID NO: 6919 - protein, 81 aa, Macaca mulatta
MDGDGLTFRDVAIEFSQEEWKCLNSTQRTLYRDVMLENYRNLVSLDLSRNCMIKELAPQRESNREEVFHTVTLEQHEKHDI

SEQ ID NO: 6920 - protein, 81 aa, Macaca mulatta
MAFTQGQLTFRDVAIEFSQEEWKCLNSTQRTLYRDVMLENYRNLVSLDLSRNCMIKELAPQRESNREEVFHTVTLEQHEKH

SEQ ID NO: 6921 - protein, 81 aa, Macaca mulatta
HEEETRKKRAKESGMAFTQLTFRDVAIEFSQEEWKCLNSTQRTLYRDVMLENYRNLVSLDLSRNCMIKELAPQRESNREEV

SEQ ID NO: 6922 - protein, 81 aa, Macaca mulatta
TQRTLYRDVMLENYRNLVSLDLSRNCMIKELAPQRESNREEVFHTVTLEQHEKHDIEEFCFREMKKKIHDFDCQWRDNERN

SEQ ID NO: 6923 - protein, 81 aa, Macaca mulatta
MDGDGLTFRDVAIEFSQEEWKCLNSTQRTLYRDVMLENYRNLVSLEYYLMWEHRKEPWTMESQVQIARKPKGWEWIKGVKI

SEQ ID NO: 6924 - protein, 81 aa, Macaca mulatta
MLENYRNLASLGISCFDLSIISMLEQGKEPFTVESQVQIARNPDGWEWIKAVITALSSEFLMKDLPHKGKSNKGEIFQTVM

SEQ ID NO: 6925 - protein, 81 aa, Macaca mulatta
SMLEQGKEPFTVESQVQIARNPDGWEWIKAVITALSSEFLMKDLPHKGKSNKGEIFQTVMLERQESHDIEGCSFREVQKNT

SEQ ID NO: 6926 - protein, 81 aa, Macaca mulatta
MAPPQGQLTLKDVAIEFSQEEWTYLDPAQKTLYRDVMLENYRNLVSLDISCKCVNKDPPPKGKNSTGEAFHMVKLEGLESC

SEQ ID NO: 6927 - protein, 81 aa, Macaca mulatta
MLENYRNLVSLGISLSEMSIISMLGQGKEPWTVEREVRITKTSNGWERIKGVNTDVSPTHMIKKSPPKQNNSTEKVFQAVM

SEQ ID NO: 6928 - protein, 81 aa, Macaca mulatta
TKTSNGWERIKGVNTDVSPTHMIKKSPPKQNNSTEKVFQAVMLERHEIHDIKDFYFREMQQNIHDFECQCHNDERNYREIP

SEQ ID NO: 6929 - protein, 81 aa, Macaca mulatta
MLENYRNLVSLAGISLSEMSIISMLGQGKEPWTVEREVRITKTSNGWERIKGVNTDVSPTHMIKKSPPKQNNSTEKVFQAV

SEQ ID NO: 6930 - protein, 81 aa, Macaca mulatta
MEKGLFTFKDVAIEFSQEEWEYLDPAQRALYRDVMLENYRNLLSLDEDNVLPENDISVGFTSKGLSPKENNKEELYHLVIL

SEQ ID NO: 6931 - protein, 81 aa, Macaca mulatta
ALYRDVMLENYRNLLSLDEDNVLPENDISVGFTSKGLSPKENNKEELYHLVILERKESHGINNFDLKEVWENMSKFDSLWD

SEQ ID NO: 6932 - protein, 81 aa, Macaca mulatta
MALSQGLFTFKDVAIEFSQEEWEYLDPAQRALYRDVMLENYRNLLSLDEDNVLPENDISVGFTSKGLSPKENNKEELYHLV

SEQ ID NO: 6933 - protein, 81 aa, Macaca mulatta
LYRDVMLENYRNLLSLDEDNVLPENDISVGFTSKGLSPKENNKEELYHLVILERKESHGINNFDLKEVWENMSKFDSLWDY

SEQ ID NO: 6934 - protein, 81 aa, Macaca mulatta
EEATKKSKEKDPGMALPQGRLTFRDVAIEFSLAEWKCLDPVQRALYTAVMLENYRNLEFVDSFLKFMMEFSSTGHSNTREG

SEQ ID NO: 6935 - protein, 81 aa, Macaca mulatta
MALPQGLLTFRDVAIEFSQEEWKCLDPAQRTLYRDVMLENYRNLVSLDISSKCMMKEFSSTAQGNTEVIHRGTIQRHERHH

SEQ ID NO: 6936 - protein, 81 aa, Macaca mulatta
MALPQGLLTFRDVAIEFSQEEWKCLDPAQRTLYRAVMLENYRNLVSLAISSKCMMKEFSSTAQGNREVLHTGTLQRHESHH

SEQ ID NO: 6937 - protein, 81 aa, Macaca mulatta
MALPQGLLTFRDVAIEFSQEEWKCLDPAQRTLYRDVMVENYRNLVSLDISSKCKMKEFLSTAQSNREVFHTGTLQRHESHQ

SEQ ID NO: 6938 - protein, 81 aa, Macaca mulatta
MAPPQGLLTFRDVAIEFSQEEWKCLDPAQRTLYRDVMLENYRNLVSLDISSKCTMKDFSSTVQGNTEVIHTRTLERHHIGD

SEQ ID NO: 6939 - protein, 81 aa, Macaca mulatta
MAPPQGLLTFRDVAIEFSQEEWKCLDPAQRTLYREVMVENYRNLVSLDISSKCMMEFLSTAQSNREVIHTGTLERHESHHI

SEQ ID NO: 6940 - protein, 81 aa, Macaca mulatta
MAPPQGLLTFRDVAIEFSQEEWKCLDPAQRTLYREVMVENYRNLVSLGSHFVTQAGGQWRDLGLLQPQPSGFKGSSHLSPH

SEQ ID NO: 6941 - protein, 81 aa, Macaca mulatta
MAQGLVTFADVAIDFSQEEWACLNSAQRDLYWDVMLENYSNLVSLDLESAYENKSLPTGKNIHEIRASKRNSDRRSKSLGR

SEQ ID NO: 6942 - protein, 81 aa, Macaca mulatta
MSQGSVTFQDVAIDFSKEEWRFLNPAQRDLYTTVMLENYQNLVWLGLSISKSVISLLEKRKLPWIMGKEEIRVPLPGMEEV

SEQ ID NO: 6943 - protein, 81 aa, Macaca mulatta
MSLGSELFRDVAIVFSQEEWQCLAPAQRDLYRDVMLETYNNLVSLGLAISKPDVISFLEQGKEPWMVERVVSGGLCPGAKG

SEQ ID NO: 6944 - protein, 81 aa, Macaca mulatta
MSLGSELFRDVAIVFSQEEWQCLAPAQRDLYRDVMLETYNNLVSLGLAISKPDVISFLEQGKEPWMVERVVSGGLCPVLES

SEQ ID NO: 6945 - protein, 81 aa, Macaca mulatta
MSKDLVTFGDVAVNFSQEEWEWLNPAQRNLYRKVMLENYRSLVSLGVSVSKPDVISLLEQGKEPWMVKKEGTRGTCPDWEY

SEQ ID NO: 6946 - protein, 81 aa, Macaca mulatta
ITHKEILPEVQNKEYNKSWQTFHQDTIFDIQQSFPTKEKEHKHEPQKKSYRKKSVEMKHRKVYVEKKLLKCNDCEKVFNQS

SEQ ID NO: 6947 - protein, 81 aa, Macaca mulatta
MSKDLVTFGDVAVNFSQEEWEWLNPAQRNLYRKVMLENYRSLVSLAGVSVSKPDVISLLEQGKEPWMVKKEGTRGTCPDWE

SEQ ID NO: 6948 - protein, 81 aa, Macaca mulatta
MPAARGKSKSKAPITFGDLAIYFSQEEWEWLSPIQKDLYEDVMLENYRNLVSLGLSFRRPNVITLLEKGKAPWMVEPVRRR

SEQ ID NO: 6949 - protein, 81 aa, Macaca mulatta
DPKGGEGMPAARGKSKSKAPITFGDLAIYFSQEEWEWLSPIQKDLYEDVMLENYRNLVSLGLSFRRPNVITLLEKGKAPWM

SEQ ID NO: 6950 - protein, 81 aa, Macaca mulatta
MNVEVVKVMPQDLVTFKDVAIDFSQEEWQWMNPAQKHLYRSMMLENYQSLVSLGLCISKPCVISLLEQGREPWEMTSEMTR

SEQ ID NO: 6951 - protein, 81 aa, Macaca mulatta
NQKLEAAGTGIEPKAMPQGLVTFGDVAVDFSQEEWEWLNPNQRNLYRKVMLENYKNLASLGLCVSKPDVISSLEQGKEPWT

SEQ ID NO: 6952 - protein, 81 aa, Macaca mulatta
LEYSLLGEHWDYDALFDTQPGLVTIKNLAVDFPQQLHPAQKNFSKNGIWENHSDLGSAGHCVAKPDLVSLLQQEKEPWMVK

SEQ ID NO: 6953 - protein, 81 aa, Macaca mulatta
SQEEVEVAGIKLRKAMSLGSVTFTDVAIDFSQDEWEWLNLAQRSLYKKVMLENYRNLVSVGLCLSKPDVISLLEQEKDPWV

SEQ ID NO: 6954 - protein, 81 aa, Macaca mulatta
MAAQLLTDEALESVTFRDVTVDFTQEEWQQLEPAQKDLYRDVMLENYRNLVSLDWETRPEMKELDPKKDISEDKPSVVGVA

SEQ ID NO: 6955 - protein, 81 aa, Macaca mulatta
AGSQFLDFKHLGAFLVFEELVTFEDVFVDFSPEELSSLSAAQRNLYREVMLENYRNLVSLGYQFSKPDIISRLEAEESRAM

SEQ ID NO: 6956 - protein, 81 aa, Macaca mulatta
RDSRAYESRSQDAESYQNVVDLTEDRKPHNTIQDNMENYRKLLSLGFLAQDSVPAEKRNTEMLDNLPSAGSQFLDFKHLGA

SEQ ID NO: 6957 - protein, 81 aa, Macaca mulatta
MNNSQGRVTFEDVTVNFTKGEWQRLNPEQRNLYRDVMLENYSNLVFVGREETTKPDVILRLEQGKEPWLVEEEVLGSGRPE

SEQ ID NO: 6958 - protein, 81 aa, Macaca mulatta
MAAAVLTDRAQVSVTFDDVAVTFTKEEWGQLDLAQRTLYQEVMLENCGLLVSLGCPIPRPELIYHLEHGQEPWTRKEDLSQ

SEQ ID NO: 6959 - protein, 81 aa, Macaca mulatta
MAAAVLTDRAQVSVTFDDVAVTFTKEEWGQLDLAQRTLYQEVMLENCGLLVSLGNKGKPKTTEPTTCEPALSEGISLQGQL

SEQ ID NO: 6960 - protein, 81 aa, Macaca mulatta
MATALTDPAQVSVTFDDVAVTFTQEEWGQLDLAQRTLYQEVMLENCGLLVSLGCPVPRPELIYHLEHGQEPWTRKEDLSQD

SEQ ID NO: 6961 - protein, 81 aa, Macaca mulatta
MAASAQVSVTFEDVAVTFTQEEWGQLDAAQRTLYQEVMLETYGLLVSLGCPLFEPELIYQLDRREELWIVKKDLSQSSYPG

SEQ ID NO: 6962 - protein, 81 aa, Macaca mulatta
MAAAVLMDRVQSCVTFEDVFVYFSREEWELLEEAQRFLYRDVMLENFALVATLGFWCEAENEEAPSEQSVSVGVSQVRTAE

SEQ ID NO: 6963 - protein, 81 aa, Macaca mulatta
MAAAVLMDRVQSCVTFEDVFVYFSREEWELLEEAQRFLYRDVMLENFALVATLAFIFPVPCSCPVGRGRKPWVPDRADTTA

SEQ ID NO: 6964 - protein, 81 aa, Macaca mulatta
MYSSLPIWQGRVVFEDVAIYFSQEEWGHLDEAQRLLYRDVMLENLALLSSLGCCHGAEDEEAPLEPGVSVGVSQVMAPKPC

SEQ ID NO: 6965 - protein, 81 aa, Macaca mulatta
MAEMNPAQGRVVFEDVAIYFSQEEWGHLDEAQRLLYRDVMLENLALLSSLGCWHGAEDEEAPSQQGFSVGMPEVTTSKSYL

SEQ ID NO: 6966 - protein, 81 aa, Macaca mulatta
MNLTEGPLVMAETDPTQGRVVFEDVAIYFSQEEWGHLDEAQRLLYRDVMLENLALLSSLGCWHGAEDEEAPSQQGFSVGMP

SEQ ID NO: 6967 - protein, 81 aa, Macaca mulatta
MAETDPTQGRVVFEDVAIYFSQEEWGHLDEAQRLLYRDVMLENLALLSSLGCWHGAEDEEAPSQQGFSVGMPEVTTSKSYL

SEQ ID NO: 6968 - protein, 81 aa, Macaca mulatta
RQVDIKGPLVMAETDPTQGRVVFEDVAIYFSQEEWGHLDEAQRLLYRDVMLENLALLSSLGCWHGAEDEEAPSQQGFSVGM

SEQ ID NO: 6969 - protein, 81 aa, Macaca mulatta
MNLTEGPVMAETDPTQDCMVFEDVAIHFSQEEWGILNGVQRHLHSDVMLENFALLSSVGCWHGAKDEEAPSKQCVSVGVSQ

SEQ ID NO: 6970 - protein, 81 aa, Macaca mulatta
VLMDAGQDCMVFEDVAIHFSQEEWGILNGVQRHLHSDVMLENFALLSSVGCWHGAKDEEAPSKQCVSVGVSQVTTLKPALC

SEQ ID NO: 6971 - protein, 81 aa, Macaca mulatta
MNLTEDCMVFEDVAIHFSQEEWGILNGVQRHLHSDVMLENFALLSSVGCWHGAKDEEAPSKQCVSVGVSQVTTLKPALCTQ

SEQ ID NO: 6972 - protein, 81 aa, Macaca mulatta
MNLTEECMVFEDVAIYFSREEWGILNDAQRHLHSNVMLENFALLSSVGCWHGAKDEEVLSKQCVSVRVLQVTAPKPALPTL

SEQ ID NO: 6973 - protein, 81 aa, Macaca mulatta
VNCSAHRGERNFTCTQGGRDFTASSDLLQQHVLNSGRKLYRDTQNGENFQGKQNDFNSSQGGKDFCHQHRLFEHQKTHNGE

SEQ ID NO: 6974 - protein, 81 aa, Macaca mulatta
MAAAEPMGPAQVPMNSEVIMDPIQGQVNFEDVFVYFSQEEWVLLDEAQRLLYRDVMLENFALMASLERQAMSIRTVLQHPT

SEQ ID NO: 6975 - protein, 81 aa, Macaca mulatta
AAAEPMGPAQVPMNSEVIMDPIQGQVNFEDVFVYFSQEEWVLLDEAQRLLYRDVMLENFALMASLERQAMSIRTVLQHPTG

SEQ ID NO: 6976 - protein, 81 aa, Macaca mulatta
MGPAQVPMNSEVIMDPIQGQVNFEDVFVYFSQEEWVLLDEAQRLLYRDVMLENFALMASLGHTSFMSHIVASLVMGSEPWL

SEQ ID NO: 6977 - protein, 81 aa, Macaca mulatta
MGPAQVPMNSEVIMDPIQGQVNFEDVFVYFSQEEWVLLDEAQRLLYRDVMLENFALMASLGCWHGMEDEEIPFEQSFSIGM

SEQ ID NO: 6978 - protein, 81 aa, Macaca mulatta
MNSEVIMDPIQGQVNFEDVFVYFSQEEWVLLDEAQRLLYRDVMLENFALMASLGHTSFMSHIVASLVMGSEPWLPDWVDMT

SEQ ID NO: 6979 - protein, 81 aa, Macaca mulatta
MAAAALRDPTQQGYVTFEDVAVYFSQEEWRLLDEAQRLLCRNVMLENFSLLASLGLASSKTHDITQLESWKEPFMPASEVV

SEQ ID NO: 6980 - protein, 81 aa, Macaca mulatta
MAAAALRDPTQGYVTFEDVAVYFSQEEWRLLDEAQRLLCRNVMLENFSLLASLGLASSKTHDITQLESWKEPFMPASEVVT

SEQ ID NO: 6981 - protein, 81 aa, Macaca mulatta
RDPTQVLVTAELFTYHEEGYVTFEDVAVYFSQEEWRLLDEAQRLLCRNVMLENFSLLASLGLASSKTHDITQLESWKEPFM

SEQ ID NO: 6982 - protein, 81 aa, Macaca mulatta
MAAAALRDPTQGYVTFEDVAVYFSQEEWRLLDEAQRLLCRNVMLENFSLLASLGKFLTAHPSILGWTWLFLLFLVTGLFFP

SEQ ID NO: 6983 - protein, 81 aa, Macaca mulatta
EAQRLLCRNVMLENFSLLASLGKFLTAHPSILGWTWLFLLFLVTGLFFPKLNCGHSFLLQDLEVATVVSLGCVYYHLLSPS

SEQ ID NO: 6984 - protein, 81 aa, Macaca mulatta
MAAAALRDPTQQGYVTFEDVAVYFSQEEWRLLDEAQRLLCRNVMLENFSLLASLGCWHGAEAEEAPEQSASVGLCSSNVQQ

SEQ ID NO: 6985 - protein, 81 aa, Macaca mulatta
RDPTQVLVTAELFTYHEQGYVTFEDVAVYFSQEEWRLLDEAQRLLCRNVMLENFSLLASLGLASSKTHDITQLESWKEPFM

SEQ ID NO: 6986 - protein, 81 aa, Macaca mulatta
MAGAALRDPAQGYVTFEDVAVYFSQEEWRLLDETQRLLYRNVMLENFSLLASLGLASSKTHEITQLESWEEPFMPAWEVMT

SEQ ID NO: 6987 - protein, 81 aa, Macaca mulatta
MAGAALRDPAQQGYVTFEDVAVYFSQEEWRLLDETQRLLYRNVMLENFSLLASLGLASSKTHEITQLESWEEPFMPAWEVM

SEQ ID NO: 6988 - protein, 81 aa, Macaca mulatta
VNTPQIPMATEEFVKPSQGHVTFEDIAVYFSQEEWGLLDEAQRCLYHDVMLENFSLMASVGCLHGIETEEAPSEHTISAQG

SEQ ID NO: 6989 - protein, 81 aa, Macaca mulatta
LVNTPQIPMATEEFVKPSQGHVTFEDIAVYFSQEEWGLLDEAQRCLYHDVMLENFSLMASVARLSESNHKDSCSQQKVTVS

SEQ ID NO: 6990 - protein, 81 aa, Macaca mulatta
MAEAKDAAQMLVTFKDVAVTFTQEEWRQLDLTQRTLYREVMLETCGLLVSLGHRVPKPELVHLLEHGQELWTVKRGLSHPT

SEQ ID NO: 6991 - protein, 81 aa, Macaca mulatta
MLVTFKDVAVTFTQEEWRQLDLTQRTLYREVMLETCGLLVSLGHRVPKPELVHLLEHGQELWTVKRGLSHPTCAGDRTQVH

SEQ ID NO: 6992 - protein, 81 aa, Macaca mulatta
RDSTSVPVTAEAKVMGFTQGSVTFEDVAIYFSQEEWGLLDEAQRLLYRDVMLENFALITALVCCHGMEDEETPEQSVSVER

SEQ ID NO: 6993 - protein, 81 aa, Macaca mulatta
MDLTKGCVTFEDIAIYFSQEEWGLLDEAQRRLYLEVMLENFALVASLGCGHGTEDEETPSEQNVSVRVSQSKAGSSTQKTQ

SEQ ID NO: 6994 - protein, 81 aa, Macaca mulatta
MAAAALRAPTQGCVTFEDIAIYFSQEEWGLLDEAQRRLYLEVMLENFALVASLGCGHGTEDEETPSEQNVSVRVSQSKAGS

SEQ ID NO: 6995 - protein, 81 aa, Macaca mulatta
RAPTQVTVSPETHMDLTKGCVTFEDIAIYFSQEEWGLLDEAQRRLYLEVMLENFALVASLGCGHGTEDEETPSEQNVSVRV

SEQ ID NO: 6996 - protein, 81 aa, Macaca mulatta
MAAAALRAPTQEEWGLLDEAQRRLYLEVMLENFALVASLGCGHGTEDEETPSEQNVSVRVSQSKAGSSTQKTQSCEMCVPV

SEQ ID NO: 6997 - protein, 81 aa, Macaca mulatta
MAAAMRAPTLQGFVAFEDVAIYFSQEEWELLDETQRLLYHDVMLENFAVMASLGCWCGAEDEGAPSAESISVSELSQGRTP

SEQ ID NO: 6998 - protein, 81 aa, Macaca mulatta
SASAFRVAGTTGMRHHAQGSVTFEDVAVYFSWEEWDLLDEAQKHLYFDVMLENFALTSSLGCWHGVEHEETPSEQRISVEG

SEQ ID NO: 6999 - protein, 81 aa, Macaca mulatta
VQLRPQTRMATALRDPAPGSVTFEDVAVYFSWEEWDLLDEAQKHLYFDVMLENFALTSSLGLTSSWSHVVAQLGLGEVSSV

SEQ ID NO: 7000 - protein, 81 aa, Macaca mulatta
RDPAPVPIATEVLFKLTQGSVTFEDVAVYFSWEEWDLLDEAQKHLYFDVMLENFALTSSLGLTSSWSHVVAQLGLGEVSSV

SEQ ID NO: 7001 - protein, 81 aa, Macaca mulatta
MATALRDPAPGSVTFEDVAVYFSWEEWDLLDEAQKHLYFDVMLENFALTSSLGLTSSWSHVVAQLGLGEVSSVLHRMFMTP

SEQ ID NO: 7002 - protein, 81 aa, Macaca mulatta
MTFEDVAIYFSQEEWELLDESQRFLYCDVMLENFAHVTSLGYCHGTENEVIASEQSVSTQVRTSEGDTPTQKSLSEIKMCV

SEQ ID NO: 7003 - protein, 81 aa, Macaca mulatta
SPPSRRSSMAAVALRDPAQGMTFEDVAIYFSQEEWELLDESQRFLYCDVMLENFAHVTSLGYCHGTENEVIASEQSVSTQV

SEQ ID NO: 7004 - protein, 81 aa, Macaca mulatta
MAAVALRDPAQGTVTFEDVAVNFSQEEWSLLSEAQRCLYHDVMLENLALISSLGCWYGAKDEPPSKQTLSIQQESPLRTHW

SEQ ID NO: 7005 - protein, 81 aa, Macaca mulatta
MAAAALRAPAQGTVTFEDVAIHFSWEEWGLLDEAQRCLYRDVMLENLALLTSLDVHHRKQHLGEKHFRSNVGTALFVKTCT

SEQ ID NO: 7006 - protein, 81 aa, Macaca mulatta
PAAVRAHGPVAELTDSARGCVVFEDVFVYFSREEWELLDDAQRLLYHDVMLENFALLASLGIAFSRSCAVIKLEQAEEPWV

SEQ ID NO: 7007 - protein, 81 aa, Macaca mulatta
MAAAALRPTAQGTVTFEDVAVNFSQEEWSLLSEAQRCLYHDVMLENLALISSLGCWYGAKDEPPSKQTLSIQQESPLRTHW

SEQ ID NO: 7008 - protein, 81 aa, Macaca mulatta
MAAAAALRDPAQSSVTFEDVAVNFSLEEWSLLNEAQRCLYHDVMLETLTLISSLGCWHGGEDEAAPSKQSTCIHIYKDQGG

SEQ ID NO: 7009 - protein, 81 aa, Macaca mulatta
LREEEDQTGSYCPSRETQSSVTFEDVAVNFSLEEWSLLNEAQRCLYHDVMLETLTLISSLGCWHGGEDEAAPSKQSTCIHI

SEQ ID NO: 7010 - protein, 81 aa, Macaca mulatta
MRWGERQGTVTFEDVAVNFTQEEWNLLSEAQRCLYRDVMLENLALISSLGCWCGVEDEEGPSKQSIYKQRETQIRIPMAGV

SEQ ID NO: 7011 - protein, 81 aa, Macaca mulatta
MAAPALRFPVQGTVTFEDVAVNFTQEEWNLLSEAQRCLYRDVMLENLALISSLGCWCGVEDEEGPSKQSIYKQRETQIRIP

SEQ ID NO: 7012 - protein, 81 aa, Macaca mulatta
MAATAPRRLAQQDTVTFEDVAVNFSQEEWSLLSEVQRCLYRDVMLENLALISSLDCWCGSKDKEAPSTQSISVQRESQNRT

SEQ ID NO: 7013 - protein, 81 aa, Macaca mulatta
MAAAATLRLSAQGTVTFEDVAVKFTREEWNLLSEAQRCLYRDVTLENLALISSLGCWCGVEDEAPSKQSIYIQRETQVRIP

SEQ ID NO: 7014 - protein, 81 aa, Macaca mulatta
MAAAALRLPAQQGTVAFEDVAVNFSQEEWSLLSEVQRCLYHDVMLENWVLISSLGYWCGSEDEEAPSKRNILHLADHQGTH

SEQ ID NO: 7015 - protein, 81 aa, Macaca mulatta
HRMTWDCIALGNHENSVQGTVAFEDVAVNFSQEEWSLLSEVQRCLYHDVMLENWVLISSLGYWCGSEDEEAPSKRNILHLA

SEQ ID NO: 7016 - protein, 81 aa, Macaca mulatta
GTVAFEDVAVNFSQEEWSLLSEVQRCLYHDVMLENWVLISSLGYWCGSEDEEAPSKRNLHLSAQAEVSRSQLTAASASRVQ

SEQ ID NO: 7017 - protein, 81 aa, Macaca mulatta
MAAAELTAPAQGVVTFEDVAVYFSWKEWGLLDEAQKCLYHDVMLENLTLTTSLGGCGAGDEEAPYQQSTSSQRVSQVRLPK

SEQ ID NO: 7018 - protein, 81 aa, Macaca mulatta
GNLEEGRRATGLPAAQVQEPVTFKDVAVDFTQEEWGQLDLVQRTLYRDVMLETYGHLLSVGNQIAKPEVISLLEQGEEPWS

SEQ ID NO: 7019 - protein, 81 aa, Macaca mulatta
RRRSVGRRCSGLCLAVRREQVTFEDVVVDFSQEEWGQLKPAQRTLYRDVMLDTFRLLVSVGHWLPKPNVISLLEQEAEPRA

SEQ ID NO: 7020 - protein, 81 aa, Macaca mulatta
RFLWDSLWYCRGEDTEDHWEWSCESLESLAVPVAFTPVKTPVQEQWQRNGFGENVSLNPDLPHQPMTPEKQGPHMWGTRGK

SEQ ID NO: 7021 - protein, 81 aa, Macaca mulatta
MTPGLRVSTDPEQVTFEDVVVDFSQEEWGQLKPAQRTLYRDVMLDTFRLLVSVGHWLPKPNVISLLEQEAEPRAVDSRVPP

SEQ ID NO: 7022 - protein, 81 aa, Macaca mulatta
QEEKQEDAAICPVTVLSEEPVTFQDVAVDFSREEWGLLGPTQRTEYRDVMLETFGHLVSVGWETTLENKELAPNSDIPQEE

SEQ ID NO: 7023 - protein, 81 aa, Macaca mulatta
MASRLPTAWSCEPVNFEDVTLGFTPEEWGLLDLKQKSLYREVMLENYRNLVSVEHQLSKPDVVSQLEEAEDFWPVERGIPQ

SEQ ID NO: 7024 - protein, 81 aa, Macaca mulatta
MASRLPTAWSCEPVNFEDVTLGFTPEEWGLLDLKQKSLYREVMLENYRNLVSVEYSELQLDPKLDPLPAESPLMNIEVVEV

SEQ ID NO: 7025 - protein, 81 aa, Macaca mulatta
MLENYRNLVSVEHQLSKPDVVSQLEEAEDFWPVERGIPQDTIPEYSELQLDPKLDPLPAESPLMNIEVVEVLTLNQEVAGP

SEQ ID NO: 7026 - protein, 81 aa, Macaca mulatta
MEARSKLVPPQASVCFEDVAMAFTQEEWEQLDLAQRTLYREVTLETWEHIVSLGLFLSKSDVISQLEQEEDLCRAEQVVPR

SEQ ID NO: 7027 - protein, 81 aa, Macaca mulatta
EDVAMAFTQEEWEQLDLAQRTLYREVTLETWEHIVSLGLFLSKSDVISQLEQEEDLCRAEQVVPRDRVSLLLPRLECSGTI

SEQ ID NO: 7028 - protein, 81 aa, Macaca mulatta
EDVAMAFTQEEWEQLDLAQRTLYREVTLETWEHIVSLGLFLSKSDVISQLEQEEDLCRAEQVVPRGARSSKEQRGYRARRM

SEQ ID NO: 7029 - protein, 81 aa, Macaca mulatta
MSVGPPATRLQEPVTFRDVAVDFTQEEWGQLDPTQRILYRDVMLETFGHLLSIGPELPKPEVISQLEQGTELWVAERGTIQ

SEQ ID NO: 7030 - protein, 81 aa, Macaca mulatta
MAGEAEVQLDPSLQGLVMFEDVAVYFSREEWGLLNVTQKGLYRDVMLENFALVSSLGLAPSRSPVFSQLEKDEQLWVPSWV

SEQ ID NO: 7031 - protein, 81 aa, Macaca mulatta
MAGEAEGLVMFEDVAVYFSREEWGLLNVTQKGLYRDVMLENFALVSSLGLAPSRSPVFSQLEKDEQLWVPSWVDVTPVSRA

SEQ ID NO: 7032 - protein, 81 aa, Macaca mulatta
GPAQHTSWPCGSAVPALKSLVTFEDVAVYFSQEEWELLDAAQRHLYHSVMLENLELVTSLGCWHGVEGEEAHPKQNISVEE

SEQ ID NO: 7033 - protein, 81 aa, Macaca mulatta
PALKSLVTFEDVAVYFSQEEWELLDAAQRHLYHSVMLENLELVTSLGNTLSQHDVFTCSVGTDLSNYFPNWLHHFTSLSGV

SEQ ID NO: 7034 - protein, 81 aa, Macaca mulatta
MAFEDVAVYFSQEEWGLLDTAQRALYRHVMLENFTLVTSLGLSTSRPHVVIQLERGEEPWVPSGKDMTLARNTYRRLNAGS

SEQ ID NO: 7035 - protein, 81 aa, Macaca mulatta
MAFEDVAVYFSQEEWGLLDTAQRALYRRVMLDNFALVASLGLSTSRPRVVIQLERGEEPWVPSGTDTILSRNTYRRRNPGS

SEQ ID NO: 7036 - protein, 81 aa, Macaca mulatta
PLAVQSPEGHHGHQAAASTSFHPPRIQEEWGLLDRSQKELYWDTMLEKYGTVVSLGLPPHQPEAQAQSELGMLLMGTGVCR

SEQ ID NO: 7037 - protein, 81 aa, Macaca mulatta
EEAAQKRKEKEPGMALPQGHLTFRDVAIEFSLEEWKCLDPVQRALYRAVMLENYRNLHSVDISSKCVMKKFSSTGQGNTEV

SEQ ID NO: 7038 - protein, 81 aa, Macaca mulatta
MLQTVWFQGLSRNLLFQEPVTFEDVAVYFTQNEWASLHPMQRALYREVMLENYANVTSLYPTAGGFPLSTERTEKVPGALP

SEQ ID NO: 7039 - protein, 81 aa, Macaca mulatta
MLQTVWFQGLSRNLLFQEPVTFEDVAVYFTQNEWASLHPMQRALYREVMLENYANVTSLSAFPFSKPDLIFQLEQGEAAWG

SEQ ID NO: 7040 - protein, 81 aa, Macaca mulatta
MLQTAWRQEPVTFEDVAVYFTQNEWASLDSVQRALYREVMLENYANVASLAFPFTTPVLVSQLEQGELPWGLDPWEPMGRE

SEQ ID NO: 7041 - protein, 81 aa, Macaca mulatta
MLQATWPQESVTFEDVAVYFTQNQWASLDPAQRALYGEVMLENYANVASLVAFPFPKPALISHLERGEAPWGPDPWDTEIP

SEQ ID NO: 7042 - protein, 81 aa, Macaca mulatta
MLQATWPQESVTFEDVAVYFTQNQWASLDPAQRALYGEVMLENYANVASLAFPFPKPALISHLERGEAPWGPDPWDTEIPR

SEQ ID NO: 7043 - protein, 81 aa, Macaca mulatta
MMTAVSLTTRSQESVAFEDVAVYFTTKEWAIMVPAERALYRDVMLENYEAVAFVVPPTSKPALVSHLEQGKESCFIRPQGV

SEQ ID NO: 7044 - protein, 81 aa, Macaca mulatta
LGPDLELLQGQPAPPRARPESVTFEDVAVYFSENEWIGLGPAQRALYRDVMLENYGAVASLAFPFPKPALISQLERGEAPW

SEQ ID NO: 7045 - protein, 81 aa, Macaca mulatta
REGCPGDQVTPPRSLTAQLQTMTFKDVEVTFSQDEWGWLDSAQRNLYRDVMLENYRNMAFLVGPFTKPALISWLEAREPWG

SEQ ID NO: 7046 - protein, 81 aa, Macaca mulatta
DTPAAQMPALFQREGCPGDQTMTFKDVEVTFSQDEWGWLDSAQRNLYRDVMLENYRNMAFLVGPFTKPALISWLEAREPWG

SEQ ID NO: 7047 - protein, 81 aa, Macaca mulatta
FLAGQSDTPAAQMPALFQREGCPGDQVTPPRSLTAQLQTMTFKDVEVTFSQDEWGWLDSAQRNLYRDVMLENYRNMAFLGK

SEQ ID NO: 7048 - protein, 81 aa, Macaca mulatta
MVRPQDTVAYEDLCVDYTQKKWKCPALSQALQWNMIPENDHSMASLGRNMMESSELIPKQEIFKGSESSNSTSGGLFGVVP

SEQ ID NO: 7049 - protein, 81 aa, Macaca mulatta
GFSYNSSLMVHQRTHTGEKPYKCNSCEKAFSDSSQLTVHQRVHTGRNLMNVLSVGKPLVSVPLLITTSELTLERSPQVWLG

SEQ ID NO: 7050 - protein, 81 aa, Macaca mulatta
PVPTLPQVGNSGLRMVRPQDTVAYEDLSVGYTQKKWKCPALSQRALQWNMMPENDRSMASLAGENMMKGSELTPKQEIFKG

SEQ ID NO: 7051 - protein, 81 aa, Macaca mulatta
HHLPNGDFAQCASPVPTLPQVGNSGLRMVRPQDTVAYEDLSVGYTQKKWKCPALSQRALQWNMMPENDRSMASLGWSTMAR

SEQ ID NO: 7052 - protein, 81 aa, Macaca mulatta
VPTLPQVGNSGLRMVRPQDTVAYEDLSVGYTQKKWKCPALSQRALQWNMMPENDRSMASLGENMMKGSELTPKQEIFKGSE

SEQ ID NO: 7053 - protein, 81 aa, Macaca mulatta
QCASPVPTLPQVGNSGLRMVRPQDTVAYEDLSVGYTQKKWKCPALSQRALQWNMMPENDRSMASLDGETGTEAELIPKHHS

SEQ ID NO: 7054 - protein, 81 aa, Macaca mulatta
MTRENWAHNALRQEGLVKGKDDTWKWGTSFQGSSSSVWETSHLHFRQLRYHETSGPQEALSRLRELCRRWLRPEARTKAQI

SEQ ID NO: 7055 - protein, 81 aa, Macaca mulatta
EALPAKDSAWPWEGKPRYLGPVTFEDVAVLFTEAEWKRLNLEQRNLFKEVMLENLRNLVSLAESKPEVHTCPSCPLAFGML

SEQ ID NO: 7056 - protein, 81 aa, Macaca mulatta
ALPAKDSAWPWEGKPRYLGPVTFEDVAVLFTEAEWKRLNLEQRNLFKEVMLENLRNLVSLGLGSLRSGLLHLDMNMNLDLW

SEQ ID NO: 7057 - protein, 80 aa, Macaca mulatta
MWAPREQLLGSATEALPAKDSAWPWEGKPRYLGPVTFEDVAVLFTEAEWKRLNLEQRNLFKEVMLENLRNLVSLVLSYQI

SEQ ID NO: 7058 - protein, 81 aa, Macaca mulatta
EALPAKDSAWPWEGKPRYLGPVTFEDVAVLFTEAEWKRLNLEQRNLFKEVMLENLRNLVSLAESKPEVHTCPSCPLAFGSQ

SEQ ID NO: 7059 - protein, 81 aa, Macaca mulatta
ALPAKDSAWPWEGKPRYLGPVTFEDVAVLFTEAEWKRLNLEQRNLFKEVMLENLRNLVSLESKPEVHTCPSCPLAFGSQQF

SEQ ID NO: 7060 - protein, 81 aa, Macaca mulatta
REQLLGSATEALPAKDSAWPWEGKPRYLGPVTFEDVAVLFTEAEWKRLNLEQRNLFKEVMLENLRNLVSLELTIFQYRRHP

SEQ ID NO: 7061 - protein, 81 aa, Macaca mulatta
ALPAKDSAWPWEGKPRYLGPVTFEDVAVLFTEAEWKRLNLEQRNLFKEVMLENLRNLVSLGSRCHPGWRALAQSQLTAAST

SEQ ID NO: 7062 - protein, 81 aa, Macaca mulatta
MLVAAAAERNKEPILHVLRQYLDPTQRGVRVLEVASGSGQHAAHFARAFPLAEWQPSDVDQRCLDRNPEWGLRDTALLEDL

SEQ ID NO: 7063 - protein, 81 aa, Macaca mulatta
VLRQYLDPTQRGVRVLEVASGSGQHAAHFARAFPLAEWQPSDVDQRCLDRNPEWGLRDTALLEDLGQASGLLLERMVDMPA

SEQ ID NO: 7064 - protein, 81 aa, Macaca mulatta
EGRTRDRQMAAALLTAWSQMPVTFEDVALYLSREEWGRLDHTQQNFYRDVLQKRNGLSLGFPFSRPFWAPQALGKGEASGS

SEQ ID NO: 7065 - protein, 81 aa, Macaca mulatta
EGRTRDRQMAAALLTAWSQMPVTFEDVALYLSREEWGRLDHTQQNFYRDVLQKRNGLSLGKHSPGVGTGFPFSRPFWAPQA

SEQ ID NO: 7066 - protein, 81 aa, Macaca mulatta
EGRTRDRQMAAALLTAWSQMPVTFEDVALYLSREEWGRLDHTQQNFYRDVLQKRNGLSLGAIEVGQRMPTSSVAALGDVKP

SEQ ID NO: 7067 - protein, 81 aa, Macaca mulatta
LKEGRTRETTDTCFVSGVHGPVALGDIPFYFSREEWGTLDPAQRDLFWDIKRENSRNTTLGLGLKGQNEKSRLEEVVPVLP

SEQ ID NO: 7068 - protein, 81 aa, Macaca mulatta
SRNTTLGLGLKGQNEKSRLEEVVPVLPGQTGSDVTVSWSPEEAETWESENRPRAALGPVVGARRGRPPTRRRQFRDLAAEK

SEQ ID NO: 7069 - protein, 81 aa, Macaca mulatta
LFPPEGNMEDKEMTGPQLPESLEDVAMYISQEEWGHQDPSKRALSRDTVQESYENVDSLESHIPSQEVPGTQVGQGGKLWD

SEQ ID NO: 7070 - protein, 81 aa, Macaca mulatta
AVKERGNMEDKEMTGPQLPESLEDVAMYISQEEWGHQDPSKRALSRDTVQESYENVDSLESHIPSQEVPGTQVGQGGKLWD

SEQ ID NO: 7071 - protein, 81 aa, Macaca mulatta
MYFSQEEWELLDPTQKALYNDVMQENYETVISLALFVLPKPKVISCLEQGEEPWVQVSPEFQDSAGKSPTGLKLKNDTENH

SEQ ID NO: 7072 - protein, 81 aa, Macaca mulatta
TNTKDWTVTPEHVLPESQSLLTFEEVAMYFSQEEWELLDPTQKALYNDVMQENYETVISLGEKMQQSRTPSADKAAANVEN

SEQ ID NO: 7073 - protein, 81 aa, Macaca mulatta
TCDNRAVSLCQQEWMCPGPARKALYRGATQRKNRHISLATGVPWGYEETKTLLAILSSSQFYGKLQTCQQNSQIYRAMAQQ

SEQ ID NO: 7074 - protein, 81 aa, Macaca mulatta
QNTGLHDQETGAVVWTAGSQGPATCDNRAVSLCQQEWMCPGPARKALYRGATQRKNRHISLATGVPWGYEETKTLLAILSS

SEQ ID NO: 7075 - protein, 81 aa, Macaca mulatta
ENGEEAVALVEDVQRAPGQQGPATCDNRAVSLCQQEWMCPGPARKALYRGATQRKNRHISLATGVPWGYEETKTLLAILSS

SEQ ID NO: 7076 - protein, 81 aa, Macaca mulatta
MASMPPTPEAQGPILFEDLAVYFSQEECVTLHPAQMSLSRDATKECLEDAALMGEEGKPEINQQLSLESMELDELALEKYP

SEQ ID NO: 7077 - protein, 81 aa, Macaca mulatta
ERGPPAPRHQEIASASPFHSAWSQAPVNLEDVAVYLSGEEPGCLDPAQRDVPLENEGLGIQLEDGGDGREDAPVRMEWYRV

SEQ ID NO: 7078 - protein, 81 aa, Macaca mulatta
EAGSLHSVHQEQLNRKRERRPLPKNARPSPWVPALADEWNTLDQEVTTTRLPAGSQEPVKDVHVARGFSYKKSVHQIPAHR

SEQ ID NO: 7079 - protein, 81 aa, Macaca mulatta
NTLDQEVTTTRLPAGSQEPVKDVHVARGFSYKKSVHQIPAHRDLYQDFRKENVGNMVSLGSTASTSNKITRLEQRREPWTL

SEQ ID NO: 7080 - protein, 81 aa, Macaca mulatta
APLPSRDPNGAVPEWRKPRTVSFADVAVYFSREEWGCLRPAQRALYRDVMRETYGHLGALGVGGSKPALISWVEEEAELWD

SEQ ID NO: 7081 - protein, 81 aa, Macaca mulatta
LRPAQRALYRDVMRETYGHLGALGVGGSKPALISWVEEEAELWDPAARDPEVTKCPTETDPDSRNEEEERQREGMGALEKP

SEQ ID NO: 7082 - protein, 81 aa, Macaca mulatta
APLPSRDPNGAVPEWRKPRTVSFADVAVYFSREEWGCLRPAQRALYRDVMRETYGHLGALGESPTCSPGPCAPTRPAAPLG

SEQ ID NO: 7083 - protein, 81 aa, Macaca mulatta
APLPPRDPNGAGPEWREPGIVSFADVAVYFCREEWGCLRPAQRALYRDVMRETYGHLSALGIGGNKPALISWVEEEAELWG

SEQ ID NO: 7084 - protein, 81 aa, Macaca mulatta
LRPAQRALYRDVMRETYGHLSALGIGGNKPALISWVEEEAELWGPAARDPETKCPTETDPADSRNKEEERQREGMEALEKP

SEQ ID NO: 7085 - protein, 81 aa, Macaca mulatta
LRPAQRALYRDVMRETYGHLSALGIGGNKPALISWVEEEAELWGPAARDPETKCPTETDPDSRNKEEERQREGMEALEKPV

SEQ ID NO: 7086 - protein, 81 aa, Macaca mulatta
APLLARKPGETRPGCRKPGAVSFADVAVYFSPEEWGCLRPAQRALYRDVMRETYGHLGALGFPGPKPALISWMEQETEAWS

SEQ ID NO: 7087 - protein, 81 aa, Macaca mulatta
RAQGPGEARPSRKRGRRPRALKFVDVAVYFSPEEWGCLRPAQRALYRDVMRETYGHLGALGCAGPKPALISWLERNTDDWE

SEQ ID NO: 7088 - protein, 81 aa, Macaca mulatta
MLENYRNLVSLGLAVSKPDLITFLEQRKEPWNVKSEETVAIQPDMFSHDTQGLLRKKLIEASFQKVILDGYGSCGPQNLNL

SEQ ID NO: 7089 - protein, 81 aa, Macaca mulatta
MGLLTFRDVAIEFSQEEWEHLDSDQKLLYGDVMLENYRNLVSLGLAVSKPDLITFLEQRKEPWNVKSEETVAIQPDMFSHD

SEQ ID NO: 7090 - protein, 81 aa, Macaca mulatta
MGLLTFRDVAIEFSQEEWEHLDSDQKLLYGDVMLENYRNLVSLGLAVSKPDLITFLEQRKEPWNVKSEETVAIQPEVKVNT

SEQ ID NO: 7091 - protein, 81 aa, Macaca mulatta
NVPGRGSPEETVGQISTEGLLTFRDVAIEFSQEEWEHLDSDQKLLYGDVMLENYRNLVSLGLAVSKPDLITFLEQRKEPWN

SEQ ID NO: 7092 - protein, 81 aa, Macaca mulatta
VTEHLTGWAPAPVPSLEGLLTFRDVAIEFSQEEWEHLDSDQKLLYGDVMLENYRNLVSLGLAVSKPDLITFLEQRKEPWNV

SEQ ID NO: 7093 - protein, 81 aa, Macaca mulatta
MGLLTFRDVAVEFSLEEWEHLEPAQKTLYQDVMLENYRNLVSLGLLVSKPDLITFLEQRKEPWNVKREETVAVQPDVFSHY

SEQ ID NO: 7094 - protein, 81 aa, Macaca mulatta
MLENYRNLVSLGLLVSKPDLITFLEQRKEPWNVKREETVAVQPDVFSHYNKDLLTEQCTEASFQKVVSRRHGNCHLENLHL

SEQ ID NO: 7095 - protein, 81 aa, Macaca mulatta
MGPLTFMDVAIEFSLKEWQCLDTAQQNLYRDVMLENYRNLVFLGIAFSKPDLITYLEQGKEPWNMKRHETVAKPLVVCSYF

SEQ ID NO: 7096 - protein, 81 aa, Macaca mulatta
MAPRPPTATPQESVTFKDVSVDFTQEEWYHVDPAQRSLYRDVMLENYSHLVSLGYQVSKPEVIFKLEQGEEPWISEGEIQR

SEQ ID NO: 7097 - protein, 81 aa, Macaca mulatta
MAAIPLKTRHQEMVTFEDVAVHFTKTEWTGLSPAQRALYRSVMLENFGNLTALGYPVPKPALISLLEGGDMAWGLEAQDDA

SEQ ID NO: 7098 - protein, 81 aa, Macaca mulatta
MVTFEDVAVHFTKTEWTGLSPAQRALYRSVMLENFGNLTALGYPVPKPALISLLEGGDMAWGLEAQDDAPAERTKNICKGR

SEQ ID NO: 7099 - protein, 81 aa, Macaca mulatta
MVTFEDVAVHFTKTEWTGLSPAQRALYRSVMLENFGNLTALGYPVPKPALISLLEGGDMAWGLEAQDDAPAERTKNICKVI

SEQ ID NO: 7100 - protein, 81 aa, Macaca mulatta
MLENYGNVASLGFPLLKPAVISQLEGGGELGGPSPLAAGTGLWGLRTDIQTDNDLTKEMYEGKENVSFELQRDFSQETDFS

SEQ ID NO: 7101 - protein, 81 aa, Macaca mulatta
MLENYGNVASLGFPLLKPAVISQLEGGGELGGPSPLAAGTGLWGLRTDGVSLCRPNWSAMATWLSATSVSWVRAILLPQPP

SEQ ID NO: 7102 - protein, 81 aa, Macaca mulatta
MLENYGNVASLGFPLLKPAVISQLEGGVDIQTDNDLTKEMYEGKENVSFELQRDFSQETDFSEACLLEKQQEVYSTGNTKK

SEQ ID NO: 7103 - protein, 81 aa, Macaca mulatta
QLEGGVDIQTDNDLTKEMYEGKENVSFELQRDFSQETDFSEACLLEKQQEVYSTGNTKKEKSNSIDGTVKDETSPMEECFF

SEQ ID NO: 7104 - protein, 81 aa, Macaca mulatta
MHLTAWSQKLVTFEDVAVYFTQAEWDGLSPAQRTLYRDVMLENYGNVASLGFPLLKPAVISQLEGGGELGGPSPLAAGTGL

SEQ ID NO: 7105 - protein, 81 aa, Macaca mulatta
MNKSQGSVSFTDVTVDFTQEEWEQLDPSQRILYMDVMLENYSNLLSVEVWKADDQMERDHRNPDEQARQFLILKNQTPVEE

SEQ ID NO: 7106 - protein, 81 aa, Macaca mulatta
MDVMLENYSNLLSVEVWKADDQMERDHRNPDEQARQFLILKNQTPVEERGDLFGKALNLNTDFVSLRQVPYKYDLYEKTLK

SEQ ID NO: 7107 - protein, 81 aa, Macaca mulatta
EQTQAAGMVAGWLINCYQDSVTFDDVAVDFTQEEWTLLDPSQRDLYRDVMRENYENLASVGRDLFKPSVICWLEEEEELRA

SEQ ID NO: 7108 - protein, 81 aa, Macaca mulatta
MAAPDLAHGSHVSRDSVCLRGEQTQAAGMVAGWLINCYQDSVTFDDVAVDFTQEEWTLLDPSQRDLYRDVMRENYENLASV

SEQ ID NO: 7109 - protein, 81 aa, Macaca mulatta
MNTLQGPVSFKDVAVDFTQEEWQQLDPDEKITYRDVMLENYSHLVSVGYDITKPNVIIKLEQGEEPWIMEGEFPCQHSPAA

SEQ ID NO: 7110 - protein, 81 aa, Macaca mulatta
MLENYSNLVSVGYHIIKPDVISKLEQGEEPWIVEGEFLLQSYPDEVWQADDLIERIQEGENKPSRQTVFTETLIEEREYIS

SEQ ID NO: 7111 - protein, 81 aa, Macaca mulatta
EEEEEEEDEDDLLMAGSQGLVTFEDVAVYFSLEEWERLEADQRGLYQEVMQENYGILVSLGYPIPKPDLIFRLEQGEEPWV

SEQ ID NO: 7112 - protein, 81 aa, Macaca mulatta
MFPPARGKELLSFEDVAMYFTREEWGHLDWGQKDLYRDVMLENYRNMVLLGFQFPKPEVICQLENWDEQWILDLPRAGSRK

SEQ ID NO: 7113 - protein, 81 aa, Macaca mulatta
MELLSFEDVAMYFTREEWGHLDWGQKDLYRDVMLENYRNMVLLGFQFPKPEVICQLENWDEQWILDLPRAGSRKASGSACP

SEQ ID NO: 7114 - protein, 81 aa, Macaca mulatta
MFPPARGKELLSFEDVAMYFTREEWGHLDWGQKDLYRDVMLENYRNMVLLGSEARHRMKKLTPKQKFSEDLESYKISVVMQ

SEQ ID NO: 7115 - protein, 81 aa, Macaca mulatta
GEEAVAVVRALQRALDGTSPQGMATFEDMAVSLTWEEWERLDPARRDFCRESAQKDSGSTVPPSLESRAENKELIPMQEIL

SEQ ID NO: 7116 - protein, 81 aa, Macaca mulatta
SQELTASLLSTGSQKLVKIEEVADVAVSFILEEWGHLDQSQKSLYRDDRKENYGSITSMGYESRDNMELIVKQISDDAESH

SEQ ID NO: 7117 - protein, 81 aa, Macaca mulatta
LAGHLRLHSREKAHQCRECGEIFFQYVSLIEHQVLHMGQKNEKHGVCEEAYSWNLTVIEDKKIELQEQPYQCDICGKAFGY

SEQ ID NO: 7118 - protein, 81 aa, Macaca mulatta
DSQELTASLLSTGSQLVKIEEVADVAVSFILEEWGHLDQSQKSLYRDDRKENYGSITSMGYESRDNMELIVKQISDDAESH

SEQ ID NO: 7119 - protein, 81 aa, Macaca mulatta
CEGSPGDQAAALLTARYQEFVTFEDVAVHLTREEWGYLDPVQRDLYREVMLENYGNVVSLGILLRLPTTRIHSVNSCPALS

SEQ ID NO: 7120 - protein, 81 aa, Macaca mulatta
LAGAPPVPQVPALPCEGSPGDQAAALLTARYQEFVTFEDVAVHLTREEWGYLDPVQRDLYREVMLENYGNVVSLGIVGSWD

SEQ ID NO: 7121 - protein, 81 aa, Macaca mulatta
QVPALPCEGSPGDQAAALLTARYQSSQDVLFQEFVTFEDVAVHLTREEWGYLDPVQRDLYREVMLENYGNVVSLGIVGSWD

SEQ ID NO: 7122 - protein, 81 aa, Macaca mulatta
GPGLPTMNSRDQEMAAGFFTAGPQGLGPFKDMALAFPEEEWRHVTPAQIDCFGEYVEPQHCRVCPGGGSKEKEAKPPQEDL

SEQ ID NO: 7123 - protein, 81 aa, Macaca mulatta
GSPRDQGMASALFTADSQAMVKIEDMAVSLILEEWGCQNLARRNLSRDHRQENYGSTFPQGGENRNENEESTSKAETTEDL

SEQ ID NO: 7124 - protein, 81 aa, Macaca mulatta
DSLGDEMLAAALLKAKSQELVTFEDVAVYFIRKEWKRLEPAQRDLYRDVMLENYGNVFSLDWIHISLTMQKVMLAWFTGTL

SEQ ID NO: 7125 - protein, 81 aa, Macaca mulatta
VTFEDVAVYFIRKEWKRLEPAQRDLYRDVMLENYGNVFSLDWIHISLTMQKVMLAWFTGTLSVGKGLCSSELASVEPPDTF

SEQ ID NO: 7126 - protein, 81 aa, Macaca mulatta
MGPLTFRDVKIEFSLEEWQCLDTAQRNLYRDVMLENYRNLVFLGIAVSKPDLITWLEQGKEPWNMKRREMVDKTPVMCSHF

SEQ ID NO: 7127 - protein, 81 aa, Macaca mulatta
MLRIILGIISFTPGPLTFMDVAIEFSLEEWECLDSAQQSLYRHVMLENYRNLVFLGIAICKPDLISCLEQEKEPWDMKRPE

SEQ ID NO: 7128 - protein, 81 aa, Macaca mulatta
MGPLTFSDVAIEFSLEEWQCLDTSQQNLYRNVMLDNYRNLVFLGIAVSKPDLIICLEQGKEPCNMKRHAMVAKPPVVCSHF

SEQ ID NO: 7129 - protein, 81 aa, Macaca mulatta
GIGRSTAKTPGLPGSLEMGPLTFSDVAIEFSLEEWQCLDTSQQNLYRNVMLDNYRNLVFLGIAVSKPDLIICLEQGKEPCN

SEQ ID NO: 7130 - protein, 81 aa, Macaca mulatta
MEPLTFKDVAIEFSLEEWQCLDTAQRDLYRNVLLENYRNLVFLGIAVSKPYLITCLEQKKEPWNIKRHEMVARPPVMSFHF

SEQ ID NO: 7131 - protein, 81 aa, Macaca mulatta
MGPLTFRDVAIEFSLEEWQCLDTAQRNLYRKVMFENYRNLVFLGIAVSKPHLITCLEQGKEPWNRKRQEMVAKPPVIYSHF

SEQ ID NO: 7132 - protein, 81 aa, Macaca mulatta
MGVLTFRDVAIEFSPEEWECLDSAQQCLYRDVMLENYRNLVSLGLAIFKPDLMTCLEQRKEPWKVKRQEAVVKHPAGSFHF

SEQ ID NO: 7133 - protein, 81 aa, Macaca mulatta
MLENYRNLVSLGIAVSKPDLIACLEQNKEPRNIKRNEMVSKHPVTCSHFTQDLQPELGIKDSLQKVIPRIYGKCEHENLQV

SEQ ID NO: 7134 - protein, 81 aa, Macaca mulatta
MEEKEMNDGSQMVRSQESLTFQDVAVDFTKEEWDQLYPAQKNLYRDVMLENYRNLVALGYQLYKPEVIAQLELEEEWVIER

SEQ ID NO: 7135 - protein, 81 aa, Macaca mulatta
GNMEEKEMNDGSQMVRSQESLTFQDVAVDFTKEEWDQLYPAQKNLYRDVMLENYRNLVALGYQLYKPEVIAQLELEEEWVI

SEQ ID NO: 7136 - protein, 81 aa, Macaca mulatta
MAEPPRLPLTFEDVAIYFSEQEWQDLEAWQKELYKHVMRSNYETLVSLDDGLPKPELISWIEHGGEPFRNWRESQKSGNII

SEQ ID NO: 7137 - protein, 81 aa, Macaca mulatta
MAEPASVTVTFDDVALYFSEQEWEILEKWQKQMYKQEMKTNYQTLDSLGYAFSKPDLITWMEQGRMLFISEQGCLDKTRRT

SEQ ID NO: 7138 - protein, 81 aa, Macaca mulatta
QEMKTNYQTLDSLGYAFSKPDLITWMEQGRMLFISEQGCLDKTRRTTSPPTDEQLDMKDTGKLPCFDHEGTLRTKEEDCRL

SEQ ID NO: 7139 - protein, 81 aa, Macaca mulatta
ADGGCRCRNSGPCCSWSGVTVTFDDVALYFSEQEWEILEKWQKQMYKQEMKTNYQTLDSLGYAFSKPDLITWMEQGRMLFI

SEQ ID NO: 7140 - protein, 81 aa, Macaca mulatta
SLGYAFSKPDLITWMEQGRMLFISEQGCLDKTRRTTSPPTDEQLDMKDTGKLPCFDHEGTLRTKEEDCRLNGPQKQDLGAA

SEQ ID NO: 7141 - protein, 81 aa, Macaca mulatta
RNFWVLRLPPGSKGEAPKVPVTFVDIAVYFSEDEWKNLDEWQKELYNNLVKENYKTLMSLDAEGPVPKPDAPTQPEPREEP

SEQ ID NO: 7142 - protein, 81 aa, Macaca mulatta
ALCVRGQRGLEERAIPTESITDSPISAQDLLSRIKQEEHQCVWDQQDLADRDIPTDPNSESLISAHDILSWIKQEEQPYPW

SEQ ID NO: 7143 - protein, 81 aa, Macaca mulatta
PGGAHPAGGVMIKQELQYTQEGPADLPGEFSCIAEEQAFLSPEQTELWGGQGSSVLLETGPGDSTLQEPVGSRDPSSSRTV

SEQ ID NO: 7144 - protein, 81 aa, Macaca mulatta
NFWILRLPPGSKGEAPKVSRSLENDGVCFTEQEWENLEDWQKELYRNVMESNYETLVSLSSSDSPASASQVAEITEVLGQT

SEQ ID NO: 7145 - protein, 81 aa, Macaca mulatta
LEEEGPGGAHPAGGVMIKQELQYTQEGPADLPGEFSCIAEEQAFLSPEQTELWGGQGSSVLLETGPGDSTLQEPVGSRDPS

SEQ ID NO: 7146 - protein, 81 aa, Macaca mulatta
KKLADCEKTAVEFGNQLEGKWAVLGTLLQEYGLLQRRLENVENLLRNRNFWILRLPPGSKGESPKVPVTFDDVAVYFSELE

SEQ ID NO: 7147 - protein, 81 aa, Macaca mulatta
RNFWILRLPPGSKGESPKVPVTFDDVAVYFSELEWGKLEDWQKELYKHVMRGNYETLVSLDYAISKPDILTRIERGEEPCL

SEQ ID NO: 7148 - protein, 81 aa, Macaca mulatta
RNFWILRLPPGSKGESPKVPVTFDDVAVYFSEQEWGKLEDWQKELYKHVMRGNYETLVSLDYAISKPEVLSQIEQGKEPCH

SEQ ID NO: 7149 - protein, 81 aa, Macaca mulatta
LENVENLLRNRNFWILRLPPGSKGESPKEWGKLEDWQKELYKHVMRGNYETLVSLDYAISKPEVLSQIEQGKEPCHWRRPG

SEQ ID NO: 7150 - protein, 81 aa, Macaca mulatta
MARQVSITFKDLAVRFSEEEWRLLEEGQREFYRDVMRENYETLVSVGTAELLPLSAFLSPSESGGAVVGGSHADEGQEPAG

SEQ ID NO: 7151 - protein, 81 aa, Macaca mulatta
MRENYETLVSVGTAELLPLSAFLSPSESGGAVVGGSHADEGQEPAGGGGPQWGQPRHSLHLTALVQLVKEIPEFLFGEVKG

SEQ ID NO: 7152 - protein, 81 aa, Macaca mulatta
MEPRESGKAPVTFDDITVYLLQEEWVLLSQQQKELCGSDKLVAPLGPTVANPELFCKFGPGPEPWLGSVQGQRSHLEHHPG

SEQ ID NO: 7153 - protein, 81 aa, Macaca mulatta
QDPSAEGLSEEVPVVFEELPVVFEDVAVYFTRKEWGMLDKRQKELYRDVMRMNYELLASLGPAAAKPDLISKLERRAAPWI

SEQ ID NO: 7154 - protein, 81 aa, Macaca mulatta
EQLKPIEPRDCWREAWVKKKPVTFEDVAVNFTQEEWDCLDASQRVLYQDVMSEIFKNLASVARIFLHKPELITKLEQEEEQ

SEQ ID NO: 7155 - protein, 81 aa, Macaca mulatta
MAAGEPRSLLFFQKPVTFEDVAVNFTQEEWDCLDASQRVLYQDVMSEIFKNLASVARIFLHKPELITKLEQEEEQWRETQV

SEQ ID NO: 7156 - protein, 81 aa, Macaca mulatta
ATLQEAMKRDCWREAWVKKKPVTFEDVAVNFTQEEWDCLDASQRVLYQDVMSEIFKNLASVARIFLHKPELITKLEQEEEQ

SEQ ID NO: 7157 - protein, 81 aa, Macaca mulatta
GSQGNLLQADITLMSQAQESVTFEDVAVNFTNREWQSLTYAQRHLYKHVMLENYGNMLSLGFPFPKPPLISHLERGVEPCV

SEQ ID NO: 7158 - protein, 81 aa, Macaca mulatta
GGCCREDTVVASRLTPESQGLLKVEDVALTVTPEWTQQDSSQGNLCRDEKQENHGSLVSLGGEKQTKGRDLPPAEKLQEKE

SEQ ID NO: 7159 - protein, 81 aa, Macaca mulatta
GGCCREDTVVASRLTPESQGLLKVEDVALTVTPEWTQQDSSQGNLCRDEKQENHGSLVSLEMGFHHVDQAGFELLTSSDLP

SEQ ID NO: 7160 - protein, 81 aa, Macaca mulatta
GGCCREDAMVASRLTPGSQGLLKMEDVALTLSPGWTQLDSSQVNIYRDEKQENHSSLVSLGGEKQTESRDLPPVKKLSKKE

SEQ ID NO: 7161 - protein, 81 aa, Macaca mulatta
MNLWDPSPYKTEGLLKMEDVALTLSPGWTQLDSSQVNIYRDEKQENHSSLVSLGGEKQTESRDLPPVKKLSKKEHGKICHL

SEQ ID NO: 7162 - protein, 81 aa, Macaca mulatta
GSSGDQEMTATLLTAGFQTLEKIEDMAVSLIREEWLLDPSQKDLSRDNRPENFRNVFSLGGETRNENRELASKQVISTGIQ

SEQ ID NO: 7163 - protein, 81 aa, Macaca mulatta
DSTLHQGGHNLLSSASFQESVTFKDVIVDFTQEEWKQLDPGQRDLFRDVTLENYTHLVSIGLQDSKPDVISQLEQGTEPWI

SEQ ID NO: 7164 - protein, 81 aa, Macaca mulatta
MELLTFRDVAIEFSPEEWKCLDPAQQNLYKDVMLENYRNLVSLAMCSPFSQDLSPVQGIEDSFQKLVLRKYEKCGYENLQL

SEQ ID NO: 7165 - protein, 81 aa, Macaca mulatta
MELLTFRDVAIEFSPEEWKCLDPAQQNLYKDVMLENYRNLVSLGFVISNPDLVTCLEQIKEPYNLKIHETAAKPPAMCSPF

SEQ ID NO: 7166 - protein, 81 aa, Macaca mulatta
MEHLTFRDVAIEFSPEEWKCLDPAQQNLYRDVMLENYRNLVSLGVAISNPDLVTFLEQRKEPYNVKIHETVAKHPGNWKHQ

SEQ ID NO: 7167 - protein, 81 aa, Macaca mulatta
MELLTFRDVAIEFSPEEWKCLDPAQQNLYRDVMLENYRNLVSLGVAISNPDLVTCLEQRKEPYNVKIRKIVARPPAVRSHF

SEQ ID NO: 7168 - protein, 81 aa, Macaca mulatta
MEPLTFRDVAIEFSPEEWKCLDPAQQNLYRDVMLENYRNLVSLAVCSYFTQDFLPVQGIEDSFHKCILRRYEKCGHENLQL

SEQ ID NO: 7169 - protein, 81 aa, Macaca mulatta
SQEESPEEDTERTERKPTVKDAFKDISIYFTKEEWAEMGDWEKTRYRNVKRNYNALITIGLRATRPAFMCHRRQAIKLQVD

SEQ ID NO: 7170 - protein, 81 aa, Macaca mulatta
YNALITIGLRATRPAFMCHRRQAIKLQVDDTEDSDEEWTPRQQELRRKETEGKMYSLRERKGHAYKEVSEPQDDDYLYCEM

SEQ ID NO: 7171 - protein, 81 aa, Macaca mulatta
PAGALFGNPAPPPPRVSVDSVAFEDVAVNFTHEKWVLPNSSQKILYREVMQETCRNLASVGNKWKDQNIENHFEKPGKDIR

SEQ ID NO: 7172 - protein, 81 aa, Macaca mulatta
MMKSQGLVSFKDVAVDFTQEEWQQLDPAQRTLYRDVMLENYSHLVSMGYPVSKPDVISKLEQGEEPWIIKRDISNWIYPDE

SEQ ID NO: 7173 - protein, 81 aa, Macaca mulatta
MLENYSHLVSMGYPVSKPDVISKLEQGEEPWIIKRDISNWIYPDEYQADGRQDRKSNLHNSQSCILGTVSFHHKILKGVTK

SEQ ID NO: 7174 - protein, 81 aa, Macaca mulatta
ADPSSSGLLEKQKMMKSQGLVSFKDVAVDFTQEEWQQLDPAQRTLYRDVMLENYSHLVSMGYPVSKPDVISKLEQGEEPWI

SEQ ID NO: 7175 - protein, 81 aa, Macaca mulatta
MAAGRREARPQVSLTFEDVAVLFTRDEWRKLVPSQRNLYRDVMLENYRNLVALGLPFTKPKVISLLQQGEDPWKVEKDSSG

SEQ ID NO: 7176 - protein, 81 aa, Macaca mulatta
MAAGRREARPQVSLTFEDVAVLFTRDEWRKLVPSQRNLYRDVMLENYRNLVSLGLPFTKPKVISLLQQGEDPWKVEKDSSG

SEQ ID NO: 7177 - protein, 81 aa, Macaca mulatta
MAVSHLPTMDQESVTFKDVAVLFTQEEWGQLSPAQRALYRDVMLENYSNLVSLGLLGPKPDMFSQLEKREVWMPEDTPGGF

SEQ ID NO: 7178 - protein, 81 aa, Macaca mulatta
MARRLLPAQVQESVTFRDVAVFFSQDEWLHLGSAQRALYREVMLENYSSLVSLGILFSKPKVISQLEQGEDPWMVESGVPQ

SEQ ID NO: 7179 - protein, 81 aa, Macaca mulatta
MAVDLLPAQESVTFRDVAVFFSQDEWLHLDSAQRALYREVMLENYSSLVSLGIPFSMPKLIHQLQQGEDPCLEEREVPSDT

SEQ ID NO: 7180 - protein, 81 aa, Macaca mulatta
QWGNELKNSMSSFRPGRGHNDGRRTVFYTNEEWELLDPTPKDLEESVVQEEKKKLTPEGNKGVTGSGFPFDFGRNPYKGKR

SEQ ID NO: 7181 - protein, 81 aa, Macaca mulatta
SGDPSSEGTSGSGSISIRKLGSEMQLQIQSQQEELERLKKDLCSQKELVRLLQQTVRSSQYDKYFTSSRLCEGVPKDTLEL

SEQ ID NO: 7182 - protein, 81 aa, Macaca mulatta
MPSLDSMTFEDIVVDFTREEWALLDTSQRKLFQDVMLENISHLVSIGKRLCKSVVLSHLQHVEKLSTQGMSLLQGREGDIK

SEQ ID NO: 7183 - protein, 81 aa, Macaca mulatta
DFTREEWALLDTSQRKLFQDVMLENISHLVSIGKRLCKSVVLSHLQHVEKLSTQGMSLLQGREGDIKHQEIPFIQHTYQKG

SEQ ID NO: 7184 - protein, 81 aa, Macaca mulatta
FTREEWALLDTSQRKLFQDVMLENISHLVSIGKRLCKSVVLSHLQHVEKLSTQGMSLLQGREGDIKHQEIPFIQHTYQKGT

SEQ ID NO: 7185 - protein, 81 aa, Macaca mulatta
MPSLDSMTFEDIVVDFTREEWALLDTSQRKLFQDVMLENISHLVSIGREGDIKHQEIPFIQHTYQKGTSTISTMRSHTQED

SEQ ID NO: 7186 - protein, 81 aa, Macaca mulatta
MQPQESLTFEDIAVDFTQEEGALLNTSQKKLYKDVMLEITSHLVSIGGESALESQMTSTHHVSRRGTTVIILMEISFLRGS

SEQ ID NO: 7187 - protein, 81 aa, Macaca mulatta
MQPQESLTFEDIAVDFTQEEGALLNTSQKKLYKDVMLEITSHLVSIGYPLHKLGVIFQPEQGKELWKERTFFQDLRTSGES

SEQ ID NO: 7188 - protein, 81 aa, Macaca mulatta
MQPQESLTFEDIAVDFTQEEGALLNTSQKKLYKDVMLEITSHLVSIGGESALESQMTSTHHVSRRGTTVIILMAKLPSFQL

SEQ ID NO: 7189 - protein, 81 aa, Macaca mulatta
KTLGEESLAACLWELPWKKKVTFEDVAIDFTQEEWAMMDTSKRKLYRDVILENVSHLVSLGYQISKSYITLQLEQGKELWR

SEQ ID NO: 7190 - protein, 81 aa, Macaca mulatta
MDMAQEPVTFRDVAIYFSREEWACLEPSQRALYRDVMLDNFSSMAALGFCSPRPDLVSRLEQWEEPWVEDRERPELQAVQR

SEQ ID NO: 7191 - protein, 81 aa, Macaca mulatta
MDMAQEPVTFRDVAIYFSREEWACLEPSQRALYRDVMLDNFSSMAALAPDQTSSLAWNSGRSRGLKIGRDLSSRQCRGATG

SEQ ID NO: 7192 - protein, 81 aa, Macaca mulatta
MSATVQLPGHQEMPLTFQDVAVYFSQAEGQQLGPQQRALYRDVMLENYGNVASLGFPVPKPELISQLEQGKELWVLNLLGA

SEQ ID NO: 7193 - protein, 81 aa, Macaca mulatta
VMLENYGNVASLGFPVPKPELISQLEQGKELWVLNLLGAEEPEILKSCQKETGFHHVAQASLKLLRSNDPCRPPRVLRLQA

SEQ ID NO: 7194 - protein, 81 aa, Macaca mulatta
AAHAHRMSATVQLPGHQEMPLTFQDVAVYFSQAEGQQLGPQQRALYRDVMLENYGNVASLGFPVPKPELISQLEQGKELWV

SEQ ID NO: 7195 - protein, 81 aa, Macaca mulatta
RKPSPAMAAWFLSAPPQAEVTFEDVAVFLSREEWGRLGPAQRGLYRDVMLETYGNLVSLGVGPAGPKPGVISQLERGDEPW

SEQ ID NO: 7196 - protein, 81 aa, Macaca mulatta
MAAWFLSAPPQAEVTFEDVAVFLSREEWGRLGPAQRGLYRDVMLETYGNLVSLGVGPAGPKPGVISQLERGDEPWVLDVQG

SEQ ID NO: 7197 - protein, 81 aa, Macaca mulatta
MAAWFLSAPPQAEVTFEDVAVFLSREEWGRLGPAQRGLYRDVMLETYGNLVSLALGTRTEYKELTSRETFGKEELGQLRGI

SEQ ID NO: 7198 - protein, 81 aa, Macaca mulatta
LRKPSPAMAAWFLSAPPQAEVTFEDVAVFLSREEWGRLGPAQRGLYRDVMLETYGNLVSLALGTRTEYKELTSRETFGKEE

SEQ ID NO: 7199 - protein, 81 aa, Macaca mulatta
MTMALPMPGPQEAVVFEDVAVYFTRIEWSCLAPDQQALYRDVMLENYGNLASLGFLVAKPALISLLEQGEEPGALILQVAE

SEQ ID NO: 7200 - protein, 81 aa, Macaca mulatta
MTMALPMPGPQEAVVFEDVAVYFTRIEWSCLAPDQQALYRDVMLENYGNLASLALISLLEQGEEPGALILQVAEQSVAKAS

SEQ ID NO: 7201 - protein, 81 aa, Macaca mulatta
ENYGNLASLALISLLEQGEEPGALILQVAEQSVAKASLCTDSRMEAGIVESPLQRKLSRQAGLPGTVWGRLPGGHPAPPHP

SEQ ID NO: 7202 - protein, 81 aa, Macaca mulatta
MTMALPMPGPQEAVVFEDVAVYFTRIEWSCLAPDQQALYRDVMLENYGNLASLDSRSETFLRGNWRLPKEPLSAFCWAATA

SEQ ID NO: 7203 - protein, 81 aa, Macaca mulatta
MGFLGCWCMSFQEVVTFGDVAVHFSREEWQCLDPGQRALYREVMLENHSSVAGLAGFLVFKPELISRLEQGEEPWVLDLQG

SEQ ID NO: 7204 - protein, 81 aa, Macaca mulatta
MEVVTFGDVAVHFSREEWQCLDPGQRALYREVMLENHSSVAGLAFSDTLWVGYLCPYFPRDGNLWAWPSRGAAAFPGFLVF

SEQ ID NO: 7205 - protein, 81 aa, Macaca mulatta
AAARLLPVPAGPQPLSFAKLTFEDVAVLLSQDEWDRLCPAQRGLYRNVMMETYGNVVSLGLPGSKPDIISQLERGEDPWVL

SEQ ID NO: 7206 - protein, 81 aa, Macaca mulatta
MGSVSFRDVTVGFTQEEWQHLDPAQRTLYRDVMLENYSHLVSVGYCIPKPEVILKLEKGEEPWILEEKFPSQRHLELINTS

SEQ ID NO: 7207 - protein, 81 aa, Macaca mulatta
MLENYSHLVSVGYCIPKPEVILKLEKGEEPWILEEKFPSQRHLELINTSRNYSRMKFNEFNKGGKCLCDEKHEIIHSEEEP

SEQ ID NO: 7208 - protein, 81 aa, Macaca mulatta
MITSQGSVSFRDVTVGFTQEEWQHLDPAQRTLYRDVMLENYSHLVSVGYCIPKPEVILKLEKGEEPWILEEKFPSQRHLEL

SEQ ID NO: 7209 - protein, 81 aa, Macaca mulatta
HLDPSQRALYRDVMLENYSNLVSVGYCVHKPEVISRLEQGEEPWRLEEEFPSQSFPEVWTADHLKERSQENQSKHLWEVVF

SEQ ID NO: 7210 - protein, 81 aa, Macaca mulatta
MNKVEQKFQGSISFKDVTVGFTQEEWQHLDPSQRALYRDVMLENYSNLVSVGYCVHKPEVISRLEQGEEPWRLEEEFPSQS

SEQ ID NO: 7211 - protein, 81 aa, Macaca mulatta
TANATRESEVEQKFQGSISFKDVTVGFTQEEWQHLDPSQRALYRDVMLENYSNLVSVGYCVHKPEVISRLEQGEEPWRLEE

SEQ ID NO: 7212 - protein, 81 aa, Macaca mulatta
SYWMSSPMYSTDVEQKFQGSISFKDVTVGFTQEEWQHLDPSQRALYRDVMLENYSNLVSVGYCVHKPEVISRLEQGEEPWR

SEQ ID NO: 7213 - protein, 81 aa, Macaca mulatta
MNKFQGPVTLKDVIVEFTKEEWKLLTPAQRTLYKDVMLENYSHLVSVGYHVNKPNAVFKLKQGREPWILEVEYPHRGFPED

SEQ ID NO: 7214 - protein, 81 aa, Macaca mulatta
MKKSYGSLSFEDVTVGFTQEEWQHLDPAQRTLYRDVMIENYSHLVSVGYCIPKQEVIFKLEQGEQPWILEEELPGQRYPDE

SEQ ID NO: 7215 - protein, 81 aa, Macaca mulatta
MNKSQEQVSFKDVCVDFTQEEWYLLDPAQKILYRDVILENYSNLVSVGYCITKPEVVFKIEQGEEPWILEKGFPSQCHPER

SEQ ID NO: 7216 - protein, 81 aa, Macaca mulatta
MLENYSNLVSVGYCVYKPEVIFRLEQGEEPWRLEEEFPSQSFPEVWTADHLKERSQENLSKHLWEIVFINDEMLTKEQGNV

SEQ ID NO: 7217 - protein, 81 aa, Macaca mulatta
MNKVEQKFQGSVSFEDVTVGFSQEEWQHLDLSQRALYRDVMLENYSNLVSVGYCVYKPEVIFRLEQGEEPWRLEEEFPSQS

SEQ ID NO: 7218 - protein, 81 aa, Macaca mulatta
MTLKDVIVEFTKEEWKLLTFAQRTLYKDVMLENYGHLVSVGYHVNKPNAVFKLKQGKEPWILEVEFPHRVLPCELEEIISH

SEQ ID NO: 7219 - protein, 81 aa, Macaca mulatta
MQYVMLLLHKPSHLTQRELCSSCQRGVAASGPCPEDPVQRCDAGELQPPPLYRDVMLENYSLLLSVGYCITKPVVICKLEH

SEQ ID NO: 7220 - protein, 81 aa, Macaca mulatta
LCSSCQRGVAASGPCPEDPVQRCDAGELQPPPLYRDVMLENYSLLLSVGYCITKPVVICKLEHGEVLWILEEESPSQSHLD

SEQ ID NO: 7221 - protein, 81 aa, Macaca mulatta
VMLENYSLLLSVGYCITKPVVICKLEHGEVLWILEEESPSQSHLDCCIDDNLLEKRQENQDQHLQKVDFFSNKTLTMDRNG

SEQ ID NO: 7222 - protein, 81 aa, Macaca mulatta
MAPRAQIQGLLTFGDVAVAFTRIEWRHLDAAQRALYRDVMLENYGNLVSVGLLSSKPKLITQLEEGAEPWMEVREAPSGTR

SEQ ID NO: 7223 - protein, 81 aa, Macaca mulatta
RDVMLENYGNLVSVGLLSSKPKLITQLEEGAEPWMEVREAPSGTRAVQDYWFETKMSALKQSTSAGSVVGERRKSVMMEKG

SEQ ID NO: 7224 - protein, 81 aa, Macaca mulatta
MAPRAQIQGLLTFGDVAVAFTRIEWRHLDAAQRALYRDVMLENYGNLVSVVQDYWFETKMSALKQSTSAGSVVGERRKSVM

SEQ ID NO: 7225 - protein, 81 aa, Macaca mulatta
TLLNRMGVPRDRMPAVTLRKDSMAFEDVAVNFTQEEWALVDSSQKNLCREVMQETCRNLASVEIMWYRDCVKAKKVDSMDK

SEQ ID NO: 7226 - protein, 81 aa, Macaca mulatta
MHSLNKVTFEDVAIDFTQEEWAMMDTSKRKLSRDVMLENVSHLVSLGESLNIHIRYRISKSYITLQLEQGKELWREGREFL

SEQ ID NO: 7227 - protein, 81 aa, Macaca mulatta
MRLLTFRDVAIEFSVEEWQCLDTAQQDLYRNVMLENYRNLVSLGIAVSKPELITCLEERKEPWNVKRHETVAKHPAMYSQY

SEQ ID NO: 7228 - protein, 81 aa, Macaca mulatta
MAMSQESLTFKDVFVDFTLEEWQQLDSAQKNLYRDVMLENYSHLVSVGYLVAKPDVIFRLGPGEESWMADGGTPVRTCADV

SEQ ID NO: 7229 - protein, 81 aa, Macaca mulatta
MAMSQESLTFKDVFVDFTLEEWQQLDSAQKNLYRDVMLENYSHLVSVGYLVAKPDVIFRLGPGEESWMADGGTPVRTCAGK

SEQ ID NO: 7230 - protein, 81 aa, Macaca mulatta
SPQGFPALIPGEPGRSFEGSVSFEDVAVDFTRQEWHRLDPAQRTMHKDVMLETYSNLASVGLCVAKPEMIFKLERGEELWI

SEQ ID NO: 7231 - protein, 81 aa, Macaca mulatta
SPPWYPVVAAEGRGSSCEASVSFEDVTVDFSREEWQHLDPAQRRLYWDVTLENYSHLLSVGYQVPKSEAAFKLEQGEGPWT

SEQ ID NO: 7232 - protein, 81 aa, Macaca mulatta
RSWLQRDVAAHVRIVSLQASVSFEDVTVDFSREEWQHLDPAQRRLYWDVTLENYSHLLSVGYQVPKSEAAFKLEQGEGPWT

SEQ ID NO: 7233 - protein, 81 aa, Macaca mulatta
AGEAPHQSCSGEAIEKMQQQGIPGEIFFHCERFDQPIGEDSLCSILEALWQDNDQLERCQENQNNLLSHVKVLIKERGYER

SEQ ID NO: 7234 - protein, 81 aa, Macaca mulatta
MAKPQGLVTFEDVAVDFTQEEWQYLNPPQRTLYRDVMLETYSNLVFVGQQVTKPNLILKLEVEEYPAEGKIPFWNFPEVCQ

SEQ ID NO: 7235 - protein, 81 aa, Macaca mulatta
SGEASGSFYSWQKAKREQGLVTFEDVAVDFTQEEWQYLNPPQRTLYRDVMLETYSNLVFVGQQVTKPNLILKLEVEEYPAE

SEQ ID NO: 7236 - protein, 81 aa, Macaca mulatta
MAKPQGLVTFEDVAVDFTQEEWQYLNPPQRTLYRDVMLETYSNLVFVGQQVTKPNLILKLEVEEYPAEGKIPFWNFPETES

SEQ ID NO: 7237 - protein, 81 aa, Macaca mulatta
MIESQEPVTFEDVAVDFTKEEWQQLNPAQKTLHRDVMLETYSHLVSVGCSGIKPDVIFKLEHGKDPWIIESELSRWIYSGI

SEQ ID NO: 7238 - protein, 81 aa, Macaca mulatta
MIESQEPVTFEDVAVDFTKEEWQQLNPAQKTLHRDVMLETYSHLVSVGCSGIKPDVIFKLEHGKDPWIIESELSRWIYSDR

SEQ ID NO: 7239 - protein, 80 aa, Macaca mulatta
MIESQEPVTFEDVAVDFTKEEWQQLNPAQKTLHRDVMLETYSHLVSVGCSGIKPDVIFKLEHGKDPWIIESELSRWIYSE

SEQ ID NO: 7240 - protein, 81 aa, Macaca mulatta
MIESQEEWQQLNPAQKTLHRDVMLETYSHLVSVGCSGIKPDVIFKLEHGKDPWIIESELSRWIYSDRVKGLESSQQIISGE

SEQ ID NO: 7241 - protein, 81 aa, Macaca mulatta
NRDNAFAKRPRDDAKTSEKRSKAFDDIAKYFSKKEWEKMKYSEKISCVHMKRKYEAMTKLGFNVTLPPFMRNKQATDFQGN

SEQ ID NO: 7242 - protein, 81 aa, Macaca mulatta
SDDAFARRPNVGAQIPEKIQKAFDDIAKCFSKKEWEKMKYSQKIIYVYMKRKYEAMTKLGFRVTLPPFMHNKRATDFQRND

SEQ ID NO: 7243 - protein, 81 aa, Macaca mulatta
APGAMNGDDAFARRPRVGAQIPEKIQKAFDDIAKYFPKKEWEKMKTSEKIIYVYKKRKYEAMNKLGFKATLPPFMRNKWAT

SEQ ID NO: 7244 - protein, 81 aa, Macaca mulatta
MNGDDAFARRPRVGAQIPEKIQKAFDDIAKYFPKKEWEKMKTSEKIIYVYKKRKYEAMNKLGFKATLPPFMRNKWATDFQG

SEQ ID NO: 7245 - protein, 81 aa, Macaca mulatta
GDNTFARRPRDDAQISEKIQKAFDDIAQYFSKKEWEKMKASEKIIYVYMKINYEVMTKLGFKVTLPPFMCSKRAADFHRND

SEQ ID NO: 7246 - protein, 81 aa, Macaca mulatta
MNGDDAFARRPRVGAQIPEKIQKAFDDIAKYFSKKEWERMKVSEKIVYVYKKRKYEAMSKLGFKVTLPPFMRNKRATDFQG

SEQ ID NO: 7247 - protein, 81 aa, Macaca mulatta
KRTKDKMASKLILPESPSLLTFEDVAVYFSEEEWQLLDPPEKTLYNDVMQDIYETVISLGLKLKNDIGNDHPISVSTSEIQ

SEQ ID NO: 7248 - protein, 81 aa, Macaca mulatta
ALVLVEFLQREPDGTKNESLLTFEDVAVYFSEEEWQLLDPPEKTLYNDVMQDIYETVISLGLKLKNDIGNDHPISVSTSEI

SEQ ID NO: 7249 - protein, 81 aa, Macaca mulatta
KNSWAGTLTKKPSLYMKESLLTFEDVAVYFSEEEWQLLDPPEKTLYNDVMQDIYETVISLGLKLKNDIGNDHPISVSTSEI

SEQ ID NO: 7250 - protein, 81 aa, Macaca mulatta
QLLCALGMAAILLTTRPKVPVSFEDVSVYFTKTEWKLLDLRQKVLYKRVMLENYSHLVSLGFSFSKPHLISQLERGEGPWV

SEQ ID NO: 7251 - protein, 81 aa, Callithrix jacchus
MAKRPGPPGSPEMGLLTFRDVAVEFSLEEWQCLNHAQQNLYRDVMFENYRNLVTLGIAVSKPELITCLEGNKESWNIKRNE

SEQ ID NO: 7252 - protein, 81 aa, Callithrix jacchus
MGLLTFRDVAVEFSLEEWQCLNHAQQNLYRDVMFENYRNLVTLGIAVSKPELITCLEGNKESWNIKRNEMVAKHPVTYSYL

SEQ ID NO: 7253 - protein, 81 aa, Callithrix jacchus
GLLTFRDVAVEFSLEEWQCLNHAQQNLYRDVMFENYRNLVTLGIAVSKPELITCLEGNKESWNIKRNEMVAKHPVTYSYLT

SEQ ID NO: 7254 - protein, 81 aa, Callithrix jacchus
MTKSLESVSFKDVTVDFSRDEWQRLNIAQKSLYRDVMLENYFNLISVGCQVPKPEVIFNLEQEEPCMLNGGISSQSCPDGK

SEQ ID NO: 7255 - protein, 81 aa, Callithrix jacchus
MSVVSHPESVSFKDVTVDFSRDEWQRLNIAQKSLYRDVMLENYFNLISVGCQVPKPEVIFNLEQEEPCMLNGGISSQSCPD

SEQ ID NO: 7256 - protein, 81 aa, Callithrix jacchus
PLRFSTLFEEQQKMNISQESVSFKDVTIEFTQEEWQQMAPVQRNLYRDVMLENYSHLVSVGYCLFKPEVIFKLEQGAEPWF

SEQ ID NO: 7257 - protein, 81 aa, Callithrix jacchus
NLYRDVMLENYSHLVSVGYCLFKPEVIFKLEQGAEPWFSEEEFSNKSHPKDYRGDDLIKQNTNIKDKHLQQVENWHRGETS

SEQ ID NO: 7258 - protein, 81 aa, Callithrix jacchus
QMAPVQRNLYRDVMLENYSHLVSVGYCLFKPEVIFKLEQGAEPWFSEEEFSNKSHPSELLSSSKQSSAGVVRLQVTLEVNT

SEQ ID NO: 7259 - protein, 81 aa, Callithrix jacchus
EFTQEEWQQMAPVQRNLYRDVMLENYSHLVSVGYCLFKPEVIFKLEQGAEPWFSEEEFSNKSHPSELLSSSKQSSAGVVRL

SEQ ID NO: 7260 - protein, 81 aa, Callithrix jacchus
MNTFQASVSFKDVTVEFTQEEWQHMGPVERTLYRDVMLENYSHLVSVGYCFTKPELIFTLEQGEDPWLLEKEKGFLSRTSP

SEQ ID NO: 7261 - protein, 81 aa, Callithrix jacchus
MNVSQASVSFQDVAVEFTQEEWQHLGLVEWTLYRDVMLENYSHLVSVGYCITKPKVISQLEQGEEPWSLEDEFLNQKYPGH

SEQ ID NO: 7262 - protein, 81 aa, Callithrix jacchus
MLENYSHLVSVGYCITKPKVISQLEQGEEPWSLEDEFLNQKYPGHFKVDDHIKGIWEKQEKPLWKEIFIDDADETWSKEGQ

SEQ ID NO: 7263 - protein, 81 aa, Callithrix jacchus
MASPSPPPEPKEEWDYLDPAQRSLYKDVMMENYGNLVSLDVLNRDKDEEPTVKQEIEEIEEEVEPQGVIVTRIKSEIDQDP

SEQ ID NO: 7264 - protein, 81 aa, Callithrix jacchus
MASPSPPPEPKGLLTFEDVAVFFTQEEWDYLDPAQRSLYKDVMMENYGNLVSLDVLNRDKDEEPTVKQEIEEIEEEVEPQG

SEQ ID NO: 7265 - protein, 81 aa, Callithrix jacchus
MASPSPPPEPKEWDYLDPAQRSLYKDVMMENYGNLVSLDVLNRDKDEEPTVKQEIEEIEEEVEPQGVIVTRIKSEIDQDPM

SEQ ID NO: 7266 - protein, 81 aa, Callithrix jacchus
ENSKENKVVAICPNTESCESITLNDVAVNFSRGEWKKLEPFQKELYKEVLLENFRNLEFLDFPVSKLELISQLKWVELSWL

SEQ ID NO: 7267 - protein, 81 aa, Callithrix jacchus
ETRRPLEMAVSKPEASAAGSVTFKDVTMAFTQKEWEQLDPAQRNLYKDVMLENYSNLASMGCQAPKPDMISKLEKGEAPCL

SEQ ID NO: 7268 - protein, 81 aa, Callithrix jacchus
RRRSAGTTKETRRPLEMAVSKPEASAAKEWEQLDPAQRNLYKDVMLENYSNLASMGCQAPKPDMISKLEKGEAPCLGKGKR

SEQ ID NO: 7269 - protein, 81 aa, Callithrix jacchus
MAAGLLTAGPRGSTSFSSVTVAFAQEGWRYLVSTSRDRFKDRIPEKSRNLVLLGLPVSQPGMNSQLELREGAWMLESEDLR

SEQ ID NO: 7270 - protein, 81 aa, Callithrix jacchus
ENTGEEGMAAGLLTAGPRGSTSFSSVTVAFAQEGWRYLVSTSRDRFKDRIPEKSRNLVLLGLPVSQPGMNSQLELREGAWM

SEQ ID NO: 7271 - protein, 81 aa, Callithrix jacchus
KENPEDISGWGLPETRSKESVSFRDVAVDFTQEEWGQLDSPQRALYRDVMLENYQNLLALGPPLHKPDVISHLERGEEPWC

SEQ ID NO: 7272 - protein, 81 aa, Callithrix jacchus
KENPEDISGWGLPETRSKESVSFRDVAVDFTQEEWGQLDSPQRALYRDVMLENYQNLLALEWEMKEVPSQQQGMCKEEPAQ

SEQ ID NO: 7273 - protein, 81 aa, Callithrix jacchus
KENPEDISGWGLPETRSKESVSFRDVAVDFTQEEWGQLDSPQRALYRDVMLENYQNLLALGAGPPLHKPDVISHLERGEEP

SEQ ID NO: 7274 - protein, 81 aa, Callithrix jacchus
LKQWGNELKNSMSSFRPGRGHNDSRRTVFYTNEEWELLDPTPKDLEESIVQEEKKKPTPEGNKGVTGSGFPFDFGRNPYKG

SEQ ID NO: 7275 - protein, 81 aa, Callithrix jacchus
GDPSSEGTPGSGSVSISIRKPASEMQLQVQSQQEELERLKKDLSSQKELVRLLQQTVRSSQYDKYFTSSRLCEGVPKDTLE

SEQ ID NO: 7276 - protein, 81 aa, Callithrix jacchus
ERSSGDSEMVALLTALSQGLVTFKDVAVCFSQDQWSDLDPTQKEFYGEYVLEEDCGIVVSLDRSKDEEECVEQEDLSLEDI

SEQ ID NO: 7277 - protein, 81 aa, Callithrix jacchus
QKASIKDKMKADSLTGKPQEPVTFKDVVVEFSKEEWGQLDSAVKNLYRDVMLENFRNLNSLRKAHLLSKPVESLELKNKKK

SEQ ID NO: 7278 - protein, 81 aa, Callithrix jacchus
MAVTFEDVTIIFTQEEWKFLDSSQKRLYREVMWENYTNVMSVGNWNESYKSQEEKFRYLEYENFSCCQGWWNAGTQIYEIQ

SEQ ID NO: 7279 - protein, 81 aa, Callithrix jacchus
RKNLSTEKEQKLIVQHSYIPMEEALPQYIGVICQKDLLKDSMEEKYSGCNKCKEIYYWNSQCVFHQRNQPGENLYQCSISK

SEQ ID NO: 7280 - protein, 81 aa, Callithrix jacchus
NVHCFPYSLIPESLIFGQMAVTFEDVTIIFTQEEWKFLDSSQKRLYREVMWENYTNVMSVGNWNESYKSQEEKFRYLEYEN

SEQ ID NO: 7281 - protein, 81 aa, Callithrix jacchus
EHKGGRNVHCFPYSLIPESLIFGQMAVTFEDVTIIFTQEEWKFLDSSQKRLYREVMWENYTNVMSETGMRATNPKKKNSDI

SEQ ID NO: 7282 - protein, 81 aa, Callithrix jacchus
KFQPSCLVTVGLWARLFEKVLTFRDVAIEFSLEEWKFLDAAQQNLYRDVMLENYRNLFSIGLTVSKPGLITCLEQRKAPWN

SEQ ID NO: 7283 - protein, 81 aa, Callithrix jacchus
MAGAQKVLTFRDVAIEFSLEEWKFLDAAQQNLYRDVMLENYRNLFSIGLTVSKPGLITCLEQRKAPWNLKRREAADGHPEL

SEQ ID NO: 7284 - protein, 81 aa, Callithrix jacchus
EGRTRDRQMAAALLTAWSQMPVTFEDVALYLSREEWGRLDHTQQSFYREVLQKRNGLSLGFPFSRPFWAPQVPGKGEASGS

SEQ ID NO: 7285 - protein, 81 aa, Callithrix jacchus
EGRTRDRQMAAALLTAWSQMPVTFEDVALYLSREEWGRLDHTQQSFYREVLQKRNGLSLGPIQGVQGVPTPPVAALEDVKP

SEQ ID NO: 7286 - protein, 81 aa, Callithrix jacchus
PHSHGAQLPALLREGQTREPMDTCFVSGVHEEWGTLDPAQRDLFWDIKRENSRNTTLGLGLKGQSERSRPEEVVPALPGQA

SEQ ID NO: 7287 - protein, 81 aa, Callithrix jacchus
LREGQTREPMDTCFVSGVHGPVASADIPFYFSQEEWGTLDPAQRDLFWDIKRENSRNTTLGLGLKGQSERSRPEEVVPALP

SEQ ID NO: 7288 - protein, 81 aa, Callithrix jacchus
MAEEWGTLDPAQRDLFWDIKRENSRNTTLGLGLKGQSERSRPEEVVPALPGQAALGPVVGARRGRPPTRRRQFRDLAAEKP

SEQ ID NO: 7289 - protein, 81 aa, Callithrix jacchus
PLLNLLPKGIQEKEEAVSLCLKANPEELVVFEDLNVFHCQEECVSLDPTQQLTSEKEDDSSVGEMMLLVNGSNPEGEDSEK

SEQ ID NO: 7290 - protein, 81 aa, Callithrix jacchus
SLFPPEGNMEDKMTGPQLPESLEDVAVYISQEEWGHQDPSKRALSRDTVQESYENVDSLESHIPSQEVPSTQVGQGGKLWD

SEQ ID NO: 7291 - protein, 81 aa, Callithrix jacchus
QTNTKDWTVAPEHVLPESQSLLTFEEVAMYFSQEEWELLDPTQKALYNDVMQENYETVISLALFVLPKPKVISCLEQGEEP

SEQ ID NO: 7292 - protein, 81 aa, Callithrix jacchus
MYFSQEEWELLDPTQKALYNDVMQENYETVISLALFVLPKPKVISCLEQGEEPWVQVSPEFKDSARGSSTGLKLKNDTENH

SEQ ID NO: 7293 - protein, 81 aa, Callithrix jacchus
MCDDRAASLCQQEWMHPGPAQRAVYRDATQRKNRHALLATGVPWGCEETRTLLAVLSSSQFYGKLQTCQQNSQIYRAIAER

SEQ ID NO: 7294 - protein, 81 aa, Callithrix jacchus
QNTGLHDQETGAVVWTAGFQGPAMCDDRAASLCQQEWMHPGPAQRAVYRDATQRKNRHALLATGVPWGCEETRTLLAVLSS

SEQ ID NO: 7295 - protein, 81 aa, Callithrix jacchus
MLVFLSEEGPAMCDDRAASLCQQEWMHPGPAQRAVYRDATQRKNRHALLGFEIKNEIENVKWDDLEEVEMNKALQRKSRGE

SEQ ID NO: 7296 - protein, 81 aa, Callithrix jacchus
QNTGLHDQETGAVVWTAGFQGPAMCDDRAASLCQQEWMHPGPAQRAVYRDATQRKNRHALLGFEIKNEIENVKWDDLEEVE

SEQ ID NO: 7297 - protein, 81 aa, Callithrix jacchus
NTGLHDQETGAVVWTAGFQGPAMCDDRAASLCQQEWMHPGPAQRAVYRDATQRKNRHALLATGVPWGCEETRTLLAVLSSS

SEQ ID NO: 7298 - protein, 81 aa, Callithrix jacchus
SQACLAPQAPRNLPQNTGLHDQETGAVVWTAGFQGPAMCDDRAASLCQQEWMHPGPAQRAVYRDATQRKNRHALLGTPGSL

SEQ ID NO: 7299 - protein, 81 aa, Callithrix jacchus
MASVLPTPEAQGPMLFEDLAVYFSQEECVTLHPAQRSLSRDATQECLEDAALMGEEGKPEINQQLSLESMELDELALEKYP

SEQ ID NO: 7300 - protein, 81 aa, Callithrix jacchus
WPERGPPAPQHQEMASASPLLSAWSQAPVNLEDVAVYLSGEELGCLDPAQQDAPLENEGPVIQLVDGGDGREDAPVRMEWY

SEQ ID NO: 7301 - protein, 81 aa, Callithrix jacchus
NILDQEVTTTRLPTGSQEPVKDVHVTRGFSYKKSVHQIPAHRGLYRDFRKENVGNVVSLGSTVSASNRITRLEQRKEPWTL

SEQ ID NO: 7302 - protein, 81 aa, Callithrix jacchus
EAGSLHSGHQEQLNRKREHRPLPKNARPSPWVPDLADEWNILDQEVTTTRLPTGSQEPVKDVHVTRGFSYKKSVHQIPAHR

SEQ ID NO: 7303 - protein, 81 aa, Callithrix jacchus
APLPSWDSNRAGPECRKPGAVSFGDVAVYFSREEWGCLRPAQRALYRDVMRETYSHLSALGVGGSMQALISWVKEAELWGP

SEQ ID NO: 7304 - protein, 81 aa, Callithrix jacchus
APLPSWDSNRAGPECRKPGAVSFGDVAVYFSREEWGCLRPAQRALYRDVMRETYSHLSALGESPTCSPGPCAPTSPAAPQG

SEQ ID NO: 7305 - protein, 81 aa, Callithrix jacchus
ATLYSQDPNGAGSEWREPGPVTFGDVAVYFSREEWGCLRPAQRALYRDVMRETYSHLGALGVEGSKPALISWVEEEAELWG

SEQ ID NO: 7306 - protein, 81 aa, Callithrix jacchus
APLLARRPGETRPGCRKPGAVSFADVAVYFSPEEWGCLRPAQRALYRDVMRETYGHLGALGFPGPKPALISWMEQESEAWS

SEQ ID NO: 7307 - protein, 81 aa, Callithrix jacchus
PAHVLWETRPPPRRDSRPGALSFADVAVYFSPEWGCLRPAQRALYRDVMRETCGHLGALGFSGPKSAFISWVEGEMEAWSP

SEQ ID NO: 7308 - protein, 81 aa, Callithrix jacchus
PVRGPGEARPSRKRGRRPRALKFVDVAVYFSSEEWGCLRPAQRALYRDVMRETYGHLGALGCAGPKPALISWLERNTDDWE

SEQ ID NO: 7309 - protein, 81 aa, Callithrix jacchus
MRLLTFRDVAIEFSLEEWEHLDSDQKNLYGDVMLENYRNLVCLGLAVSKPDLITFLEQRKEPWNVKSAETVAIQPDIFSHD

SEQ ID NO: 7310 - protein, 81 aa, Callithrix jacchus
MLENYRNLVCLGLAVSKPDLITFLEQRKEPWNVKSAETVAIQPDIFSHDTQALLRKKQIEASFQKVILDGYGSCGLQNLHL

SEQ ID NO: 7311 - protein, 81 aa, Callithrix jacchus
HCAVTEHLTGAPAVPSVERLLTFRDVAIEFSLEEWEHLDSDQKNLYGDVMLENYRNLVCLGLAVSKPDLITFLEQRKEPWN

SEQ ID NO: 7312 - protein, 81 aa, Callithrix jacchus
MGLLTFRDVAIEFSLEEWEHLDSNQKNLYRDVMLENYRNLVCLGFAVSKPDLITFLEQRKEPCNVKSIETVAIQPDVFSHD

SEQ ID NO: 7313 - protein, 81 aa, Callithrix jacchus
KEPCNVKSIETVAIQPDVFSHDTQAFLRKKHIEASFQKVMLDGYESCGLQNLHLRKECESDENNQYNKSDTTVGQGISPRR

SEQ ID NO: 7314 - protein, 81 aa, Callithrix jacchus
MGLVTFRDVAIEFSLEEWKHLEPAQKNLYWDVMLENYRNLVSLGLTISKPDLITFLEQRKEPWNVKSAETVATQPDIFLHH

SEQ ID NO: 7315 - protein, 81 aa, Callithrix jacchus
MLENYRNLVSLGLTISKPDLITFLEQRKEPWNVKSAETVATQPDIFLHHNKDLLTEHCTEASFQKVILRRHESCDLENLHI

SEQ ID NO: 7316 - protein, 81 aa, Callithrix jacchus
MNKFQEQVSFKDVCVDFTEEEWYLLDPAQKMLYRDVILENYSNLVSVGYCITKPEVIFKIEQGEEPWILEKGFPSQCHPER

SEQ ID NO: 7317 - protein, 81 aa, Callithrix jacchus
MGFTQEEWQHLDPAQRTLYKDVMLENYSPVVSVGYYIPKPGVIVKLEQGEHPWILEEELPGHKYPRQVSPCWLVWSRTPDL

SEQ ID NO: 7318 - protein, 81 aa, Callithrix jacchus
MNKFQVPVTLKDVIVEFTKEEWKLLTPAQRTLYKDVMLENYSHLVSVGYRVNKPNVVFKLKQGKEPWMLEVEFPHRGLPED

SEQ ID NO: 7319 - protein, 81 aa, Callithrix jacchus
MNKVEQKFQGSISFKDVTVGFTQEEWHHLDPSQRALYRDVMLENYSNLVSVGYCVHKPEVIFRLEQGEEPWRLEEEFPSQS

SEQ ID NO: 7320 - protein, 81 aa, Callithrix jacchus
VGYLLCAPQIFQVEQKFQGSISFKDVTVGFTQEEWHHLDPSQRALYRDVMLENYSNLVSVGYCVHKPEVIFRLEQGEEPWR

SEQ ID NO: 7321 - protein, 81 aa, Callithrix jacchus
RANATRGSGVEQKFQGSISFKDVTVGFTQEEWHHLDPSQRALYRDVMLENYSNLVSVGYCVHKPEVIFRLEQGEEPWRLEE

SEQ ID NO: 7322 - protein, 81 aa, Callithrix jacchus
MSAVEQKFQGSISFKDVTVGFTQEEWHHLDPSQRALYRDVMLENYSNLVSVGYCVHKPEVIFRLEQGEEPWRLEEEFPSQS

SEQ ID NO: 7323 - protein, 81 aa, Callithrix jacchus
HLDPSQRALYRDVMLENYSNLVSVGYCVHKPEVIFRLEQGEEPWRLEEEFPSQSFPEIWTADHLKERSQENQSKHLWEVVF

SEQ ID NO: 7324 - protein, 81 aa, Callithrix jacchus
PSQFSLLFQHQGKMITAQGPVSFRDVTVGFTQEEWQHLDPAQRTLYRDVMMENYSHLVSVGYCIPKPEVILKLEKGEEPWI

SEQ ID NO: 7325 - protein, 81 aa, Callithrix jacchus
MITAQGPVSFRDVTVGFTQEEWQHLDPAQRTLYRDVMMENYSHLVSVGYCIPKPEVILKLEKGEEPWILEENFPSQSHLGS

SEQ ID NO: 7326 - protein, 81 aa, Callithrix jacchus
MITAQGPVSFRDVTVGFTQEEWQHLDPAQRTLYRDVMMENYSHLVSVGYCIPKPEVILKLEKGEEPWILEENFPSQSHLEL

SEQ ID NO: 7327 - protein, 81 aa, Callithrix jacchus
MGPLTFMDVAIEFSPEEWQCLDTAQQNLYRDVMLENYRNLVFLGTAFSKPDLITYLEQGKEPWNMKRHETLAKPPVTCSYF

SEQ ID NO: 7328 - protein, 81 aa, Callithrix jacchus
MAPRAQIQGLLTFGDVAVAFTRIEWRHLDAAQRALYRDVMLENYGNLVSVGLLSSKPKLIAQLEQGAEPWMEVREAPSGTR

SEQ ID NO: 7329 - protein, 81 aa, Callithrix jacchus
RDVMLENYGNLVSVGLLSSKPKLIAQLEQGAEPWMEVREAPSGTRAVPDYWFETKMSALKQSTSEGSVLGERMKSVMMEKG

SEQ ID NO: 7330 - protein, 81 aa, Callithrix jacchus
MPSQDFMTFEDIIIDFTREEWALLDTSQRKLFRDVMLENISHLVSIGNEFCKSVVFSQGISLLQGKEGDIKHQEIPFIQHI

SEQ ID NO: 7331 - protein, 81 aa, Callithrix jacchus
DIKHQEIPFIQHIYQKDTSTISTMRSHTQDDPFLCNDLGEDFTQHIPLTQNMVTYMSKKQFERRSSEHQSVVTATSIKTWL

SEQ ID NO: 7332 - protein, 81 aa, Callithrix jacchus
LVSIGNEFCKSVVFSQGISLLQGKEGDIKHQEIPFIQHIYQKDTSTISTMRSHTQDDPFLCNDLGEDFTQHIPLTQNMVTY

SEQ ID NO: 7333 - protein, 81 aa, Callithrix jacchus
MMPSQDFMTFEDIIIDFTREEWALLDTSQRKLFRDVMLENISHLVSIGKEGDIKHQEIPFIQHIYQKDTSTISTMRSHTQD

SEQ ID NO: 7334 - protein, 81 aa, Callithrix jacchus
RFLGEKRTTNSFLKARPQDLMTFEDVAVEFTQWEWGQLNPAQKDLYREVMLENFRNLTLLGLLVSKPYVICQLEEGGEPFM

SEQ ID NO: 7335 - protein, 81 aa, Callithrix jacchus
MTFEDVAVEFTQWEWGQLNPAQKDLYREVMLENFRNLTLLGLLVSKPYVICQLEEGGEPFMVKREISIGVHSDWERRSKSK

SEQ ID NO: 7336 - protein, 81 aa, Callithrix jacchus
MLENYKSVVSLGLPVPQPDMIFQLKRGEEPWMVDLHGSEEREWPESVSLDWETKPEIYDASEEKAEGSLRESLGKQSPLCP

SEQ ID NO: 7337 - protein, 81 aa, Callithrix jacchus
MAAVSPTTRCQESVTFEDVAVVFTDEEWSHLVPIQRDLYKEVMLENYKSVVSLGLPVPQPDMIFQLKRGEEPWMVDLHGSE

SEQ ID NO: 7338 - protein, 81 aa, Callithrix jacchus
LGPALELLPGQPTLPRTCLESVTFEDVAVYFSENEWIGLGPAQRALYRDVMLENYGSVASLAFPFPKPALISQLEQGKAPW

SEQ ID NO: 7339 - protein, 81 aa, Callithrix jacchus
TMTTVSSTARPQESVAFDDVAVYFTKKEWAIMVPDQRALYRDVMLENYEAVAFVVPPTSKPALISHLEQGKEPCFTQPQGV

SEQ ID NO: 7340 - protein, 81 aa, Callithrix jacchus
QILELLVLEQFLSILPGELRVWVQLHNPESGDEAVALLEELQRDLDGTSHRDPGPVQSPDVHWMGTGALRSAQIWSLASPL

SEQ ID NO: 7341 - protein, 81 aa, Callithrix jacchus
EGCPGDQVTATRSLTAQLQETMTFKDVEVTFSQDEWGLLDSAQRNLYRDVMLENYRNMAFLVGPFTKPALISWLEAREPWG

SEQ ID NO: 7342 - protein, 81 aa, Callithrix jacchus
AQILELLVLEQFLSILPGELRVWVQLHNPESGDEAVALLEELQRDLDGTSHRDPGPVQSPDVHWMGTGALRSAQIWSLASP

SEQ ID NO: 7343 - protein, 81 aa, Callithrix jacchus
PPAAQMPALFQREGCPGDQETMTFKDVEVTFSQDEWGLLDSAQRNLYRDVMLENYRNMAFLVGPFTKPALISWLEAREPWG

SEQ ID NO: 7344 - protein, 81 aa, Callithrix jacchus
LAGQSDPPAAQMPALFQREGCPGDQVTATRSLTAQLQETMTFKDVEVTFSQDEWGLLDSAQRNLYRDVMLENYRNMAFLGK

SEQ ID NO: 7345 - protein, 81 aa, Callithrix jacchus
VGNSGDQAGATVLRMVRPQDTVAFEDLCVDYTQKNQKCPALSQRAMHCNVMPDNDHSMASLAGENKLESSELTPKQEIFKG

SEQ ID NO: 7346 - protein, 81 aa, Callithrix jacchus
GNSGDQAGATVLRMVRPQDTVAFEDLCVDYTQKNQKCPALSQRAMHCNVMPDNDHSMASLGENKLESSELTPKQEIFKGSK

SEQ ID NO: 7347 - protein, 81 aa, Callithrix jacchus
TLPQVGNSGDQAGATVLRMVRPQDTVAFEDLCVDYTQKNQKCPALSQRAMHCNVMPDNDHSMASLDGETGTEEVLIPKLHS

SEQ ID NO: 7348 - protein, 81 aa, Callithrix jacchus
APEASALSQEENPRNQLMALMLLTAQPQELVMFEEVSVCFTSEEWACLGPIQRALYWDVMLENYGNVTSLGYRKYGRQKNK

SEQ ID NO: 7349 - protein, 81 aa, Callithrix jacchus
PALPSKVSAWPWEEKPGYLGPVTFKDVAVVFTEAEWKRLSLEQRNLYREVMLENLRNLVSLARSPSCPSCPVVFGSQQFLS

SEQ ID NO: 7350 - protein, 81 aa, Callithrix jacchus
LPSKVSAWPWEEKPGYLGPVTFKDVAVVFTEAEWKRLSLEQRNLYREVMLENLRNLVSLAESKPEVHCPSCPVVFGSQQFL

SEQ ID NO: 7351 - protein, 81 aa, Callithrix jacchus
GFSSLFQRPPTSSGGNRILEIQLSPAQDASSEEVYRISKRAKTPGFGAVRFGECALAFSQKSNLFGQKAVTVEKSSDKRQS

SEQ ID NO: 7352 - protein, 81 aa, Callithrix jacchus
MAAARLLPVPAGPQAKLTFEDVAVLLSQDEWDRLGPAQRGLYRNVMMETYGNVVSLGLPISKPDLISQLERGEDPWVLDGK

SEQ ID NO: 7353 - protein, 81 aa, Callithrix jacchus
AAARLLPVPAGPQPLSFQAKLTFEDVAVLLSQDEWDRLGPAQRGLYRNVMMETYGNVVSLGLPISKPDLISQLERGEDPWV

SEQ ID NO: 7354 - protein, 81 aa, Callithrix jacchus
MSFQEVVTFGDVAVHFSREEWQCLDPGQRALYREVMLENHSSVAGLAGFLVFKPELISRLEQGQEPWVLDLQGAEGTEAPK

SEQ ID NO: 7355 - protein, 81 aa, Callithrix jacchus
MEVVTFGDVAVHFSREEWQCLDPGQRALYREVMLENHSSVAGLAGFLVFKPELISRLEQGQEPWVLDLQGAEGTEAPKTFK

SEQ ID NO: 7356 - protein, 81 aa, Callithrix jacchus
MGFLGCWCMSFQEVVTFGDVAVHFSREEWQCLDPGQRALYREVMLENHSSVAGLAGFLVFKPELISRLEQGQEPWVLDLQG

SEQ ID NO: 7357 - protein, 81 aa, Callithrix jacchus
MEVVTFGDVAVHFSREEWQCLDPGQRALYREVMLENHSSVAGLGFLVFKPELISRLEQGQEPWVLDLQGAEGTEAPKTFKT

SEQ ID NO: 7358 - protein, 81 aa, Callithrix jacchus
MEVVTFGDVAVHFSREEWQCLDPGQRALYREVMLENHSSVAGLAFSHTVWVGYLCPCFPHDGNLWAWSRGAVASGFLVFKP

SEQ ID NO: 7359 - protein, 81 aa, Callithrix jacchus
MVMALPMPGPQEAVVFEDVAVYFTRIEWSCLAPDQQVLYRDVMLENYRNLASLGFLVAKPALISLLEQGEEPGALILQVAE

SEQ ID NO: 7360 - protein, 81 aa, Callithrix jacchus
MVMALPMPGPQEAVVFEDVAVYFTRIEWSCLAPDQQVLYRDVMLENYRNLASLALISLLEQGEEPGALILQVAEQRGAKTS

SEQ ID NO: 7361 - protein, 81 aa, Callithrix jacchus
ENYRNLASLALISLLEQGEEPGALILQVAEQRGAKTSLCTDSRMEAGIMESSLQRKLSRQAGLSGTVWRCLPEEDPAPPHP

SEQ ID NO: 7362 - protein, 81 aa, Callithrix jacchus
ALKPKTQAMAALFLSAPPQTEVTFEDVAVLLSREEWGRLGPAQRGLYRDVMLETYGNLVSLALGTSTEYKELTSRETFDEE

SEQ ID NO: 7363 - protein, 81 aa, Callithrix jacchus
AQRGLYRDVMLETYGNLVSLALGTSTEYKELTSRETFDEEELGHLRGIFPQGSEPVDASNRARKPEGSLEKLVEQNRPVTL

SEQ ID NO: 7364 - protein, 81 aa, Callithrix jacchus
MAALFLSAPPQTEVTFEDVAVLLSREEWGRLGPAQRGLYRDVMLETYGNLVSLGVGPAGPKPGVISQLERGDEPWVLDVQG

SEQ ID NO: 7365 - protein, 81 aa, Callithrix jacchus
GKPKTQAMAALFLSAPPQTEVTFEDVAVLLSREEWGRLGPAQRGLYRDVMLETYGNLVSLGVGPAGPKPGVISQLERGDEP

SEQ ID NO: 7366 - protein, 81 aa, Callithrix jacchus
MAALFLSAPPQTEVTFEDVAVLLSREEWGRLGPAQRGLYRDVMLETYGNLVSLALGTSTEYKELTSRETFDEEELGHLRGI

SEQ ID NO: 7367 - protein, 81 aa, Callithrix jacchus
MAATLQLRGHQEMPLTFQDVAVYFSQAEGQQLGPQQRALYRDVMLENYGNVASLGFPVPKPELISQLEQGKELWVLNLLGA

SEQ ID NO: 7368 - protein, 81 aa, Callithrix jacchus
AAHAHRMAATLQLRGHQEMPLTFQDVAVYFSQAEGQQLGPQQRALYRDVMLENYGNVASLGFPVPKPELISQLEQGKELWV

SEQ ID NO: 7369 - protein, 81 aa, Callithrix jacchus
FEGTSGHGPGSGDVLLQEMPLTFQDVAVYFSQAEGQQLGPQQRALYRDVMLENYGNVASLGFPVPKPELISQLEQGKELWV

SEQ ID NO: 7370 - protein, 81 aa, Callithrix jacchus
MDVAQEQVTFWDVAIYFSREEWECLEPSQRALYRDVMLDTFSNVAALGFCSPRPDLISRLEQWEEPWVEDRERPELQAVQR

SEQ ID NO: 7371 - protein, 81 aa, Callithrix jacchus
MDVAQEQVTFWDVAIYFSREEWECLEPSQRALYRDVMLDTFSNVAALAPDQTSSPAWNSGRSRGLKTGRDLSCRQCRGAPA

SEQ ID NO: 7372 - protein, 81 aa, Callithrix jacchus
MLQTLWFQGSSRNLFQKPVTFEDVAVYFTQNEWASLHPTQRALYREVMLENYANVTSFYLIGGFPGTERTEKVPGALPSFL

SEQ ID NO: 7373 - protein, 81 aa, Callithrix jacchus
MLQTLWFQGSSRNLFQKPVTFEDVAVYFTQNEWASLHPTQRALYREVMLENYANVTSFSAFPFPKPDLVFQLDQGEAAWGP

SEQ ID NO: 7374 - protein, 81 aa, Callithrix jacchus
MLQTLWFQGSSRNLFQKPVTFEDVAVYFTQNEWASLHPTQRALYREVMLENYANVTSFSLSSSLIPNGDLMQGGFPGYREN

SEQ ID NO: 7375 - protein, 81 aa, Callithrix jacchus
MLQTAWRQEPVTFEDVAVYFTQNEWTSLDPVQRALYREVMLENYANVASLAFPFTTPVLVSQLEQGERPWGLDPWEPVGRE

SEQ ID NO: 7376 - protein, 81 aa, Callithrix jacchus
MLQTAWPQESVAFEDVAVYFTQNQWASLDPAQRALYREVMLENYANVTSLVAFPFPKPALISHLEKGEAPWGPDPWDAEIP

SEQ ID NO: 7377 - protein, 81 aa, Callithrix jacchus
MLQTAWPQRLSRNLWFQESVAFEDVAVYFTQNQWASLDPAQRALYREVMLENYANVTSLVAFPFPKPALISHLEKGEAPWG

SEQ ID NO: 7378 - protein, 81 aa, Callithrix jacchus
EDGPVVMQKVRICSEGGWVPALFDEVAIYFSDEEWEVLTEQQKALYREVMRMNYETVLSLEFPFPKPDMITRLEGEEESQN

SEQ ID NO: 7379 - protein, 81 aa, Callithrix jacchus
QKALYREVMRMNYETVLSLEFPFPKPDMITRLEGEEESQNSDEWQLQGGTSAENEESDVKPPDWPSPVNATSHFPQPQHFD

SEQ ID NO: 7380 - protein, 81 aa, Callithrix jacchus
QEENVRDTQQVVTTLQLPPNRVSPFKDMILCFSEEDWSLLDPAQTGFYGEFIIGEDCGVSMPPNDLAAQPDLSQGEENEPR

SEQ ID NO: 7381 - protein, 81 aa, Callithrix jacchus
LGSGGKKAQAISVLSQIYVNRVSPFKDMILCFSEEDWSLLDPAQTGFYGEFIIGEDCGVSMPPNDLAAQPDLSQGEENEPR

SEQ ID NO: 7382 - protein, 81 aa, Callithrix jacchus
MGLLIFRDVAIEFSPEEWSYLNPAQQNLYRDVMLENYRNLVSLGIAISKPDLITCLEQRNEPWSVKKCETVAKQPAISSHF

SEQ ID NO: 7383 - protein, 81 aa, Callithrix jacchus
MNPVAFEDVAVNFTQEEWALLDPSQKNLYRDVMQETFRNLASIGNKGEDQSFEDRYKKSWRNLRHSISHSGNNPHSCEESR

SEQ ID NO: 7384 - protein, 81 aa, Callithrix jacchus
MYSVSFEDVAVTFTQEEWALLDLSQKSLYRDVMQEIFRNLASVGNKSENQNMQDDFKSPGRNLSSHMVERLFEIKEGSQYG

SEQ ID NO: 7385 - protein, 81 aa, Callithrix jacchus
TCHFDFCVAESIFAEAAEDSAAFKDVAVNFTQEEWALLDSSQKNLYREVMEETCRNLAIVGNKWKDQNTEDYFKKPGKDIR

SEQ ID NO: 7386 - protein, 81 aa, Callithrix jacchus
MDSAAFKDVAVNFTQEEWALLDSSQKNLYREVMEETCRNLAIVGNKWKDQNTEDYFKKPGKDIRNHMVQRLCERKEGNQYG

SEQ ID NO: 7387 - protein, 81 aa, Callithrix jacchus
PAALGSGWASRKVVTRAKDSAAFKDVAVNFTQEEWALLDSSQKNLYREVMEETCRNLAIVGNKWKDQNTEDYFKKPGKDIR

SEQ ID NO: 7388 - protein, 81 aa, Callithrix jacchus
MGPLTFRDVKIEFSLEEWQCLDTVQRNLYRDVMLENYRNLVFLGIAVSKPDLITWLEQGKEPWNMKSHAMVAKPPVICSHF

SEQ ID NO: 7389 - protein, 81 aa, Callithrix jacchus
LLDVSQNILLEPKTLSLLGPLTFRDVAIEFSLEEWQCLDTAQQNLYRHVMLENYRNLVFLGIAVSKPDLITCLEQGKEPWN

SEQ ID NO: 7390 - protein, 81 aa, Callithrix jacchus
MEPLTFRDVAIEFSLEEWQCLDTAQRDLYRNVLLENYRNLVFLGIAVSKPYLITCLEQKKEPWNMKRCEMVAKPPVMCFHF

SEQ ID NO: 7391 - protein, 81 aa, Callithrix jacchus
MEPLTFRDVAIEFSLEEWQCLDTAQRDLYRNVLLENYRNLVFLGIAVSKPYLITCLEQKKEPWNMKRCEMVAKPPVIFLQV

SEQ ID NO: 7392 - protein, 81 aa, Callithrix jacchus
MGPLTFRDVAIEFSLEEWQCLDTAQRNLYRKVMFENYRNLVFLGIAVSKPHLITCLEQGQEPWNRKRQEMVAKPPVMCSHV

SEQ ID NO: 7393 - protein, 81 aa, Callithrix jacchus
MGVLTFRDVAIEFSPEEWQCLDSAQQHLYRDVMLENYRNLVSLGLAIFKPDLITCLEQREEPWNLKKQETVAKHQAGSFHF

SEQ ID NO: 7394 - protein, 81 aa, Callithrix jacchus
MEEKEMNDGSQVVRSQESLTFQDVAVDFTREEWDRLYPAQKDLYRDVMLENYRNLVALGHQLYKPEVIAQLELEEEWVIER

SEQ ID NO: 7395 - protein, 81 aa, Callithrix jacchus
MPSQSAVFSQEENMEEKEMNDGSQVVRSQESLTFQDVAVDFTREEWDRLYPAQKDLYRDVMLENYRNLVALGHQLYKPEVI

SEQ ID NO: 7396 - protein, 81 aa, Callithrix jacchus
ENMEEKEMNDGSQVVRSQESLTFQDVAVDFTREEWDRLYPAQKDLYRDVMLENYRNLVALGHQLYKPEVIAQLELEEEWVI

SEQ ID NO: 7397 - protein, 81 aa, Callithrix jacchus
GGLWDFHYHPEFNQEDQQRYLGQVTLTHKKITQQRNLECNKFAENCNLNSTLRRQRIPSIKTPLNSDTQGNGIRHNSDLIF

SEQ ID NO: 7398 - protein, 81 aa, Callithrix jacchus
DSLGDEMLAAALLKAKSQELVTFEDVAVYFIRKEWKRLEPAQRDLYRDVMLENYGNVFSLDGETRTENDQAVSEDTRSHGV

SEQ ID NO: 7399 - protein, 81 aa, Callithrix jacchus
MLAAALLKAKSQELVTFEDVAVYFIRKEWKRLEPAQRDLYRDVMLENYGNVFSLDGETRTENDQAVSEDTRSHGVLLGRFQ

SEQ ID NO: 7400 - protein, 81 aa, Callithrix jacchus
DSLGDEMLAAALLKAKSQELVTFEDVAVYFIRKEWKRLEPAQRDLYRDVMLENYGNVFSLDQIQVSLTIQKVMLAWFTGTL

SEQ ID NO: 7401 - protein, 81 aa, Callithrix jacchus
VPAFSDKDSLGDEMLAAALLKAKSQELVTFEDVAVYFIRKEWKRLEPAQRDLYRDVMLENYGNVFSLDGETRTENDQAVSE

SEQ ID NO: 7402 - protein, 81 aa, Callithrix jacchus
GSPRDQAMASALFTADSQAMVKIEDMAVSLILEEWGCQNLARRNLSRDNRQENYGSAFSQGGENRNENEESTSKAETAEDS

SEQ ID NO: 7403 - protein, 81 aa, Callithrix jacchus
MASALFTADSQAMVKIEDMAVSLILEEWGCQNLARRNLSRDNRQENYGSAFSQGGENRNENEESTSKAETAEDSASHGETA

SEQ ID NO: 7404 - protein, 81 aa, Callithrix jacchus
GPGLPTMNPRDQEMAAGFFTAGPQGLGPFKDMALAFPEEEWRHVTPAQIDCFGEYVEPQDCRVSPGIGSKEKETKPPQEDL

SEQ ID NO: 7405 - protein, 81 aa, Callithrix jacchus
HEGSPGDQAAALLTARYQEFVTFEDVAVHLTREEWGYLDPVQRDLYREVMLENYGNVVSLGILLRLPTTRIHSVNSCPALS

SEQ ID NO: 7406 - protein, 81 aa, Callithrix jacchus
QVPALPHEGSPGDQAAALLTARYQSSQDVLFQEFVTFEDVAVHLTREEWGYLDPVQRDLYREVMLENYGNVVSLGTVGSWD

SEQ ID NO: 7407 - protein, 81 aa, Callithrix jacchus
LTGAPPVPQVPALPHEGSPGDQAAALLTARYQEFVTFEDVAVHLTREEWGYLDPVQRDLYREVMLENYGNVVSLGTVGSWD

SEQ ID NO: 7408 - protein, 81 aa, Callithrix jacchus
SQELTTSLLSTGSQKLVKIEEVADVAVSFILEEWGHLDQSQKSLYRDDRKENYGSITSMDYESRDNMELMVKQVSDDTESQ

SEQ ID NO: 7409 - protein, 81 aa, Callithrix jacchus
DSQELTTSLLSTGSQLVKIEEVADVAVSFILEEWGHLDQSQKSLYRDDRKENYGSITSMDYESRDNMELMVKQVSDDTESQ

SEQ ID NO: 7410 - protein, 81 aa, Callithrix jacchus
EAVAVVQALQRALDGTSPQGMMTFEDMAMSLTWEEWERLDPARKDFYRESMQKDSGSTVLPSLESRTENKELIPMQEILEA

SEQ ID NO: 7411 - protein, 81 aa, Callithrix jacchus
MFPPVSGKELLSFEDVAMYFTREEWGHLDWGQKDLYRDVMLENYRNMVFLGFQFPKPEVICQLENWDEQWILDLPRAGNRK

SEQ ID NO: 7412 - protein, 81 aa, Callithrix jacchus
MFPPVSGKELLSFEDVAMYFTREEWGHLDWGQKDLYRDVMLENYRNMVFLGSEARHKMKKLTSRQKFSEDLESYKISVVMQ

SEQ ID NO: 7413 - protein, 81 aa, Callithrix jacchus
MFPPVSGKELLSFEDVAMYFTREEWGHLDWGQKDLYRDVMLENYRNMVFLGRTRLEGSEARHKMKKLTSRQKFSEDLESYK

SEQ ID NO: 7414 - protein, 81 aa, Callithrix jacchus
MELLSFEDVAMYFTREEWGHLDWGQKDLYRDVMLENYRNMVFLGFQFPKPEVICQLENWDEQWILDLPRAGNRKASGSACP

SEQ ID NO: 7415 - protein, 81 aa, Callithrix jacchus
EEEDEDEDEDDLLMAGSQGLVTFEDVAVYFSLEEWERLEADQRGLYQEVMQENYGILVSLGYPIPKPDLIFRLEQGEEPWV

SEQ ID NO: 7416 - protein, 81 aa, Callithrix jacchus
MLENYSNLVSVGYHIIKPDVITKLEQGEEPWIVEGEFLLQSYPDKVWQTDDLIERVQEDENKPSRQTVFIKTLTEEREYIS

SEQ ID NO: 7417 - protein, 81 aa, Callithrix jacchus
MNKSLGPVSFKDVAVDFTQEEWQQLDPEQKITYRDVMLENYSNLVSVGYHIIKPDVITKLEQGEEPWIVEGEFLLQSYPDK

SEQ ID NO: 7418 - protein, 81 aa, Callithrix jacchus
MNKLQGPVSFKDVAVDFTQEEWQQLDPDEKIIYRDVMLENYSHLVSVGCDITKPNVIIKLEQGEEPWIMEDEFPCQHSPEV

SEQ ID NO: 7419 - protein, 81 aa, Callithrix jacchus
MNKLQGPVSFKDVAVDFTQEEWQQLDPDEKIIYRDVMLENYSHLVSVGCDITKPNVIIKLEQGEEPWIMEDEFPCQHSPAA

SEQ ID NO: 7420 - protein, 81 aa, Callithrix jacchus
MMKSQGLVSFKDVAVDFTQEEWQQLDPAQRTLYRDVMLENYSHLVSMGYPVSKPDVICKLEQGEEPWILKTDISNWIYPDE

SEQ ID NO: 7421 - protein, 81 aa, Callithrix jacchus
MLENYSHLVSMGYPVSKPDVICKLEQGEEPWILKTDISNWIYPDEYQADGRQDRKSNLHNSESYILETVFSQHKILKGITK

SEQ ID NO: 7422 - protein, 81 aa, Callithrix jacchus
ADPSSSGLLEEQKMMKSQGLVSFKDVAVDFTQEEWQQLDPAQRTLYRDVMLENYSHLVSMGYPVSKPDVICKLEQGEEPWI

SEQ ID NO: 7423 - protein, 81 aa, Callithrix jacchus
MAAGQWEARPQVSLTFEDVAVLFTRDEWRKLAPSQRNLYRDVMLENYRNLVSLGLPFTKPKVISLLQQGEDPWKVEKGSSG

SEQ ID NO: 7424 - protein, 81 aa, Callithrix jacchus
MAVDLLSAQESMTFRDVAVFFSQDEWLHLDSAQRALYREVMLENYSTLVSLGIPFSMPKVIHQLQQGQDPCTVEGDVPSNT

SEQ ID NO: 7425 - protein, 81 aa, Callithrix jacchus
ISWLLDSEMAGMFPDFVQESMTFRDVAVFFSQDEWLHLDSAQRALYREVMLENYSTLVSLGIPFSMPKVIHQLQQGQDPCT

SEQ ID NO: 7426 - protein, 81 aa, Callithrix jacchus
MARRLLPAQVQESVTFRDVAVFFSPDEWLHLDSAQRALYREVMLENYSSLVSLGILFSKPKVISHLEQGENPWMVESGVPQ

SEQ ID NO: 7427 - protein, 81 aa, Callithrix jacchus
MALSHLPTMVQESVTFKDVAVLFTQEEWGQLSPAQRALYRDVMLENYSNLVSLGLLGPKSDIFSQLEKREEWMPEDPSGGF

SEQ ID NO: 7428 - protein, 81 aa, Callithrix jacchus
MLENYRNLVSLGLPFTKPKVISLLQQGEDPWKVEKDCFGGSFLGCKSNPKMTKTTQTQDSFQELMRKRLKRDEPWNFISER

SEQ ID NO: 7429 - protein, 81 aa, Callithrix jacchus
MAAGQPEARPQVSLTFEDVAVLFTRDEWRKLAPSQRNLYRDVMLENYRNLVSLGLPFTKPKVISLLQQGEDPWKVEKDCFG

SEQ ID NO: 7430 - protein, 81 aa, Callithrix jacchus
MAAIPLKAQCQETVTFEDVAVHFTKTEWTGLSPAQRALYRSVMLENYGNLTAMGYLVPKPALISLLEGGDMAWGLEAQDDP

SEQ ID NO: 7431 - protein, 80 aa, Callithrix jacchus
VTFEDVAVHFTKTEWTGLSPAQRALYRSVMLENYGNLTAMGYLVPKPALISLLEGGDMAWGLEAQDDPLAEGTKNICKGR

SEQ ID NO: 7432 - protein, 81 aa, Callithrix jacchus
TVTFEDVAVHFTKTEWTGLSPAQRALYRSVMLENYGNLTAMGYLVPKPALISLLEGGDMAWGLEAQDDPLAEGTKNICKVI

SEQ ID NO: 7433 - protein, 81 aa, Callithrix jacchus
MLENYGNVASLGFPLLKPAVISQLEGGGELGGPSPLAAGTGLHVLRTDIQTDSDFTKEMYDRKEDVSFELQRDFSQETGFL

SEQ ID NO: 7434 - protein, 81 aa, Callithrix jacchus
VLRTDIQTDSDFTKEMYDRKEDVSFELQRDFSQETGFLETSLLEKQQELYSAGNIKKEKSNTIDGTVTDETSPMAECFFSQ

SEQ ID NO: 7435 - protein, 81 aa, Callithrix jacchus
MLENYGNVASLGFPLLKPAVISQLEGGGELGGPSPLAAGTGLHVLRTARVSLCLPGWSAVATWLTATSVSWVQAILLPQPS

SEQ ID NO: 7436 - protein, 81 aa, Callithrix jacchus
MLENYGNVASLGFPLLKPAVISQLEGGVDIQTDSDFTKEMYDRKEDVSFELQRDFSQETGFLETSLLEKQQELYSAGNIKK

SEQ ID NO: 7437 - protein, 81 aa, Callithrix jacchus
QLEGGVDIQTDSDFTKEMYDRKEDVSFELQRDFSQETGFLETSLLEKQQELYSAGNIKKEKSNTIDGTVTDETSPMAECFF

SEQ ID NO: 7438 - protein, 81 aa, Callithrix jacchus
IHLTAWPQKSVTFEDVAVYFTQAEWDGLSPAQRTLYRDVMLENYGNVASLGFPLLKPAVISQLEGGGELGGPSPLAAGTGL

SEQ ID NO: 7439 - protein, 81 aa, Callithrix jacchus
LRTVDIQTDSDFTKEMYDRKEDVSFELQRDFSQETGFLETSLLEKQQELYSAGNIKKEKSNTIDGTVTDETSPMAECFFSQ

SEQ ID NO: 7440 - protein, 81 aa, Callithrix jacchus
MNKSQGSVSFTDVTVDFTQEEWEQLDPSQRILYMDVMLENYSNLLSVEVWKADDQMERDHRNPDEQPRQFIILKNQTPMEE

SEQ ID NO: 7441 - protein, 81 aa, Callithrix jacchus
MDVMLENYSNLLSVEVWKADDQMERDHRNPDEQPRQFIILKNQTPMEERGDLFGKTLNLNTDFVSLRQVPYKYDLYEKTLK

SEQ ID NO: 7442 - protein, 81 aa, Callithrix jacchus
EQTQAAGMLAGWLIESYQDSVTFDDVAVAFTQEEWTLLDPSQRDLYRDVMLENYENLASVGHHLFKPSVICWLEEEGPSRA

SEQ ID NO: 7443 - protein, 81 aa, Callithrix jacchus
MAAPDLAHRGRVSKDLVCLHEEQTQAAGMLAGWLIESYQDSVTFDDVAVAFTQEEWTLLDPSQRDLYRDVMLENYENLASV

SEQ ID NO: 7444 - protein, 81 aa, Callithrix jacchus
MLENYENLASVGHHLFKPSVICWLEEEGPSRAGQRGVLQEWRLKSKGSALQQDRAWFHSASDETQTARSHNGGQPCDRMQC

SEQ ID NO: 7445 - protein, 81 aa, Callithrix jacchus
SQEESPEGDTGRTEQKPMVKDAFKDISMYFSKEEWAEMGDWEKTRYRNMKRNYNALITIGLRATRPAFMCHRRQAIKLQVD

SEQ ID NO: 7446 - protein, 81 aa, Callithrix jacchus
MKRNYNALITIGLRATRPAFMCHRRQAIKLQVDDTEDSDEEWTPRQQVKPPGMAFRVGQSKHQKIVRCVRTSSLTAVLLMG

SEQ ID NO: 7447 - protein, 81 aa, Callithrix jacchus
QKPMVKDAFKDISMYFSKEEWAEMGDWEKTRYRNMKRNYNALITIGLRATRPAFMCHRRQAIKLQVDDTEDSDEEWTPRQQ

SEQ ID NO: 7448 - protein, 81 aa, Callithrix jacchus
CFSGEERMAAGHPPRWPQELVTFEDVSVDFSQEEWELLDPAQKELYREVTLENYRNLVSLEALKNPCADAGMEEGPFSTAH

SEQ ID NO: 7449 - protein, 81 aa, Callithrix jacchus
HLRLQPVASAHVEQSEALWMEERGTPRASCSDWTTVLKNQDSTYKKVVLQEEPASGISIIRLIREDGGWRQLEESPDGPQG

SEQ ID NO: 7450 - protein, 81 aa, Callithrix jacchus
MDSVVFEDVAVDFTLEEWALLDSAQRDLYRDVMLETFWNLASVDDETRFKASGSVSQQDIYGEEIPKESEIAEFTRNVSWA

SEQ ID NO: 7451 - protein, 81 aa, Callithrix jacchus
MDSVVFEEVAVRFTPEEWALLSHAQRRLYRDVMLEICRNLASLGSCIYVRTSGSSSQRDVFGNKISNEEEMAKFTRSESWC

SEQ ID NO: 7452 - protein, 81 aa, Callithrix jacchus
GHTEGGGLVNELLRSWLQGVTFKDVAVEFTQEDWALLDPAQKTLYRNVMLEDSWNLSSSLDVETPLKASGLTSKLRVFREQ

SEQ ID NO: 7453 - protein, 81 aa, Callithrix jacchus
GHTEGGGLVNELLTSWLQGLVTFEDVAVEFTQEEWALLDPAQRTLYKDVMLENCRNLASLGCHVNKPRLISQWEQDKKVMT

SEQ ID NO: 7454 - protein, 81 aa, Callithrix jacchus
DPAQRTLYKDVMLENCRNLASLGCHVNKPRLISQWEQDKKVMTEERGILPSTCPDLETLLKAKWLTPKKHVFKKEQSKRVK

SEQ ID NO: 7455 - protein, 81 aa, Callithrix jacchus
MLENCRNLASLDLETLLKAKWLTPKKHVFKKEQSKRVKTERSHRGVKLNECNQCFKVFSTKSNLTQHKRIHTGEKPYDCNQ

SEQ ID NO: 7456 - protein, 81 aa, Callithrix jacchus
DLFACSGLEPHTPSIGSQESVTFQDVAVDFTEKEWPLLDSSQRKLYKDVMLENYSNLTSLGYQVGKPSLISHLEQEEEPRT

SEQ ID NO: 7457 - protein, 81 aa, Callithrix jacchus
DLFACSGLEPHTPSIGSQESVTFQDVAVDFTEKEWPLLDSSQRKLYKDVMLENYSNLTSLDWETPSKTKWSLLMEDIFGKE

SEQ ID NO: 7458 - protein, 81 aa, Callithrix jacchus
SSKDCSCPQNLDLFACSGLEPHTPSIGSQESVTFQDVAVDFTEKEWPLLDSSQRKLYKDVMLENYSNLTSLEMLASSCCCS

SEQ ID NO: 7459 - protein, 81 aa, Callithrix jacchus
MEEERTTAELQKNRIQDSVVFQDVAVDFTQEEWALLDLAQRNLYRDVMLENFQNLASLGYLLHTPHLISQWEQEEDLQTVK

SEQ ID NO: 7460 - protein, 81 aa, Callithrix jacchus
AKFEEERMVAGWLTNYSQDSVTFEDVAVDFTPEEWTLLDQTQRNLYGDVMLENYKNLIAVDWESHINTKWTAPQQNFFQEK

SEQ ID NO: 7461 - protein, 81 aa, Callithrix jacchus
MAAGWLTAWSQNSVSFQEVAVDFSQEEWALLDLAQKNLYKDVMLENFRNLTSVGYELCRHNLISKVDQEELKTDERGILES

SEQ ID NO: 7462 - protein, 81 aa, Callithrix jacchus
MVAGWLTNYSQDSVTFEDVAVDFTPEEWTLLDQTQRNLYGDVMLENYKNLIAVDWESHINTKWTAPQQNFFQEKTFSMVEM

SEQ ID NO: 7463 - protein, 81 aa, Callithrix jacchus
MLENFRNLTSVGYELCRHNLISKVDQEELKTDERGILESDCAEWETQLKSKDVIAMQNIPGGKTSNDMKMAQTQPGKNPLE

SEQ ID NO: 7464 - protein, 81 aa, Callithrix jacchus
EKTEVERMVADCLTNCYQDSVTFDDLAVDFTPEEWTLLDPTQRNLYRDVMLENYKNLATVGCQLFKPSLISWLEQEESRTV

SEQ ID NO: 7465 - protein, 81 aa, Callithrix jacchus
VEVLILVKDYLEKRFSISDSVTFEDVSVDFTQEEWTLLDPLQRNFYRDVMLENYENLAKVGFQLLKPSLISWLEEEELRTL

SEQ ID NO: 7466 - protein, 81 aa, Callithrix jacchus
SAVQQNFCKIQTSNGIQTDLIIFDSVAVEFTQEEWTLLDPTERNLYRDVMLENYKNLFSVGYQLFKPSLISWMEEEEELST

SEQ ID NO: 7467 - protein, 81 aa, Callithrix jacchus
MAYCLTDCYQDSVTFEDVSVDFTQEEWTLLDPLQRNFYRDVMLENYENLAKVGFQLLKPSLISWLEEEELRTLQQGLLQEC

SEQ ID NO: 7468 - protein, 81 aa, Callithrix jacchus
EKTAAGRIVAGCLTNCYQDSVTFDDVAVDFTQEEWTLLDPTQRSLYSDVMLENYKNLATVGGQIIKPSLISWLEQEESRTV

SEQ ID NO: 7469 - protein, 81 aa, Callithrix jacchus
MDSVTFDDVAVDFTQEEWTLLDPTQRSLYSDVMLENYKNLATVGWELQLETQWSTLQQNCLRGQTSIGVQLEGNHNGGKLL

SEQ ID NO: 7470 - protein, 81 aa, Callithrix jacchus
LSGDPVCLHEEKTAAGRIVAGCLTNCYQDSVTFDDVAVDFTQEEWTLLDPTQRSLYSDVMLENYKNLATVGRKPQWRETFG

SEQ ID NO: 7471 - protein, 81 aa, Callithrix jacchus
EKTKVERTVVDYLANGYQDSVTFDDVAVEFTPEEWALLDTTQKYLYRDVMLENYKNLASVEWEIQPRSQGPSHQQGFLKNE

SEQ ID NO: 7472 - protein, 81 aa, Callithrix jacchus
EKTKVERTVVDYLANGYQDSVTFDDVAVEFTPEEWALLDTTQKYLYRDVMLENYKNLASMGCQLFIPNLTSWLKQEELKTM

SEQ ID NO: 7473 - protein, 81 aa, Callithrix jacchus
EKTKVERTVVDYLANGYQDSVTFDDVAVEFTPEEWALLDTTQKYLYRDVMLENYKNLASMDYFFCLTSEWEIQPRTQGLSL

SEQ ID NO: 7474 - protein, 81 aa, Callithrix jacchus
FFPREAICPLEEKTKVERTVVDYLANGYQDSVTFDDVAVEFTPEEWALLDTTQKYLYRDVMLENYKNLASMADKLQWMETL

SEQ ID NO: 7475 - protein, 81 aa, Callithrix jacchus
VDSVTFDDVAVEFTPEEWALLDTTQKYLYRDVMLENYKNLASMDYFFCLTSEWEIQPRTQGLSLQQRFLKNEIFNGIQMQT

SEQ ID NO: 7476 - protein, 81 aa, Callithrix jacchus
MDSVAFEDVAVNFTLEEWALLDPSQKNLYRDVMRETFRNLASIGKQWEDQNTEDPFKLPRRNTSHIPQRIGEETFSQIPDG

SEQ ID NO: 7477 - protein, 81 aa, Callithrix jacchus
MDSVAFEDVAVNFTQEEWALLGPSQKSLYRNVMQETIRNLDCIGHTCEIIDNSQCGETFSQIPESIVNKNTPGVDPCDSSE

SEQ ID NO: 7478 - protein, 81 aa, Callithrix jacchus
MDSVAFEDVAVNFTQEEWALLGPSQKSLYRNVMQETIRNLDCIEMKWEDQNIEDQCQNHRRNLRSHTCEIIDNSQCGETFS

SEQ ID NO: 7479 - protein, 81 aa, Callithrix jacchus
MDSVAFEDVAINFTCEEWALLGPSQKSLYRDVMQETIRNLDCIGMKWQNLDIEEDKYRNPGRNLRYYMVKRAREIKDNSQC

SEQ ID NO: 7480 - protein, 81 aa, Callithrix jacchus
MMFQDPVAFEDVAVNFTQEEWALLDISQKNLYREVMLETFRNLTSIGKKWKDKSIEDECQIHRRNLRSLIEEKVYEIKKDS

SEQ ID NO: 7481 - protein, 81 aa, Callithrix jacchus
MDPVAFEDVAVNFTQEEWALLDISQKNLYREVMLETFRNLTSIGKKWKDKSIEDECQIHRRNLRSLIEEKVYEIKKDSHSE

SEQ ID NO: 7482 - protein, 81 aa, Callithrix jacchus
MFQDPVAFEDVAVNFTQEEWALLDISQKNLYREVMLETFRNLTSIGKKWKDKSIEDECQIHRRNLRSLIEEKVYEIKKDSH

SEQ ID NO: 7483 - protein, 81 aa, Callithrix jacchus
MDSVAFEDVAVSFTQEEWALLNPSKKNLYRDVMKETFKNLASVGKTWKVQDIKGMYKNSRRNIRWSLAFARAGVQRDLGSL

SEQ ID NO: 7484 - protein, 81 aa, Callithrix jacchus
MMFQDSVAFEDVAVSFTQEEWALLNPSKKNLYRDVMKETFKNLASVGKTWKVQDIKGMYKNSRRNISLLIKEKLFETKDSN

SEQ ID NO: 7485 - protein, 81 aa, Callithrix jacchus
LLVLSLSPVLHTRGMFQDPVAFEDVAVNFTQEEWALLDISQKNLYREVMLETFRNLTSIGKKWKDKSIEDECQIHRRNLRS

SEQ ID NO: 7486 - protein, 81 aa, Callithrix jacchus
VPCCSHRSCREDSGTSENWEMEEWALLDISQKNLYREVMLETFRNLTSIGKKWKDKSIEDECQIHRRNLRSLIEEKVYEIK

SEQ ID NO: 7487 - protein, 81 aa, Callithrix jacchus
MQENFRNLASVGKKWKAQNIYVEYKNLRRNLRNLMGKRLFESKEDHQHGEILTQVPDDVLKKKTTGVKSCESSVCGEVGSG

SEQ ID NO: 7488 - protein, 81 aa, Callithrix jacchus
MFQDSVAFEDVAVTFTQEEWALLDPSQKTLYRDVMQENFRNLASVGKKWKAQNIYVEYKNLRRNLRNLMGKRLFESKEDHQ

SEQ ID NO: 7489 - protein, 81 aa, Callithrix jacchus
MDSVAFEDVAVTFTQEEWALLDPSQKTLYRDVMQENFRNLASVGKKWKAQNIYVEYKNLRRNLRNLMGKRLFESKEDHQHG

SEQ ID NO: 7490 - protein, 81 aa, Callithrix jacchus
MFQDSVAFEDVTVLVSPILLYICGMFQDSVAFEDVAVTFTQEEWALLDPSQKTLYRDVMQENFRNLASVGKKWKAQNIYVE

SEQ ID NO: 7491 - protein, 81 aa, Callithrix jacchus
DVTVLVSPILLYICGMFQDSVAFEDVAVTFTQEEWALLDPSQKTLYRDVMQENFRNLASVGKKWKAQNIYVEYKNLRRNLR

SEQ ID NO: 7492 - protein, 81 aa, Callithrix jacchus
MDSVAFEDVAVNFTQEEWALLDRSQKKLYREVMQETLRNLTSIGKTWSNQNAEERHQNPRRNLRRLIGERLFQILEVVESV

SEQ ID NO: 7493 - protein, 81 aa, Callithrix jacchus
VMAELAVNTARHPVSSLQLDSVAFEDVAVTFTQEEWALLDPSQKTLYRDVMQENFRNLASVGKKWKAQNIYVEYKNLRRNL

SEQ ID NO: 7494 - protein, 81 aa, Callithrix jacchus
DSVAFEDVAVNFTQEEWALLDRSQKKLYREVMQETLRNLTSIGKTWSNQNAEERHQNPRRNLRRLIGERLFQSKESHQHAE

SEQ ID NO: 7495 - protein, 81 aa, Callithrix jacchus
MDSVAFEDVDVNFTQDEWALLDPSQKNLYRDVMQETFRNLASVGKKWKDQKIEDEYKNPRSNLRGLMGERLLESKTGHQLG

SEQ ID NO: 7496 - protein, 81 aa, Callithrix jacchus
RRHLRADTGHKPYEYQEYGQKPYKCTYCKKAFSDLPYFRTHEWAHTGGKPYDCEECGKSFISRSSIRRHRIMHSGDGPYKC

SEQ ID NO: 7497 - protein, 81 aa, Callithrix jacchus
MDLVAFEDIDVNFTQEEWALLDPSQKNLYRDVMWETMRNLASIGKKWKDQKIKDHYKHQGRNLRRHMVERLYQSRDGGQHG

SEQ ID NO: 7498 - protein, 81 aa, Callithrix jacchus
TLRRGQPKVLGWGLPKDQDSVAFEDVAVNFTHEEWALLGPTQKNLYRDVMQETIRNLNCIGMKWENQNTDDWYQNLRRNLR

SEQ ID NO: 7499 - protein, 81 aa, Callithrix jacchus
MLGHPEVQEMDPVTFEDVAVNFTQEEWALLDPSQKKLYRDVMWETFRNLASIGKQKEWNIDEEYKNQGKSLRSHMVERLFE

SEQ ID NO: 7500 - protein, 81 aa, Callithrix jacchus
EVQEMDPVTFEDVAVNFTQEEWALLDPSQKKLYRDVMWETFRNLASIGKQKEWNIDEEYKNQGKSLRSHMVERLFESKEVS

SEQ ID NO: 7501 - protein, 81 aa, Callithrix jacchus
MDSVAFEDVAVNFTHEEWALLGPTQKNLYRDVMQETIRNLNCIGMKWENQNTDDWYQNLRRNLRCDVVERFGKSKDGSQCG

SEQ ID NO: 7502 - protein, 81 aa, Callithrix jacchus
LGPTQKNLYRDVMQETIRNLNCIGMKWENQNTDDWYQNLRRNLRCDVVERFGKSKDGSQCGETLSQIRNSIVNKNTPARVD

SEQ ID NO: 7503 - protein, 81 aa, Callithrix jacchus
MDTVALEDVAVNFTQEEWALLGPSQKKLYRDVMQETIRNLDCIKMISEDQNIEDQYKNPKKNLRCRMAERLSESKDNSQCG

SEQ ID NO: 7504 - protein, 81 aa, Callithrix jacchus
PHTHKQCGKTFSYHHSFQSHGRPLTGKRCFECKECGKTFSSRRNLRRHMVLQGGNRPYKCKLCGKAFYWPSLLRMHERTHT

SEQ ID NO: 7505 - protein, 81 aa, Callithrix jacchus
MDSVAFEDVAVNFTQEEWALLGPSQKSLYRDVMWETIRNLDYIGMKWEDTNTEDQHKNPRRSLRCHIVERFRESNWISDSI

SEQ ID NO: 7506 - protein, 81 aa, Callithrix jacchus
MASVALEDVAVNFTREEWALLGPCQKNLYKDVMQETIRNLDCVGMKWKDQNIEDQYTYLRKNLRCYMLERFGESKDGRQCG

SEQ ID NO: 7507 - protein, 81 aa, Callithrix jacchus
MDSVVFEDVAVNFTQEEWALLGPSQKKLYRDVMQETFVNLASIGENWEDKNIEDHRNQGRKLRSHTVERLCERKEGNQLGE

SEQ ID NO: 7508 - protein, 81 aa, Callithrix jacchus
SDQRSRNKEARTPGSREMDSVVFEDVAVNFTQEEWALLGPSQKKLYRDVMQETFVNLASIGENWEDKNIEDHRNQGRKLRS

SEQ ID NO: 7509 - protein, 81 aa, Callithrix jacchus
MDSVASEDVAVNFTLEEWALLDPSQKKLYRDVMRETFRNLACVGKKWEDQSIEDWYKNQGRILSNHVEVGLSESKEHDQCG

SEQ ID NO: 7510 - protein, 81 aa, Callithrix jacchus
DSISLEDVAVNFTLEEWALLDPGQRNIYRDVMRATFKNLACIGEKWKDQDIEDDPKNQGRNLRGPMVETLCENKEDRECGK

SEQ ID NO: 7511 - protein, 81 aa, Callithrix jacchus
VLQMQNSVHHGQNIKTQTDSISLEDVAVNFTLEEWALLDPGQRNIYRDVMRATFKNLACIGEKWKDQDIEDDPKNQGRNLR

SEQ ID NO: 7512 - protein, 81 aa, Callithrix jacchus
MDSISLEDVAVNFTLEEWALLDPGQRNIYRDVMRATFKNLACIGEKWKDQDIEDDPKNQGRNLRGPMVETLCENKEDRECG

SEQ ID NO: 7513 - protein, 81 aa, Callithrix jacchus
MDSVAFEDVSVNFSQEEWALLAPSQKKLYRDVMQETFKNLASIGKKWENQNVEDQHKNQGKNLRSHTVERLCESKEGSQCG

SEQ ID NO: 7514 - protein, 81 aa, Callithrix jacchus
MESVTFGDVAVEFIQEWMLLDSVRRNLCRYGMLDKCRSLASRAWESQLKPKELPSMRDILEEASSRDMQMGPGLFLRMQLV

SEQ ID NO: 7515 - protein, 81 aa, Callithrix jacchus
RDILEEASSRDMQMGPGLFLRMQLVPSMEERETPSTQEDWPALQEPPWFPGCMGPKAAVQIQRTVMPVPTLGHPDPWVAGN

SEQ ID NO: 7516 - protein, 81 aa, Callithrix jacchus
DRVEEETMAPGLPTACSQEPVTFADVAVVFTPEEWVFLDSTQRSLYRDVMLENYRNLASVGDQLCKPNALSYLEQRGEQWT

SEQ ID NO: 7517 - protein, 81 aa, Callithrix jacchus
MESVTFGDVAVEFIQEWMLLDSVRRNLCRYGMLDKCRSLASRETPLFWESQLKPKELPSMRDILEEASSRDMQMGPGLFLR

SEQ ID NO: 7518 - protein, 81 aa, Callithrix jacchus
MESVTFGDVAVEFIQEWMLLDSVRRNLCRYGMLDKCRSLASRGARAVPEDAAGAVHGREGDTIDSRGLASSPGATLVSRMH

SEQ ID NO: 7519 - protein, 81 aa, Callithrix jacchus
EDRVEEETMAPGLPTACSQEPVTFADVAVVFTPEEWVFLDSTQRSLYRDVMLENYRNLASVAGDQLCKPNALSYLEQRGEQ

SEQ ID NO: 7520 - protein, 81 aa, Callithrix jacchus
MQMGPGLFLRMQLVPSMEERETPSTQEDWPALQEPPWFPGCMGPKAAVQIQRTVMPVPTLGHPDPWVAGNSAVSPGCPAWL

SEQ ID NO: 7521 - protein, 81 aa, Callithrix jacchus
MLENYRNLVFLAGIAVSKADLVTCLQQGKDPWNIKRHSMAATPPVINPPLAQDLWPVQGIKDSFQEVMLRRYGKCGTEDLQ

SEQ ID NO: 7522 - protein, 81 aa, Callithrix jacchus
GKDPWNIKRHSMAATPPVINPPLAQDLWPVQGIKDSFQEVMLRRYGKCGTEDLQLTTDCESVEECNLYKEGYNELNQCLTT

SEQ ID NO: 7523 - protein, 81 aa, Callithrix jacchus
MLENYRNLVFLGIAVSKADLVTCLQQGKDPWNIKRHSMAATPPVINPPLAQDLWPVQGIKDSFQEVMLRRYGKCGTEDLQL

SEQ ID NO: 7524 - protein, 81 aa, Callithrix jacchus
MDSVAFEDVAVNFTQEEWALLSPSRKQLYRDVMLETFKNLASVGIRWKDQDMENLYQNLGIEPRSLVERLCGRKEGSDHRE

SEQ ID NO: 7525 - protein, 81 aa, Callithrix jacchus
MNSVSFEDVAVNFTLEEWALLDSSQKKLYKDVMRETFKNLVCLGKRWEDQHIEDDHRNLGRNRRGHMVERLCESGKGSKCR

SEQ ID NO: 7526 - protein, 81 aa, Callithrix jacchus
MELLTFRDVTIEFSLEEWEFLNPAQQNLYRNVMLENYRNLVSLGLTISKPELISCLEQRQEPWSVKRHETVAKPPAISCHY

SEQ ID NO: 7527 - protein, 81 aa, Callithrix jacchus
MELLTFRDVTIEFSLEEWEFLNPAQQNLYRNVMLENYRNLVSLGLTISKPELISCLEQRQEPWSVKRHETVAKPPDILSLH

SEQ ID NO: 7528 - protein, 81 aa, Callithrix jacchus
MLENYRNLVSLGLTISKPELISCLEQRQEPWSVKRHETVAKPPAISCHYTEDSLTEQGVKDSFQKVILRRYGSCGLENLYL

SEQ ID NO: 7529 - protein, 81 aa, Callithrix jacchus
IFCFIFQELLTFRDVTIEFSLEEWEFLNPAQQNLYRNVMLENYRNLVSLGLTISKPELISCLEQRQEPWSVKRHETVAKPP

SEQ ID NO: 7530 - protein, 81 aa, Callithrix jacchus
MRPLEFMDVAVEFSLEEWHCLDTAQRNLYRDVMLENYRNLVFLGIAVSEPDLITRLEKGKKPLTVKRHEMIATPPVMRSHF

SEQ ID NO: 7531 - protein, 81 aa, Callithrix jacchus
MRPLEFMDVAVEFSLEEWHCLDTAQRNLYRDVMLENYRNLVFLGIAVSEPDLITRLEKGKKPLTVKRHEMIATPPDGVSLL

SEQ ID NO: 7532 - protein, 81 aa, Callithrix jacchus
MGPLTFRDVAIEFSLEEWQCLDTAQQDLYRKVMLENYRNLAFLGIAVSKPDLITCLEQGKEPWNMKRLEMVDEPPVTCSYF

SEQ ID NO: 7533 - protein, 81 aa, Callithrix jacchus
MGPLTFRDVAIEFSLEEWQCLDTAQQDLYRKVMLENYRNLAFLAGIAVSKPDLITCLEQGKEPWNMKRLEMVDEPPVTCSY

SEQ ID NO: 7534 - protein, 81 aa, Callithrix jacchus
MGPLTFRDVAIEFSLEEWQCLDTAQQDLYRKVMLENYRNLAFLGIAVSKPDLITCLEQGKEPWNMRRLEMVDEPPVIYSHF

SEQ ID NO: 7535 - protein, 81 aa, Callithrix jacchus
MPESPGSLEMGPLTFRDVAIEFSLEEWQCLDTAQQDLYRKVMLENYRNLAFLAGIAVSKPDLITCLEQGKEPWNMRRLEMV

SEQ ID NO: 7536 - protein, 81 aa, Callithrix jacchus
MGPLTFSDVAIEFSLEEWQCLDAAQQNLYRNVMLENYRNLVFLGIAVCKPDLIISLEQEKEVWSRKRQEIMVAKPPVMHSH

SEQ ID NO: 7537 - protein, 81 aa, Callithrix jacchus
MEPLGFRDVAIEFSLEEWHCLDTAQRNLYWDVMLENYRNLVFLVMHSHFAQDLWPEQGIKDSFQKMILRKYEKCEHDNLQL

SEQ ID NO: 7538 - protein, 81 aa, Callithrix jacchus
MEPLGFRDVAIEFSLEEWHCLDTVQRNLYWDVMLENYRNLVFLVMHSHFAQDLWPEQGIKDSFQKMILRRYEKCEHDNLQL

SEQ ID NO: 7539 - protein, 81 aa, Callithrix jacchus
MGPLTFMDVAIEFSLEEWQCLDTAQQNLYRNVMLENYRNFVFLGIAVSNLDLITCLEQGKEPWNMKRHEMVAKSPVIYSDF

SEQ ID NO: 7540 - protein, 81 aa, Callithrix jacchus
MLENYRNLVFLGIAVSKQNPVTCLEQGKEPRNMIRYEIMAKPKAMCYFPKNLWPEQDMKGSSKQVILRRYGKCGHENLQLR

SEQ ID NO: 7541 - protein, 81 aa, Callithrix jacchus
METLTFRDVAIEFSLEEWQCLDTAQQNLYRNVMLENYRNLVFLAGIAVSKQNPVTCLEQGKEPRNMIRYEIMAKPKAMCYF

SEQ ID NO: 7542 - protein, 81 aa, Callithrix jacchus
METLTFRDVAIEFSLEEWQCLDTAQQNLYRNVMLENYRNLVFLGIAVSKQNPVTCLEQGKEPRNMIRYEIMAKPKAMCYFP

SEQ ID NO: 7543 - protein, 81 aa, Callithrix jacchus
METLTFRDVAIEFSLEEWQCLDTAQQSLYRNVMLENYRNLVFLAGIAVSKQNPVTCLEQGKEPQNMIRYEIMAKPTAMCYF

SEQ ID NO: 7544 - protein, 81 aa, Callithrix jacchus
METLTFRDVAIEFSLEEWQCLDTAQQSLYRNVMLENYRNLVFLGIAVSKQNPVTCLEQGKEPQNMIRYEIMAKPTAMCYFP

SEQ ID NO: 7545 - protein, 81 aa, Callithrix jacchus
MGPLTFRDVAIEFSLEEWQCLDTAQQDLYRKVMLENYRNLVFLGIAVSKADLITCLQQGKDPWNMKRHSMAATPPVLCSHF

SEQ ID NO: 7546 - protein, 81 aa, Callithrix jacchus
MGPLTFRDVAIEFSLEEWQCLDTAQQDLYRKVMLENYRNLVFLAGIAVSKADLITCLQQGKDPWNMKRHSMAATPPVLCSH

SEQ ID NO: 7547 - protein, 81 aa, Callithrix jacchus
MGPLTFRDVAIEFSLEEWQCLDTAQQDLYRKVMLENYRNLAFLAGIAVSKADPITFLQQGKDPWNMKRHSMAATPPVLCSH

SEQ ID NO: 7548 - protein, 81 aa, Callithrix jacchus
MGPLTFRDVAIEFSLEEWQCLDTAQQDLYRKVMLENYRNLAFLGIAVSKADPITFLQQGKDPWNMKRHSMAATPPVLCSHF

SEQ ID NO: 7549 - protein, 81 aa, Callithrix jacchus
MGPLTFRDVAIEFSLEEWQCLDTAQQDLYRKVMLENYRNLVFLGIAVSKADPITCLQQEKDPWNMKRHSMAATPPVLCSHF

SEQ ID NO: 7550 - protein, 81 aa, Callithrix jacchus
LVFLGIAVSKADPITCLQQEKDPWNMKRHSMAATPPVLCSHFGQDLWPKLGIKDSFQEVTLREMENVDIRIYSYEKVVKSE

SEQ ID NO: 7551 - protein, 81 aa, Callithrix jacchus
MGPLTFRDVAIEFSLEEWQCLDTAQQDLYRKVMLENYRNLVFLAGIAVSKADPITCLQQEKDPWNMKRHSMAATPPVLCSH

SEQ ID NO: 7552 - protein, 81 aa, Callithrix jacchus
VFLAGIAVSKADPITCLQQEKDPWNMKRHSMAATPPVLCSHFGQDLWPKLGIKDSFQEVTLREMENVDIRIYSYEKVVKSE

SEQ ID NO: 7553 - protein, 81 aa, Callithrix jacchus
GPLTFRDVAIEFSLEEWQCLDTAQKELYRKVMLENYRNLAFLAGIAVSKADPITCLQQEKDPWNMKRHSMVATPPVLCSHF

SEQ ID NO: 7554 - protein, 81 aa, Callithrix jacchus
MGPLTFRDVAIEFSLEEWQCLDTAQKELYRKVMLENYRNLAFLGIAVSKADPITCLQQEKDPWNMKRHSMVATPPVLCSHF

SEQ ID NO: 7555 - protein, 81 aa, Callithrix jacchus
MGPLTFRDVAIEFSLEEWQCLDTAQKELYRKVMLENYRNLAFLAGIAVSKADPITCLQQEKDPWNMKRHSMVATPPVLCSH

SEQ ID NO: 7556 - protein, 81 aa, Callithrix jacchus
MGPLTFRDVAIEFSLEEWQCLNPAQQDLYRKVMLENYRNLVFLGRSDHLSAGRKRSLEYEETQYGSHTPRISLLLSRLECN

SEQ ID NO: 7557 - protein, 81 aa, Callithrix jacchus
LLGSSNSPASASRIAGTTVIYSRFAQDLWPEQGIKDSFQEVMLRRYRKCGHEDLQLRTGCKSVEECNLHKEGYNELNQCLT

SEQ ID NO: 7558 - protein, 81 aa, Callithrix jacchus
MGPLTFRDVAIEFSLEEWQCLNPAQQDLYRKVMLENYRNLVFLDLITCLQEEKDPWNMKRHSMAATPPVIYSRFAQDLWPE

SEQ ID NO: 7559 - protein, 81 aa, Callithrix jacchus
EEKDPWNMKRHSMAATPPVIYSRFAQDLWPEQGIKDSFQEVMLRRYRKCGHEDLQLRTGCKSVEECNLHKEGYNELNQCLT

SEQ ID NO: 7560 - protein, 81 aa, Callithrix jacchus
MGPLTFRDVAIEFSLEEWQCLNPAQQDLYRKVMLENYRNLVFLAGIAVSKADLITCLQEEKDPWNMKRHSMAATPPVIYSR

SEQ ID NO: 7561 - protein, 81 aa, Callithrix jacchus
MGPLTFRDVAIEFSLEEWQCLNPAQQDLYRKVMLENYRNLVFLGIAVSKADLITCLQEEKDPWNMKRHSMAATPPVIYSRF

SEQ ID NO: 7562 - protein, 81 aa, Callithrix jacchus
MGSLTFRDVAIEFSLEEWQCLDTAQQDLYRKVMLENYANLAFLGIAVSKADLITCLQQEKDPWNVKRHSMAATPPVLCSHF

SEQ ID NO: 7563 - protein, 81 aa, Callithrix jacchus
MGSLTFRDVAIEFSLEEWQCLDTAQQDLYRKVMLENYANLAFLAGIAVSKADLITCLQQEKDPWNVKRHSMAATPPVLCSH

SEQ ID NO: 7564 - protein, 81 aa, Callithrix jacchus
METLTFRDVAIEFSLEEWQCLNPAQQDLYRNVMLENYRNLVFLGITVCKENPITCLVQGKEPCNVKRHEMVARPNAMCSYF

SEQ ID NO: 7565 - protein, 81 aa, Callithrix jacchus
METLTFRDVAIEFSLEEWQCLNPAQQDLYRNVMLENYRNLVFLAGITVCKENPITCLVQGKEPCNVKRHEMVARPNAMCSY

SEQ ID NO: 7566 - protein, 81 aa, Callithrix jacchus
METLTFRDVAIEFSLEEWQCLNPAQQDLYRNVMLENYRNLVFLGITVCKENPITCLVQGKEPCNVKRHEMVARPNAICSYF

SEQ ID NO: 7567 - protein, 81 aa, Callithrix jacchus
METLTFRDVAIEFSLEEWQCLNPAQQDLYRNVMLENYRNLVFLAGITVCKENPITCLVQGKEPCNVKRHEMVARPNAICSY

SEQ ID NO: 7568 - protein, 81 aa, Callithrix jacchus
KWMPWGSEESSGVLFFFEKETLTFRDVAIEFSLEEWQCLNPAQQDLYRNVMLETYRNLVFLAMCSYFPKYFWPEQHIKGSF

SEQ ID NO: 7569 - protein, 81 aa, Callithrix jacchus
AAIGSSTAMTPGPPGAIEMETLTFRDVAIEFSLEEWQCLNPAQQDLYRNVMLETYRNLVFLAMCSYFPKYFWPEQHIKGSF

SEQ ID NO: 7570 - protein, 81 aa, Callithrix jacchus
MPGDSESCETGPLTFRDVAIEFSLEEWQCLDTAQQDLYRKVMLENYRNLVFLGIAVSTPDWITCLEQGKDPWNMKRHSVVV

SEQ ID NO: 7571 - protein, 81 aa, Callithrix jacchus
MPGDSESCETGPLTFRDVAIEFSLEEWQCLDTAQQDLYRKVMLENYRNLVFLAGIAVSTPDWITCLEQGKDPWNMKRHSVV

SEQ ID NO: 7572 - protein, 81 aa, Callithrix jacchus
MLENYRNLVFLGIAVSTPDWITCLEQGKDPWNMKRHSVVVTPPVLCSHFGQDLGQRPGIKDSFQKVILREYVKCGHKDLQL

SEQ ID NO: 7573 - protein, 81 aa, Callithrix jacchus
MGPLTFMDVAIEFCLEEWQCLDTAQQNLYRNVMLENYRNLVFLGIAVSKPDLITCLEQEKEPWNMKRHEMVAKSSVMCSHF

SEQ ID NO: 7574 - protein, 81 aa, Callithrix jacchus
LRRYKNGEHKNLHLKKDCKSMDECKVHREGCNGFNQCLPPTQRKTFLFDKCVKAFHKFSNSNRHKISHTEKKLFKCKECGK

SEQ ID NO: 7575 - protein, 81 aa, Callithrix jacchus
APLTFRDVTVEFSLEEWQCLDTAQQNLYRDVMLENYRNLAFLGIAVSKPDMITCLEQGKEPWNMKRPEMVAKPPVICSHFA

SEQ ID NO: 7576 - protein, 81 aa, Callithrix jacchus
MAPLTFRDVTVEFSLEEWQCLDTAQQNLYRDVMLENYRNLAFLGIAVSKPDMITCLEQGKEPWNMKRPEMVAKPPVICSHF

SEQ ID NO: 7577 - protein, 81 aa, Callithrix jacchus
MTPGPPGSLEMEPLTFKDVAIEFSLEEWQCLDTAQQDLYRNVMLENYGNLVFLGIAVSKPDLITCLEQGKVPWNRKRHEMV

SEQ ID NO: 7578 - protein, 81 aa, Callithrix jacchus
MTPGPPGSLEMEPLTFKDVAIEFCLEEWQCLDTAQQDLYRNVMLENYGNLVFLGIAVSKPDLITCLEQRKVPWNRKRHEMV

SEQ ID NO: 7579 - protein, 81 aa, Callithrix jacchus
MTPGPPGSLEMEPLTFKDVAIEFCLEEWQCLDTAQQDLYRNVMLENYRNLVFLGIAVSKPDLITCLEQGKVPWNRKRHEMV

SEQ ID NO: 7580 - protein, 81 aa, Callithrix jacchus
WTPVKHAVFEIHLLKLKKKIYASNRTTETWSSWRPLTFMDVAIEFSLEEWQCLNTAQKNLYRNVMLRTTETWFSWVLQCLM

SEQ ID NO: 7581 - protein, 81 aa, Callithrix jacchus
RRWGFFLLVQLVSDSQHQGVLTFREVAIEFCLEEWQCLDTAQRNLYRNVMLENYRNLVFLGIAASKPDLITCLEQGKEPWN

SEQ ID NO: 7582 - protein, 81 aa, Callithrix jacchus
WYWRSTPKMSGPPGSLEMGVLTFREVAIEFCLEEWQCLDTAQRNLYRNVMLENYRNLVFLGIAASKPDLITCLEQGKEPWN

SEQ ID NO: 7583 - protein, 81 aa, Callithrix jacchus
MGLLTFRDVAIEFSLTEWQFLDTAQRNLYRNVMLENYENLVFLGIAVSKPDLITCLEQEKEFWNMKRHEMVDKPPVMCSHI

SEQ ID NO: 7584 - protein, 81 aa, Callithrix jacchus
MLENYENLVFLGIAVSKPDLITCLEQEKEFWNMKRHEMVDKPPVMCSHIIQDLLPEKNIEDSFHKVTLTRDEKYEHTNFLL

SEQ ID NO: 7585 - protein, 81 aa, Callithrix jacchus
MGQLTFNDVIIEFSLEEWQCLDKTQQNFYRDVMLENYRNLVFVGIAVSKPDLITCLKEGKEPWSMRRHEMVTKPPAPSESA

SEQ ID NO: 7586 - protein, 81 aa, Callithrix jacchus
MDVAIEFSLEEWQCLDTAQQNLYRNVMLENYRNLVFLGIAVSKPDLITFLDQEKKPWNIKRREMVPKPSVICSHFSQDLWE

SEQ ID NO: 7587 - protein, 81 aa, Callithrix jacchus
MGPLTFMDVAIEFSLEEWQCLDTAQQNLYRNVMLENYRNLVFLGIAVSKPDLITFLDQEKKPWNIKRREMVPKPSVICSHF

SEQ ID NO: 7588 - protein, 81 aa, Callithrix jacchus
MGPLTFMDVTVEFSLEEWQCLDIAQQNLYRDVMLENYRNLVFLSIVSKPDMITCLEQGIEPWNIKRYKLVAKPPGSVNQAS

SEQ ID NO: 7589 - protein, 81 aa, Callithrix jacchus
MRPLTFMDVAIEFSLEEWQCLDTTQQNLYRNVMLENYRNMVFLGIAVSKPDLIACLEQGKEPWNLKRQEMVAKPPGMRSYF

SEQ ID NO: 7590 - protein, 81 aa, Callithrix jacchus
MGLLTFRDVAIEFSLEEWQCLDAAQRNLYKNVILENYRNLVFLGIAVSKPDLIACLEQEKEPLIMKRDEMADEPPVMCSHF

SEQ ID NO: 7591 - protein, 81 aa, Callithrix jacchus
MGLLTFRDVAIEFSLEEWQCLDTAQRNLYKNVILENYRNLVFLGIAVSKPDLIACLEQEKEPLIMKRDEMADEPPVMCSHF

SEQ ID NO: 7592 - protein, 81 aa, Callithrix jacchus
MGLLTFRDVAIEFSLEEWQCLDTAQRNLYKNVILENYRNLVFLGIAVSKPDLITCLEQEKEPLIMKRDEMADEPPVMCSHF

SEQ ID NO: 7593 - protein, 81 aa, Callithrix jacchus
GLLTFRDVAIEFSLEEWQCLDTAQRNLYKNVILENYRNLVFLGIAVSKPDLITCLEQEKEPLIMKRDEMADEPPESCSVAH

SEQ ID NO: 7594 - protein, 81 aa, Callithrix jacchus
MGLLTFRDVAIEFSLEEWQCLDTAQRNLYKNVILENYRNLVFLGIAVSKPDLITCLEQEKEPLIMKREEMADEPPVMCSQF

SEQ ID NO: 7595 - protein, 81 aa, Callithrix jacchus
MGLLTFRDVAIEFSLGEWQCLDTAQRNLYKNVILENYRNLVFLGIAISKPDLIACLEQEKEPLIMKRDEMADEPPVICSHF

SEQ ID NO: 7596 - protein, 81 aa, Callithrix jacchus
AIEFSLGEWQCLDTAQRNLYKNVILENYRNLVFLGIAISKPDLIACLEQEKEPLIMKRDEMADEPPVICSHFAQDFSQSRT

SEQ ID NO: 7597 - protein, 81 aa, Callithrix jacchus
MGLLTFRDVAIEFSLGEWQCLDTAQRNLYKNVILENYRNLVFLGIAISKPDLIACLEQEKEPLIMKRDEMADEPPGIAVSK

SEQ ID NO: 7598 - protein, 81 aa, Callithrix jacchus
GLLTFRDVAIEFSLGEWQCLDTAQRNLYKNVILENYRNLVFLGIAISKPDLIACLEQEKEPLIMKRDEMADEPPVMCSHFA

SEQ ID NO: 7599 - protein, 81 aa, Callithrix jacchus
MGLLTFRDVAIEFSLEEWQCLDTAQWNLYKNVILENYRNLVFLGIAVSKPDLIAGLEQEKEPLIMKRDEMAGEPPVMCSHF

SEQ ID NO: 7600 - protein, 81 aa, Callithrix jacchus
MEPLKFRDLVIEFSLEEWQCLDSAQRNLYRNVMLENYRNLVFLGIAVSKPDLITWLEQEKEAWTIERHEMVAKPPEKKQHK

SEQ ID NO: 7601 - protein, 81 aa, Callithrix jacchus
MPGPPGSLEMDPLTFRDVAIEFSLEEWQCLDTAQQNLYRNVMLENYKNLAFLGIAVSKPDLITRLEKEKEPWKMKRHRMVD

SEQ ID NO: 7602 - protein, 81 aa, Callithrix jacchus
MGLLTFRDVAIEFSLEEWQCLDTAQQNLYRNVMLENYRNLAFLGIAASKPDLITCLEKAKEPWKMKRHVMVDELPVICPHF

SEQ ID NO: 7603 - protein, 81 aa, Callithrix jacchus
WYWRSTAEMPGPPGSLKMGVLTFRDVAIEFSRKEWQCLDTAQRNLYRNVMLENYGNLVFLGIAASKPDLITCLEQGQEPWN

SEQ ID NO: 7604 - protein, 81 aa, Callithrix jacchus
MLENYGNLVFLGIAASKPDLITCLEQGQEPWNVKRHEFEAKLPVASSYFAQDFWPKQDIKNHFQKLILRRYKKCGHENFQL

SEQ ID NO: 7605 - protein, 81 aa, Callithrix jacchus
MGVLTFRDVAIEFSQKEWQCLDTAQRNLYRNVMLENYGNLVYLGIATSKPDLITCLEQGQEPWNVKRHEFEAKLPVASSYF

SEQ ID NO: 7606 - protein, 81 aa, Callithrix jacchus
HPKPEPKPKKAPAKKGEKGVLTFRDVAIEFSRKEWQCLDTAQRNLYSNVMLENYGNLVFLGIAASKPDLITCLEQGKEPWN

SEQ ID NO: 7607 - protein, 81 aa, Callithrix jacchus
MLENYGNLVFLGIAASKPDLITCLEQGKEPWNVKRHEFEAKLPVASSYFAQDLWPKQGIQNHFQKVILRRYKKYGHENFQL

SEQ ID NO: 7608 - protein, 81 aa, Callithrix jacchus
MSQVTFSDVAIDFSHEEWEWLDSAQRDLYKDVMVQNYENLASLGLSITKPHVITLLEDGKEPWMVEEKMSKGVTPDWESRL

SEQ ID NO: 7609 - protein, 81 aa, Callithrix jacchus
MSQVTFSDVAIDFSHEEWEWLDSAQRDLYKDVMVQNYENLASLAGLSITKPHVITLLEDGKEPWMVEEKMSKGVTPDWESR

SEQ ID NO: 7610 - protein, 81 aa, Callithrix jacchus
MSQVTFSDVAIDFSHEEWEWLDSAQRDLYKDVMVQNYENLASLGLSITKPHVITLLEDGKEPWMVEEKLSKGVTPDWESRW

SEQ ID NO: 7611 - protein, 81 aa, Callithrix jacchus
ESPAFLTPEVTFSDVAIDFSHEEWEWLDSAQRDLYKDVMVQNYENLASLGLSITKPHVITLLEDGKEPWMVEEKLSKGVTP

SEQ ID NO: 7612 - protein, 81 aa, Callithrix jacchus
ILAHHNLRLPGSSHSASAYQVTFSDVAIDFSHEEWEWLDSAQRDLYKDVMVQNYENLASLGLSITKPHVITLLEDGKEPWM

SEQ ID NO: 7613 - protein, 81 aa, Callithrix jacchus
MSQVTFSDVAIDFSHEEWEWLDSAQRDLYKDVMVQNYENLASLGLSITKPHVITLLEDGKEPWMVEEKMSKGVTPDWESRW

SEQ ID NO: 7614 - protein, 81 aa, Callithrix jacchus
MAAPALALVSFEDVVVTFTGEEWGHLDLAQRTLYQEVMLETFRLLISLGHPVPKPEMIYLLEHGQEPWTEKRGLSQSTCAG

SEQ ID NO: 7615 - protein, 81 aa, Callithrix jacchus
MAAPALALVSFEDVVVTFTGEEWGHLDLAQRTLYQEVMLETFRLLISLGHPVPKPEMIYLLEHGQEPWTEKRGLSQSTCAA

SEQ ID NO: 7616 - protein, 81 aa, Callithrix jacchus
MAAAAAALRDPAQGCVTFKDVTIYFSKEEWGLLDEAQRLLYCDVMLENFALIASLGLISFRSHIVSQLEMGKEPWVPDSMD

SEQ ID NO: 7617 - protein, 81 aa, Callithrix jacchus
MAQGLVTFRDVAIEFSLEEWKCLEPAQRDLYREVTLENFGHLVSLGLSIPKPDVISLLEQGKEPWIIANDVTGPWCPDLES

SEQ ID NO: 7618 - protein, 81 aa, Callithrix jacchus
EFREIRAGQIVLKAMAQGLVTFRDVAIEFSLEEWKCLEPAQRDLYREVTLENFGHLVSLGLSIPKPDVISLLEQGKEPWII

SEQ ID NO: 7619 - protein, 81 aa, Callithrix jacchus
MNMEGLVMFQDLSIDFSQEEWECLNPAQKDLYRDVMMENYSSLLSLGLSIPKPDVISLLEQGKEPWMVSRDILGGWCPDRL

SEQ ID NO: 7620 - protein, 81 aa, Callithrix jacchus
MNMEGLVMFQDLSIDFSQEEWECLNPAQKDLYRDVMMENYSSLLSLGLSIPKPDVISLLEQGKEPWMVSRDILGGWCPDLE

SEQ ID NO: 7621 - protein, 81 aa, Callithrix jacchus
MDVMLENYCHLISVGCHMTKPDVILKLERGEEPWTSFAGHTRLEENWKAEDFLVKFREHREKYSRSDVSINHKKLVKEKNK

SEQ ID NO: 7622 - protein, 81 aa, Callithrix jacchus
MAQGSVSFNDVTVDFTQEEWQHLDHAQKTLYMDVMLENYCHLISVGCHMTKPDVILKLERGEEPWTSFAGHTRLEENWKAE

SEQ ID NO: 7623 - protein, 81 aa, Callithrix jacchus
MAHELVMFRDVAIDVSQEEWECLNPAQRNLYKDVMLENYSNLVSLGLSVSKPAIISSLEQGKEPWMVVREESGRWCPDLAS

SEQ ID NO: 7624 - protein, 81 aa, Callithrix jacchus
MAHELVMFRDVAIDVSQEEWECLNPAQRNLYKDVMLENYSNLVSLGLSVSKPAIISSLEQGKEPWMVVREESGRWCPGTWK

SEQ ID NO: 7625 - protein, 81 aa, Callithrix jacchus
MAHELVMFRDVAIDVSQEEWECLNPAQRNLYKDVMLENYSNLVSLGLSVSKPAIISSLEQGKEPWMVVREESGRWCPGILK

SEQ ID NO: 7626 - protein, 81 aa, Callithrix jacchus
LTHELVMFRDVAIDVSQEEWECLNPAQRNLYKDVMLENYSNLVSLGLSVSKPAIISSLEQGKEPWMVVREESGRWCPGTWK

SEQ ID NO: 7627 - protein, 81 aa, Callithrix jacchus
MPLQGSVSFKDVTVDFTQEEWQQLDPAQKALYRDVMLENYCHFISVGFHMAKPDMIRKLEQGEELWTQRIFPSYSYLEADG

SEQ ID NO: 7628 - protein, 81 aa, Callithrix jacchus
FHMAKPDMIRKLEQGEELWTQRIFPSYSYLEADGKTEDVLVKFKEYQDRHSRSLILINHKKLIKERSNIYGKTLTLGKNHI

SEQ ID NO: 7629 - protein, 81 aa, Callithrix jacchus
MSQGSVSFKDVTVDFTQEEWQQLDPAQKALYRDVMLENYCHFISVGFHMAKPDMIRKLEQGEELWTQRIFPSYSYLEADGK

SEQ ID NO: 7630 - protein, 81 aa, Callithrix jacchus
MPLQGSVSFKDVTVDFTQEEWQQLDPAQKALYRDVMLENYCHFISVGFHMAKPDMIRKLEQGEELWTQRIFPSYSYLADGK

SEQ ID NO: 7631 - protein, 81 aa, Callithrix jacchus
GFHMAKPDMIRKLEQGEELWTQRIFPSYSYLADGKTEDVLVKFKEYQDRHSRSLILINHKKLIKERSNIYGKTLTLGKNHI

SEQ ID NO: 7632 - protein, 81 aa, Callithrix jacchus
MMENYSNLLSLDLESKYDTKLLSVGTDIIKNTGSQWEVMESSKLCGLENSIFRNDWQSKNKAEVQGPKVGYFSQMKTNSQN

SEQ ID NO: 7633 - protein, 81 aa, Callithrix jacchus
YSNLLSLDLESKYDTKLLSVGTDIIKNTGSQWEVMESSKLCGLENSIFRNDWQSKNKAEVQGPKVGYFSQMKTNSQNVPSY

SEQ ID NO: 7634 - protein, 81 aa, Callithrix jacchus
MPEVKFPDQFFTVLTMDHELVTFRDVLINFSQEEWEYLDSAQRNLYWDVMMENYSNLLSLDLESKYDTKLLSVGTDIIKNT

SEQ ID NO: 7635 - protein, 81 aa, Callithrix jacchus
TVLTMDHELVTFRDVLINFSQEEWEYLDSAQRNLYWDVMMENYSNLLSLDLESKYDTKLLSVGTDIIKNTGSQWEVMESSK

SEQ ID NO: 7636 - protein, 81 aa, Callithrix jacchus
MALRSVIFSDISIDFSPEEWEYLDLEQKDLYRDVMLENYSNLVSLGCFISKPDVISLLEQGKEPWKVVRKRRRQYPDLETK

SEQ ID NO: 7637 - protein, 81 aa, Callithrix jacchus
MAHGSVTFRDVAIDFSQEEWEFLDPAQRDLYRDVMWENYSNFISLGPSISKPDVITLLGEEGKEPGMVVREGIGRYCPDLD

SEQ ID NO: 7638 - protein, 81 aa, Callithrix jacchus
MAHGSVTFRDVAIDFSQEEWEFLDPAQRDLYRDVMWENYSNFISLAGPSISKPDVITLLGEEGKEPGMVVREGIGRYCPGE

SEQ ID NO: 7639 - protein, 81 aa, Callithrix jacchus
MAHGSVTFRDVAIDFSQEEWEFLDPAQRDLYRDVMWENYSNFISLDLDSRYRTSTLSLEKDVYEIYSFQWDIMERIKSYSL

SEQ ID NO: 7640 - protein, 81 aa, Callithrix jacchus
CSQEFALSEEEEDTTRSLETVTFKDVAVDLTQEEWEQMKPAQRNLYRDVMLENYSNLVTVGCQVTKPDVIFKLEQEEEPWV

SEQ ID NO: 7641 - protein, 81 aa, Callithrix jacchus
QEEWEQMKPAQRNLYRDVMLENYSNLVTVGCQVTKPDVIFKLEQEEEPWVMEEEMFGRHCPEPRRGENCCASEVMVEVEFH

SEQ ID NO: 7642 - protein, 81 aa, Callithrix jacchus
VDLTQEEWEQMKPAQRNLYRDVMLENYSNLVTVGCQVTKPDVIFKLEQEEEPWVMEEEMFGRHCPEPRRGENCCASEVMVE

SEQ ID NO: 7643 - protein, 81 aa, Callithrix jacchus
EEWEQMKPAQRNLYRDVMLENYSNLVTVGCQVTKPDVIFKLEQEEEPWVMEEEMFGRHCPESCSVTQAGERWCHLGSLQPP

SEQ ID NO: 7644 - protein, 81 aa, Callithrix jacchus
DPEEEERMHDELLQAVSKGSVMFRDVSIDFSQEEWECLDSGQMNLYKEVMLENFSNLVSVGLSSSKPAVISLLEQGREPWM

SEQ ID NO: 7645 - protein, 81 aa, Callithrix jacchus
EEEERMHDELLQAVSKGSVMFRDVSIDFSQEEWECLDSGQMNLYKEVMLENFSNLVSVGLSSSKPAVISLLEQGREPWMVD

SEQ ID NO: 7646 - protein, 81 aa, Callithrix jacchus
MAHLMFRDVAIDFSQEEWEGLDLKQRDLYRDVMLENYSNMVSLGFCVYQPDVFSLLEKGKEPWKILRDETRGPCPDMQSRC

SEQ ID NO: 7647 - protein, 81 aa, Callithrix jacchus
CQVGLIRSYNSKTMTCFQELVTFRDVAIDFSGQEWEYLDPHQRDLYRDVMLENYRNLVSLGGHSISKPVLVDLLEQGKEPW

SEQ ID NO: 7648 - protein, 81 aa, Callithrix jacchus
CQVGLIRSYNSKTMTCFQELVTFRDVAIDFSGQEWEYLDPHQRDLYRDVMLENYRNLVSLEMRSYCVAQVGPKLLVSSDPP

SEQ ID NO: 7649 - protein, 81 aa, Callithrix jacchus
TCNWRRPLKCCPTKYVKFQELVTFRDVAIDFSGQEWEYLDPHQRDLYRDVMLENYRNLVSLGGHSISKPVLVDLLEQGKEP

SEQ ID NO: 7650 - protein, 81 aa, Callithrix jacchus
ELCQVGLIRSYNSKTMTCELVTFRDVAIDFSGQEWEYLDPHQRDLYRDVMLENYRNLVSLGGHSISKPVLVDLLEQGKEPW

SEQ ID NO: 7651 - protein, 81 aa, Callithrix jacchus
CNWRRPLKCCPTKYVKFQELVTFRDVAIDFSGQEWEYLDPHQRDLYRDVMLENYRNLVSLGGHSISKPVLVDLLEQGKEPW

SEQ ID NO: 7652 - protein, 81 aa, Callithrix jacchus
MLENYRNLVSLGGHSISKPVLVDLLEQGKEPWMILREETQFPDLDLQCEIFSYIEVPTYDTDISSIQHQTIYQREKLYECK

SEQ ID NO: 7653 - protein, 81 aa, Callithrix jacchus
MACRSITFRDVAIDFSHQEWEYLNLVQKTLYQEVMMENYDNLVSLGHSISKPDLITLLEQGKEPWMIVREETRGECTDLDS

SEQ ID NO: 7654 - protein, 81 aa, Callithrix jacchus
MAHDLVMFRDVAVDFSQEEWECLNSYQRNLYRDVILENYSNLVSLGCSISKPDVITLLEQGKEPWLVERDEKRRWSLDLES

SEQ ID NO: 7655 - protein, 81 aa, Callithrix jacchus
MAHDLVMFRDVAVDFSQEEWECLNSYQRNLYRDVILENYSNLVSLAGCSISKPDVITLLEQGKEPWLVERDEKRRWSLDLE

SEQ ID NO: 7656 - protein, 81 aa, Callithrix jacchus
MAHDLVMFRDVAVDFSQEEWECLNSYQRNLYRDVILENYSNLVSLGCSISKPDVITLLEQGKEPWLVERDEKRRWSLGPTF

SEQ ID NO: 7657 - protein, 81 aa, Callithrix jacchus
MAHALVTFRDVAINFSQKEWECLDPTQRKLYRDVMLENYSNLVSLGYSGSKPDVITLLEQGKEPCVAVRDMTGRQYPGLLS

SEQ ID NO: 7658 - protein, 81 aa, Callithrix jacchus
MAHALVTFRDVAINFSQKEWECLDPTQRKLYRDVMLENYSNLVSLGLLSRHKTKKLSSEKDIHEISFSKGNIIEKSKTLHL

SEQ ID NO: 7659 - protein, 81 aa, Callithrix jacchus
MAHALVTFRDVAINFSQKEWECLDPTQRKLYRDVMLENYSNLVSLAGYSGSKPDVITLLEQGKEPCVAVRDMTGRQYPGLL

SEQ ID NO: 7660 - protein, 81 aa, Callithrix jacchus
MPHLLVTFRDVAIDFSQEEWECLDPAQRDLYRDVMLENYSNLISLDLESSHEINELSPEKEIYEMESLQWENMGKFINHHL

SEQ ID NO: 7661 - protein, 81 aa, Callithrix jacchus
MDLLFQLLVTFRDVAIDFSQEEWECLDPAQRDLYRDVMLENYSNLISLDLESSHEINELSPEKEIYEMESLQWENMGKFIN

SEQ ID NO: 7662 - protein, 81 aa, Callithrix jacchus
MINYQTPVSFRDVVVGFTQEEWHRLNPTQRALYRDVMLETYSNLVSVGYEGTKPDVILRLEQEEAPWIGEAACLGCHCWED

SEQ ID NO: 7663 - protein, 81 aa, Callithrix jacchus
MINYQTPVSFRDVVVGFTQEEWHRLNPTQRALYRDVMLETYSNLVSVGYEGTKPDVILRLEQEEAPWIGEAACLGCHCWGI

SEQ ID NO: 7664 - protein, 81 aa, Callithrix jacchus
VVVGFTQEEWHRLNPTQRALYRDVMLETYSNLVSVGYEGTKPDVILRLEQEEAPWIGEAACLGCHCWGISKPWPADWPPAL

SEQ ID NO: 7665 - protein, 81 aa, Callithrix jacchus
MINYQTPVSFRDVVVGFTQEEWHRLNPTQRALYRDVMLETYSNLVSVGYEGTKPDVILRLEQEEAPWIGEAACLGCHCWGK

SEQ ID NO: 7666 - protein, 81 aa, Callithrix jacchus
EWHRLNPTQRALYRDVMLETYSNLVSVGYEGTKPDVILRLEQEEAPWIGEAACLGCHCWGKCDKSGKRGPEGGHLWNFVQC

SEQ ID NO: 7667 - protein, 81 aa, Callithrix jacchus
EWHRLNPTQRALYRDVMLETYSNLVSVGYEGTKPDVILRLEQEEAPWIGEAACLGCHCWEDIWKVNIQRKRRQDVLLRQGA

SEQ ID NO: 7668 - protein, 81 aa, Callithrix jacchus
SFRDVVVGFTQEEWHRLNPTQRALYRDVMLETYSNLVSVGYEGTKPDVILRLEQEEAPWIGEAACLGCHCWALTYLRELQP

SEQ ID NO: 7669 - protein, 81 aa, Callithrix jacchus
RDVVVGFTQEEWHRLNPTQRALYRDVMLETYSNLVSVGYEGTKPDVILRLEQEEAPWIGEAACLGCHCWALTYLRELQPHE

SEQ ID NO: 7670 - protein, 81 aa, Callithrix jacchus
MAVGLLKAMYQELVTFRDVAVDFSQEEWDCLDSSQRHLYSNVMLENYRILVSLGLCFSKPGVILLLEQGKAPWMVKRELTK

SEQ ID NO: 7671 - protein, 81 aa, Callithrix jacchus
PLCETEELTPKQEFYEEHQSQQIIETLTRYNLEYSSLREEWKCKGYFERQPGNQKACFKEEIITHEEALVNEREQEYKSWG

SEQ ID NO: 7672 - protein, 81 aa, Callithrix jacchus
KSQQEGRMAVGLLKAMYQELVTFRDVAVDFSQEEWDCLDSSQRHLYSNVMLENYRILVSLGLCFSKPGVILLLEQGKAPWM

SEQ ID NO: 7673 - protein, 81 aa, Callithrix jacchus
QGKAPWMVKRELTKGLCSGWAPLCETEELTPKQEFYEEHQSQQIIETLTRYNLEYSSLREEWKCKGYFERQPGNQKACFKE

SEQ ID NO: 7674 - protein, 81 aa, Callithrix jacchus
ASAGPIPSQKEEEMTESQGTVTFKDVAIDFTQEEWKRLDPAQRNLYRNVMLENYNNLITVGYPFTKPDVIFKLEQEEEPWV

SEQ ID NO: 7675 - protein, 81 aa, Callithrix jacchus
LCRGPIPSQKEEEMTESQGTVTFKDVAIDFTQEEWKRLDPAQRNLYRNVMLENYNNLITVGYPFTKPDVIFKLEQEEEPWV

SEQ ID NO: 7676 - protein, 81 aa, Callithrix jacchus
MTESQEEWKRLDPAQRNLYRNVMLENYNNLITVGYPFTKPDVIFKLEQEEEPWVMEEEVLRRHWQGEIWGVDEHQKSQDRL

SEQ ID NO: 7677 - protein, 81 aa, Callithrix jacchus
MAVGLCKAMSQGLVTFRDVALDFSQEEWEWLKPSQKDLYRDVMLENYRNLVWLGLSFSKPNMISLLEQGKEPWMVERKMSQ

SEQ ID NO: 7678 - protein, 81 aa, Callithrix jacchus
MAVGLCKAMSQGLVTFRDVALDFSQEEWEWLKPSQKDLYRDVMLENYRNLVWLGDGCSCCSTLRTTGMAEASSSSSSIQVS

SEQ ID NO: 7679 - protein, 81 aa, Callithrix jacchus
MAVGLCKAMSQGLVTFRDVALDFSQEEWEWLKPSQKDLYRDVMLENYRNLPNMISLLEQGKEPWMVERKMSQGHCADWESW

SEQ ID NO: 7680 - protein, 81 aa, Callithrix jacchus
MAVGLCKAMSQGLVTFRDVALDFSQEEWEWLKPSQKDLYRDVMLENYRNLVWLDWESWCDVKELSPKWFTEEDEISQEVVM

SEQ ID NO: 7681 - protein, 81 aa, Callithrix jacchus
TPQETRKMATELLRAKKEAFVAFRDVAVDFTQEEWRLLSPAQRTLHREVMLETYNHLVSLEIPSSKPKLIVQLKRGEEPWR

SEQ ID NO: 7682 - protein, 81 aa, Callithrix jacchus
PCVVLRQTMNCSRAGGITAFVAFRDVAVDFTQEEWRLLSPAQRTLHREVMLETYNHLVSLEIPSSKPKLIVQLKRGEEPWR

SEQ ID NO: 7683 - protein, 81 aa, Callithrix jacchus
MATELLRAKKEAFVAFRDVAVDFTQEEWRLLSPAQRTLHREVMLETYNHLVSLEIPSSKPKLIVQLKRGEEPWREERKCSL

SEQ ID NO: 7684 - protein, 81 aa, Callithrix jacchus
MATELLRAKKEEEWRLLSPAQRTLHREVMLETYNHLVSLEIPSSKPKLIVQLKRGEEPWREERKCSLDLRPAGSKPEIQLC

SEQ ID NO: 7685 - protein, 81 aa, Callithrix jacchus
MAEGSVMFSDVSIDFSQEEWDCLDPVQRALYRDVMLENYSNLVLMGLHTPKPQVISLLEQGKEPWMVGRELTRGLCSDLES

SEQ ID NO: 7686 - protein, 81 aa, Callithrix jacchus
MAEGSVMFSDVSIDFSQEEWDCLDPVQRALYRDVMLENYSNLVLMGKGIHTNASQFSSGMSASSTVSFSAAFQDFILLSLR

SEQ ID NO: 7687 - protein, 81 aa, Callithrix jacchus
SPQKSPALAPEDHGSSYEGSVSFRDVAINFSREEWRHLDLSQRNLYWDVMLETYSHLLSVGYQFPKPEVVMLEQGNEPWAL

SEQ ID NO: 7688 - protein, 81 aa, Callithrix jacchus
HGSSYEGSVSFRDVAINFSREEWRHLDLSQRNLYWDVMLETYSHLLSVGYQFPKPEVVMLEQGNEPWALQGERPRHSCPGE

SEQ ID NO: 7689 - protein, 81 aa, Callithrix jacchus
GSVSFRDVAINFSREEWRHLDLSQRNLYWDVMLETYSHLLSVGYQFPKPEVVMLEQGNEPWALQGERPRHSCPGEKLWDHN

SEQ ID NO: 7690 - protein, 81 aa, Callithrix jacchus
REEWRHLDLSQRNLYWDVMLETYSHLLSVGYQFPKPEVVMLEQGNEPWALQGERPRHSCPGEKLWDHNLRRKILSYKPASS

SEQ ID NO: 7691 - protein, 81 aa, Callithrix jacchus
SPQKSPALALEDHGNSYEGSVSFRDVAIDFSREEWRHLDPSQRNLYRDVMLETYSHLLSVGYQVPEAEVVMLEQGNEPWAL

SEQ ID NO: 7692 - protein, 81 aa, Callithrix jacchus
LAPEDHGSSYEGSVSFRDVAIDFSREEWRHLDPSQRNLYRDVMLETYSHLLSVGYQVPEAEVVMLEQGNEPWALQGERPHQ

SEQ ID NO: 7693 - protein, 81 aa, Callithrix jacchus
REEWRHLDPSQRNLYRDVMLETYSHLLSVGYQVPEAEVVMLEQGNEPWALQGERPHQSCPVTHWLPFPSTMTKSFLGLTRR

SEQ ID NO: 7694 - protein, 81 aa, Callithrix jacchus
MAWKVVMFRDVAIDFSQEEWECLDAAQRDLYRDVMLENYSNLVSLDLPLRCARKDLSPEKNTYETELSQWEVSDRLEKCDL

SEQ ID NO: 7695 - protein, 81 aa, Callithrix jacchus
YETELSQWEVSDRLEKCDLEESNSRDYLEAKAEMERQQENQREYFRQGMIIYDKMSIFNQHTYLSQHSKCHSTEKPYKCKE

SEQ ID NO: 7696 - protein, 81 aa, Callithrix jacchus
MAVSVAMSKKVVMFRDVAIDFSQEEWECLDAAQRDLYRDVMLENYSNLVSLDLPLRCARKDLSPEKNTYETELSQWEVSDR

SEQ ID NO: 7697 - protein, 81 aa, Callithrix jacchus
EEAQGELTSSCGAKTMAHVSLAFRDVSIDLSQEEWECLDPAQRDLYKDVMFENYSNLVSLGYTIPKPDVITLLEQEKEPWI

SEQ ID NO: 7698 - protein, 81 aa, Callithrix jacchus
GRSTRKIDQFCNSKNMVHGSVTFRDVAIDFSQEEWECLQPAQKTLYRDVMLENYSHLISLGSSVSKPDVITLLEQEKEPWM

SEQ ID NO: 7699 - protein, 81 aa, Callithrix jacchus
MLENYSHLISLGSSVSKPDVITLLEQEKEPWMVVRKETSRWYPDLESKCGPEKISLENDISEINLPKQFIKQISKTLGLEA

SEQ ID NO: 7700 - protein, 81 aa, Callithrix jacchus
MVHGSVTFRDVAIDFSQEEWECLQPAQKTLYRDVMLENYSHLISLAGSSVSKPDVITLLEQEKEPWMVVRKETSRWYPDLE

SEQ ID NO: 7701 - protein, 81 aa, Callithrix jacchus
MVHGSVTFRDVAIDFSQEEWECLQPAQKTLYRDVMLENYSHLISLGSSVSKPDVITLLEQEKEPWMVVRKETSRWYPDLES

SEQ ID NO: 7702 - protein, 81 aa, Callithrix jacchus
MVHGSVTFRDVAIDFSQEEWECLQPAQRTLYRDVMLENYSHLISLGSSISKPDVITLLEQEKEPWMVIRKETNRWYPDLES

SEQ ID NO: 7703 - protein, 81 aa, Callithrix jacchus
IEESHGALINCWNSRTMTDGLVTFRDVAIDFSQEEWECLDPAQRDLYVDVMLENYSNLVSLVSLKNVPLASELYCIWSQQH

SEQ ID NO: 7704 - protein, 81 aa, Callithrix jacchus
EESHGALINCWNSRTMTDGLVTFRDVAIDFSQEEWECLDPAQRDLYVDVMLENYSNLVSLDLESTTYDAKKIFSEKDIFEI

SEQ ID NO: 7705 - protein, 81 aa, Callithrix jacchus
MTARKKLLTGEVLEENFDSEHVSLPRVTATGCSRADGVLLFLSSSWNYSSGFSGLCASPIEESHGALINCWNSRTMTDGLV

SEQ ID NO: 7706 - protein, 81 aa, Callithrix jacchus
KSCSGFSGLCASPIEESHGALINCWNSRTMTDGLVTFRDVAIDFSQEEWECLDPAQRDLYVDVMLENYSNLVSLGKVICLK

SEQ ID NO: 7707 - protein, 81 aa, Callithrix jacchus
MTKSGEAVTFKDVAVVFSEEELRLLDLTQRKLYRDVMLENFRNVVSVGHQSIPDGLLQSEREEKLWMMKTATQRDKSSGGK

SEQ ID NO: 7708 - protein, 81 aa, Callithrix jacchus
ATGENPYKYEECGRNVGKSSHCQTPLIVHTGEKPYKCEDCGVSFSQRSYLQVHLKVHTGKKPYKCEECGKSFSWRSRLQAH

SEQ ID NO: 7709 - protein, 81 aa, Callithrix jacchus
STNLALLQKEEDKMTKSGEAVTFKDVAVVFSEEELRLLDLTQRKLYRDVMLENFRNVVSVGHQSIPDGLLQSEREEKLWMM

SEQ ID NO: 7710 - protein, 81 aa, Callithrix jacchus
MLENFRNVVSVGHQSIPDGLLQSEREEKLWMMKTATQRDKSSGGKHLKEMETLQEVGLRYLPHEELFCSQIWQQITRELTK

SEQ ID NO: 7711 - protein, 81 aa, Callithrix jacchus
MTTIKEAVTFKDVTVVFTEEELGLLDPAQRKLYRDVMLENFRNLLSIGNQPFHEDTFHFLRKEKFWMMKTTSQREGNLGGK

SEQ ID NO: 7712 - protein, 81 aa, Callithrix jacchus
HFLRKEKFWMMKTTSQREGNLGGKIQIETVPEAGPHEEWSCQQIWEQITSDLTRSQDPLINSSQFFKEGDIPCQIEADLSI

SEQ ID NO: 7713 - protein, 81 aa, Callithrix jacchus
MTSFKEAVTFKDVAVFFTEEELGLLDLAQRKLYRDVMLENFRNLLSVGHQPFHQDVFHFLREEKFWMMETATQREGNSGGK

SEQ ID NO: 7714 - protein, 81 aa, Callithrix jacchus
FKDVAVFFTEEELGLLDLAQRKLYRDVMLENFRNLLSVGHQPFHQDVFHFLREEKFWMMETATQREGNSGGKIQTELESVP

SEQ ID NO: 7715 - protein, 81 aa, Callithrix jacchus
LREEKFWMMETATQREGNSGGKIQTELESVPEAGTHEEWSCQQIWEQTTSDLTRSQDSIINNSQFFAHGDLPSQVEAGLYI

SEQ ID NO: 7716 - protein, 81 aa, Callithrix jacchus
VMKRTVLVFYKIMEEAVTFKDVAVFFTEEELGLLDLAQRKLYRDVMLENFRNLLSVGHQPFHQDVFHFLREEKFWMMETAT

SEQ ID NO: 7717 - protein, 81 aa, Callithrix jacchus
EEKFWMMETATQREGNSGGKIQTELESVPEAGTHEEWSCQQIWEQTTSDLTRSQDSIINNSQFFAHGDLPSQVEAGLYIIH

SEQ ID NO: 7718 - protein, 81 aa, Callithrix jacchus
LDLAQRKLYRDVMLENFRNLLSVGHQPFHQDVFHFLREEKFWMMETATQREGNSGGKIQTELESVPEAGTHEEWSCQQIWE

SEQ ID NO: 7719 - protein, 81 aa, Callithrix jacchus
DVMLENFRNLLSVGHQPFHQDVFHFLREEKFWMMETATQREGNSGGKIQTELESVPEAGTHEEWSCQQIWEQTTSDLTRSQ

SEQ ID NO: 7720 - protein, 81 aa, Callithrix jacchus
EAVTFKDVAVFFTEEELGLLDLAQRKLYRDVMLENFRNLLSVGHQPFHQDVFHFLREEKFWMMETATQREGNSGENASVHP

SEQ ID NO: 7721 - protein, 81 aa, Callithrix jacchus
VTFKDVAVFFTEEELGLLDLAQRKLYRDVMLENFRNLLSVGHQPFHQDVFHFLREEKFWMMETATQREGNSGENASVHPYT

SEQ ID NO: 7722 - protein, 81 aa, Callithrix jacchus
HSGLCKFPEVGGKMTTSKEAVTFKDVAVVFTEEELGLLDPAQRRLYRDVMLENFRNLLSVGHQPFNRDTFYFLREEKFWMM

SEQ ID NO: 7723 - protein, 81 aa, Callithrix jacchus
MTTSKEAVTFKDVAVVFTEEELGLLDPAQRRLYRDVMLENFRNLLSVGHQPFNRDTFYFLREEKFWMMDIATQREGNSGGK

SEQ ID NO: 7724 - protein, 81 aa, Callithrix jacchus
MYPTCTRAEAPQKEAVTFKDVAVVFTEEELGLLDPAQRRLYRDVMLENFRNLLSVGHQPFNRDTFYFLREEKFWMMDIATQ

SEQ ID NO: 7725 - protein, 81 aa, Callithrix jacchus
MFKEAVTFKDVAVVFTEEELGLLGPAQRKLYRDVMLENFRNLLSVGHQPFHRDTFHLQREEKFWMMETATQREGNSGGKIQ

SEQ ID NO: 7726 - protein, 81 aa, Callithrix jacchus
QREEKFWMMETATQREGNSGGKIQTELESVPETGPHEEWSCQQIWEQIAGNLTRPQDSMISSSQFYTQGDVPSQADAGLSI

SEQ ID NO: 7727 - protein, 81 aa, Callithrix jacchus
HSVLRKFPEVRGKMTTFTEAVTFKDVAVVFTEEELGLLDPAQRKLYRDVMLENFGNLLSVGQQAFNRDTFQFLREEKVWMM

SEQ ID NO: 7728 - protein, 81 aa, Callithrix jacchus
FLREEKVWMMKTATQREGNSGGKIQTEMKPVSEAGTHQEWSCQQIWEKIVSDLTRSQASVIHSSQFSKQSDLPCQTEAGLS

SEQ ID NO: 7729 - protein, 81 aa, Callithrix jacchus
MTTFTEAVTFKDVAVVFTEEELGLLDPAQRKLYRDVMLENFGNLLSVGQQAFNRDTFQFLREEKVWMMKTATQREGNSGGK

SEQ ID NO: 7730 - protein, 81 aa, Callithrix jacchus
MGIIKQIRTELLNVAKEAVTFKDVAVVFTEEELGLLDPAQRKLYRDVMLENFGNLLSVGQQAFNRDTFQFLREEKVWMMKT

SEQ ID NO: 7731 - protein, 81 aa, Callithrix jacchus
KYIFLWRNKFISGYSTIKETVTFKDVAVVFTEEELQLLDPAQKKLYQDVMLENFRNLLSVGHQPFHGDTFHFPREEKFWMV

SEQ ID NO: 7732 - protein, 81 aa, Callithrix jacchus
MTTLKETVTFKDVAVVFTEEELQLLDPAQKKLYQDVMLENFRNLLSVGHQPFHGDTFHFPREEKFWMVETATQKEGNLGGK

SEQ ID NO: 7733 - protein, 81 aa, Callithrix jacchus
DPAQKKLYQDVMLENFRNLLSVGHQPFHGDTFHFPREEKFWMVETATQKEGNLGGKIQTEMETVPEQGTHEGLFSHQTWEQ

SEQ ID NO: 7734 - protein, 81 aa, Callithrix jacchus
RNLLSVGHQPFHGDTFHFPREEKFWMVETATQKEGNLGGKIQTEMETVPEQGTHEGLFSHQTWEQISSDLTRFQDSMVNSS

SEQ ID NO: 7735 - protein, 81 aa, Callithrix jacchus
MTTLKETVTFKDVAVVFTEEELQLLDPAQKKLYQDVMLENFRNLLSVGHQPFHGDTFHFPREEKFWMVETATQKEGNLGPA

SEQ ID NO: 7736 - protein, 81 aa, Callithrix jacchus
KDVAVVFTEEELQLLDPAQKKLYQDVMLENFRNLLSVGHQPFHGDTFHFPREEKFWMVETATQKEGNLGPAFQIPIKTEGF

SEQ ID NO: 7737 - protein, 81 aa, Callithrix jacchus
MTTLKETVTFKDVAVVFTEEELQLLDPAQKKLYQDVMLENFRNLLSVGHQPFHGDTFHFPREEKFWMVETATQKEGNLDGV

SEQ ID NO: 7738 - protein, 81 aa, Callithrix jacchus
NSGLCKFPETGGKMTTFKEGLTFKDVAVVFTEEELGLLDPVQRNLYRDVMLENFRNLLSVERRGNVAKKILRRKMRGWSCW

SEQ ID NO: 7739 - protein, 81 aa, Callithrix jacchus
MTTFKEGLTFKDVAVVFTEEELGLLDPVQRNLYRDVMLENFRNLLSVADKIQSEMEAGPHEELSWGQIWKQIASDLVKYED

SEQ ID NO: 7740 - protein, 81 aa, Callithrix jacchus
MTTFKEGLTFKDVAVVFTEEELGLLDPVQRNLYRDVMLENFRNLLSVERRGNVAKKILRRKMRGWSCWLRDDRDRRKSMSD

SEQ ID NO: 7741 - protein, 81 aa, Callithrix jacchus
MNMFKEAVTFKDVAVAFTEEELGLLGPAQRKLYQEVMVENFRNLLSVGHQPFKRDVSPIERKEQLCIMKTATQRQRNLGEN

SEQ ID NO: 7742 - protein, 81 aa, Callithrix jacchus
VGHQPFKRDVSPIERKEQLCIMKTATQRQRNLGENNQSKLMTVEDRESEEELSCWQIWQQIASDLTRCQDFMINNSQFHKQ

SEQ ID NO: 7743 - protein, 81 aa, Callithrix jacchus
MNMFKEAVTFKDVAVAFTEEELGLLGPAQRKLYQEVMVENFRNLLSVGHQPFKRDVSPIERKEQLCIMKTATQRQRNLGKN

SEQ ID NO: 7744 - protein, 81 aa, Callithrix jacchus
VTFKDVAVAFTEEELGLLGPAQRKLYQEVMVENFRNLLSVGHQPFKRDVSPIERKEQLCIMKTATQRQRNLGKNTVVSSYS

SEQ ID NO: 7745 - protein, 81 aa, Callithrix jacchus
MNMFKEAVTFKDVAVAFTEEELGLLGPAQRKLYQEVMVENFRNLLSVGHQPFKRDVSPIERKEQLCIMKTATQRQRNLDTL

SEQ ID NO: 7746 - protein, 81 aa, Callithrix jacchus
AVAFTEEELGLLGPAQRKLYQEVMVENFRNLLSVGHQPFKRDVSPIERKEQLCIMKTATQRQRNLDTLLVKAVLFYDLAQT

SEQ ID NO: 7747 - protein, 81 aa, Callithrix jacchus
MVENFRNLLSVGHQPFKRDVSPIERKEQLCIMKTATQRQRNLGENNQSKLMTVEDRESEEELSCWQIWQQIASDLTRCQDF

SEQ ID NO: 7748 - protein, 81 aa, Callithrix jacchus
RKEQLCIMKTATQRQRNLGENNQSKLMTVEDRESEEELSCWQIWQQIASDLTRCQDFMINNSQFHKQDDFHCQVGAGLSIQ

SEQ ID NO: 7749 - protein, 81 aa, Callithrix jacchus
IERKEQLCIMKTATQRQRNLGENNQSKLMTVEDRESEEELSCWQIWQQIASDLTRCQDFMINNSQFHKQDDFHCQVGAGLS

SEQ ID NO: 7750 - protein, 81 aa, Callithrix jacchus
SQDYDFPQKQQEKMTKFQEAVTFKDVAVVFSSEELRLLDLTQRKLYRDVMVENFKNLVAVGHLPFQSDMVSQLEAEEKLWM

SEQ ID NO: 7751 - protein, 81 aa, Callithrix jacchus
SQDYDFPQKQQEKMTKFQEAVTFKDVAVVFSSEELRLLDLTQRKLYRDVMVENFKNLVAVGSKHQNKVETLRKFALKYLSN

SEQ ID NO: 7752 - protein, 81 aa, Callithrix jacchus
LSQDYDFPQKQQEKMTKFQEAVTFKDVAVVFSSEELRLLDLTQRKLYRDVMVENFKNLVAVGHLPFQSDMVSQLEAEEKLW

SEQ ID NO: 7753 - protein, 81 aa, Callithrix jacchus
MTKFQEAVTFKDVAVVFSSEELRLLDLTQRKLYRDVMVENFKNLVAVGHLPFQSDMVSQLEAEEKLWMMEAETQRSRYSGE

SEQ ID NO: 7754 - protein, 81 aa, Callithrix jacchus
MTKFQEAVTFKDVAVAFTEEELGLLDSAQRKLYRDVMLENFRNLVSVGRQSFKPDMISQLEREEKLWMKEFQTQRGDRNQN

SEQ ID NO: 7755 - protein, 81 aa, Callithrix jacchus
MVTFKDVAVVFTEEELGLLDCVQRKLYRDVMLENFRNLLLVAHQPFKPDLISQLEREEKLLMVETETPRDGCSGRKNQQMM

SEQ ID NO: 7756 - protein, 81 aa, Callithrix jacchus
MIKFQEMVTFKDVAVVFTEEELGLLDCVQRKLYRDVMLENFRNLLLVAHQPFKPDLISQLEREEKLLMVETETPRDGCSGR

SEQ ID NO: 7757 - protein, 81 aa, Callithrix jacchus
MIKLQMVTFKDVAVVFTEEELGLLDCVQRKLYRDVMLENFRNLLLVAHQPFKPDLISQLEREEKLLMVETETPRDGCSGRK

SEQ ID NO: 7758 - protein, 81 aa, Callithrix jacchus
MIKLQEGVTFKDVAVVFTKEELALLDKTQINLYQDVMLENFRNLISVGDRIENNILNLQEKGLSYLSQEVLHCWQIWKQRI

SEQ ID NO: 7759 - protein, 81 aa, Callithrix jacchus
LTQVLTPQSWRKVNIMTKPQNSQGRFKGIYMEEKLYRRVWHDDYLNWTSHDHEESQECKGEDPGRLPNCGKNLGVKSTVEQ

SEQ ID NO: 7760 - protein, 81 aa, Callithrix jacchus
EIIIKVEGEDTESLTIPSQEGVNFKIVTVDFTQEEQGTWNPAQRSLDRDILESHRDLVSWDLATAVGKEDSTSKQNIFDEE

SEQ ID NO: 7761 - protein, 81 aa, Callithrix jacchus
ESMEEQDEKPPEPPKACAQEGVNFKIVTVDFTQEEQGTWNPAQRSLDRDILESHRDLVSWDLATAVGKEDSTSKQNIFDEE

SEQ ID NO: 7762 - protein, 81 aa, Callithrix jacchus
AQDSLLPQEIIIKVEGEDTESLTIPSQEEQGTWNPAQRSLDRDILESHRDLVSWDLATAVGKEDSTSKQNIFDEEPANGVK

SEQ ID NO: 7763 - protein, 81 aa, Callithrix jacchus
MAEEFVTLKDVAMDFALEDWEQFGLDQGDLFWDTALENYQNLFLLNPPRPNLTSHADGSEDLEPLARGSPEAMGPDLAETT

SEQ ID NO: 7764 - protein, 81 aa, Callithrix jacchus
MDFALEDWEQFGLDQGDLFWDTALENYQNLFLLNPPRPNLTSHADGSEDLEPLARGSPEAMGPDLAETTTNSLMQDFLEEG

SEQ ID NO: 7765 - protein, 81 aa, Callithrix jacchus
MANRTLMAAGQESVTFKDVAVDFTLEEWGWLEPGQRELYRDVMLENYRNLLSLGAGLPGSKPDVISRLERGEEPRPEEREA

SEQ ID NO: 7766 - protein, 81 aa, Callithrix jacchus
FSQKPQVLGPEEQDGSCEASVSFEDVTMAFSREEWQQLDPAQKRLYQDVMLELYSHLFSVGYQIPNPDVIFRRLKEKEPCT

SEQ ID NO: 7767 - protein, 81 aa, Callithrix jacchus
NAVIVMSVRSEQGSSSGEGLLSFEDVAVDFTREEWQFLDPSQKVLYKEVMSENYRNLVSVGYQGTKPDSLFKLERGKPPWI

SEQ ID NO: 7768 - protein, 81 aa, Callithrix jacchus
MLENYSNLVSVGYQASKPDALSKLEQGEPWTIENEIHSQVCPENKKVDNHLQMHSRNQRCLKRVEQCHKHNAFGSIIHQRK

SEQ ID NO: 7769 - protein, 81 aa, Callithrix jacchus
MITSQESLTLEDVAVEFTWEEWQLLGPSQKDLYRDVMLENYSNLVSVGYQASKPDALSKLEQGEPWTIENEIHSQVCPENK

SEQ ID NO: 7770 - protein, 81 aa, Callithrix jacchus
MKKLRRGKAKESGMALPQGPLTFRDVAIEFSQEEWRCLDPTQKALYKDVMLENYRNLVFLGISPKCMIKELPPTENSNTRE

SEQ ID NO: 7771 - protein, 81 aa, Callithrix jacchus
MALTQGSLTFKDVAIEFSQEEWKCLDPVQKALYRDVMLENYRNLGFLGLCLPDLDIISMLEQGKEPWTVVSQVKITRNPNC

SEQ ID NO: 7772 - protein, 81 aa, Callithrix jacchus
KITRNPNCGECMKGVITGISPKCVIKELPPIHNSNTRETFQMVMLEGHESGDIENFYFREIQKNLQDLDFQRKDGEVNYKE

SEQ ID NO: 7773 - protein, 81 aa, Callithrix jacchus
EAQKRKKKEKESGMALTQGSLTFKDVAIEFSQEEWKCLDPVQKALYRDVMLENYRNLGFLGLCLPDLDIISMLEQGKEPWT

SEQ ID NO: 7774 - protein, 81 aa, Callithrix jacchus
VYPGADRFPQQKKMLNAQESLTLEDVMVEFTWEEWQLLDPSQKDLYRDVMLEIYSNLVSVGFQVSKPDALSKLERGEEPWT

SEQ ID NO: 7775 - protein, 81 aa, Callithrix jacchus
MLNAQESLTLEDVMVEFTWEEWQLLDPSQKDLYRDVMLEIYSNLVSVGFQVSKPDALSKLERGEEPWTIGDERHSRICPEN

SEQ ID NO: 7776 - protein, 81 aa, Callithrix jacchus
MIKTQESLTLEDVAVEFSWEEWQLLDTAQKDLYRDVMVENYNHLVSLGYQTSKPDALSKLAHGQEPWITDAKIQNKNCPGI

SEQ ID NO: 7777 - protein, 81 aa, Callithrix jacchus
MRPELTNFWEESLTLEDVAVGFTREEWQLLGPAQKDLYRDVMLENYSNLVAVGYPASKPDALLKLERGEEPCCTTEDEIYT

SEQ ID NO: 7778 - protein, 81 aa, Callithrix jacchus
MESLTLEDVAVGFTREEWQLLGPAQKDLYRDVMLENYSNLVAVGYPASKPDALLKLERGEEPCCTTEDEIYTQICSEIRKI

SEQ ID NO: 7779 - protein, 81 aa, Callithrix jacchus
MIQTQESLTLEDVAVDFTREEWQLLGPAQKDLYRDVMLENYSNLVAVGYQASKPDALFKLGQGQPPWTVKDGIHSGACSEI

SEQ ID NO: 7780 - protein, 81 aa, Callithrix jacchus
AYMSCLVKHKRIHTREKQEAATVENPPAERHSLLHTSDVMQEKSSASMVTTQLPSMAPQTSFNISGLLANRNVVLVGQPVV

SEQ ID NO: 7781 - protein, 81 aa, Callithrix jacchus
MIQTQESLTLEDVAVDFTREEWQLLGPAQKDLYRDVMLENYSNLVAVGYQASKPDALFKLGQGQPPWTVKDGIHSGACSGS

SEQ ID NO: 7782 - protein, 81 aa, Callithrix jacchus
MALTQGPLTFRDVTIQFSQEEWRCLDPAQKALYKDVMLENYRNLVFLGIIPKCTTKELPPTGNSNTGEKFRTMTLERHECC

SEQ ID NO: 7783 - protein, 81 aa, Callithrix jacchus
LCKVQGPLTFRDVTIQFSQEEWRCLDPAQKALYKDVMLENYRNLVFLGIIPKCTTKELPPTGNSNTGEKFRTMTLERHECC

SEQ ID NO: 7784 - protein, 81 aa, Callithrix jacchus
LDPAQKALYKDVMLENYRNLVFLGIIPKCTTKELPPTGNSNTGEKFRTMTLERHECCDIEDIYSRETQKNLQDLEFQWKDG

SEQ ID NO: 7785 - protein, 81 aa, Callithrix jacchus
MAQLRRGPLTFRDVAIEFSQEEWKCLDPAQRTLYRDVMLENYRNLVSLGMCLPDLSIISMMKQRTEPWTVESEMKVAKHPA

SEQ ID NO: 7786 - protein, 81 aa, Callithrix jacchus
GPLTFRDVAIEFSQEEWKCLDPAQRTLYRDVMLENYRNLVSLGMCLPDLSIISMMKQRTEPWTVESEMKVAKHPARWEGMK

SEQ ID NO: 7787 - protein, 81 aa, Callithrix jacchus
EKFISHSSSVSPLPNISYGVKTCIFNKLRNDFVDFPLLSPEQKARIRSKPDKCKEQSKVFRVSSSFPNPQAVHTADKANRC

SEQ ID NO: 7788 - protein, 81 aa, Callithrix jacchus
MLENYRNLVSLGMCLPDLSIISMMKQRTEPWTVESEMKVAKHPARWEGMKDISTGRRCAVSSKTGNNRVTNPLGLTFRLPL

SEQ ID NO: 7789 - protein, 81 aa, Callithrix jacchus
AQKRRKRKAKEAGMALPQGHLTFTDVAIEFSQEEWKCLEPTQKALYKDVMLENYRNLVSLGISLPDLNINSMLERRRELLS

SEQ ID NO: 7790 - protein, 81 aa, Callithrix jacchus
EWKCLEPTQKALYKDVMLENYRNLVSLGISLPDLNINSMLERRRELLSGESEVKIAKRSDRRERIEVVNRVQGAAVHWEAV

SEQ ID NO: 7791 - protein, 81 aa, Callithrix jacchus
AQKRRKRKAKEAGMALPQGHLTFTDVAIEFSQEEWKCLEPTQKALYKDVMLENYRNLVSLGSSCALGGSAENKPIKTQLGG

SEQ ID NO: 7792 - protein, 81 aa, Callithrix jacchus
MGHLTFMDVAIEFSQEEWTCLDPAQQALYRDVMLENYRNLVSLGICLPDLSIISMLEQRREPSTLQGELKIVKIQDGRERI

SEQ ID NO: 7793 - protein, 81 aa, Callithrix jacchus
RSCILRSNAGNKPIKNQLGLILESHLPELQLFQAGRKIYRSNRGETFTNHSSSVSPLQKISSHFTTHIFNKYRNGLIDFPL

SEQ ID NO: 7794 - protein, 81 aa, Callithrix jacchus
VSWRPGSGLRGVTVMLRRGHLTFRDVAIEFSQEEWKCLELAQRALYRDVMLENYRNLVSLGICPYDLSIISTLEQSGGPWN

SEQ ID NO: 7795 - protein, 81 aa, Callithrix jacchus
MLRRGHLTFRDVAIEFSQEEWKCLELAQRALYRDVMLENYRNLVSLGICPYDLSIISTLEQSGGPWNLQSEVKIANTPDGR

SEQ ID NO: 7796 - protein, 81 aa, Callithrix jacchus
EEATQKREGKKSGMARSQGPLTFIDVAIEFSQEEWKCLDPAQRTLYKDVMLENYRNLVSLGVDLPDLSFISMLEQKREPWT

SEQ ID NO: 7797 - protein, 81 aa, Callithrix jacchus
MALPQPPEQLGLQGLLTFRDVTIEFSQDEWRCLHPAQKTLYRDVMLENYRNLVSLDISSKYKMKGLLSTAQGDTEGFHTGI

SEQ ID NO: 7798 - protein, 81 aa, Callithrix jacchus
MALPQGLLTFRDVTIEFSQDEWRCLHPAQKTLYRDVMLENYRNLVSLDISSKYKMKGLLSTAQGDTEGFHTGILDRHESHH

SEQ ID NO: 7799 - protein, 81 aa, Callithrix jacchus
MLENYRNLVSLDISSKYKMKGLLSTAQGDTEGFHTGILDRHESHHMGDFCFQEIDRDIRDFECRNSHEALMRKVEKLPCGT

SEQ ID NO: 7800 - protein, 81 aa, Callithrix jacchus
MALPQGLLTFRDVTIEFSQEEWRCLDPAQKTLYRDVMLENYRNLVSLATYLQSGKVFNQKRQLFRHRRPHTGERPYKCNEC

SEQ ID NO: 7801 - protein, 81 aa, Callithrix jacchus
MALPQGLLTFRDVTIEFSQEEWRCLDPAQKTLYRDVMLENYRNLVSLDVSSKCMMKATCTGQPTYLQSGKVFNQKRQLFRH

SEQ ID NO: 7802 - protein, 81 aa, Callithrix jacchus
EEAAQKRKEKEPGMALPQGCLTFRDVAVEFSLAEWKCLTPAQRALYRDVMLENYRNLESVDISFKCMMKKFSLTAQGTTEM

SEQ ID NO: 7803 - protein, 81 aa, Callithrix jacchus
EKQYECDVCGKAFNQKRYLGRHGRCHTGEKPYQCHECGVNFTQQSILTRHSRLHTGEKPSKCNKCSKTFGRNSALVIPKAV

SEQ ID NO: 7804 - protein, 81 aa, Callithrix jacchus
MALPQGCLTFRDVAVEFSLAEWKCLTPAQRALYRDVMLENYRNLESVDISFKCMMKKFSLTAQGTTEMLHTGTLETHESHH

SEQ ID NO: 7805 - protein, 81 aa, Callithrix jacchus
MALPQGLLTFRDVTIEFSQDEWRCLHPAQKTLYRDVMLENYRNLVSLDISSKYKMKGLLSTAQGNTEGFHTGILDRHESHH

SEQ ID NO: 7806 - protein, 81 aa, Callithrix jacchus
MALPQGLLTFRDVTIEFSQEEWRCLDPAQKTLYRDVMLENYRNLVSLDISSKYKMKGLLSTAQGDTDGFHTGILDRHESHH

SEQ ID NO: 7807 - protein, 81 aa, Callithrix jacchus
EPRKRKRKAKESGMALPQGLLTFRDVAIEFSQEEWRCLDPAQRTLYRDVMLENYRNLVSLDIFSKCETKELPPEEKSNTGE

SEQ ID NO: 7808 - protein, 81 aa, Callithrix jacchus
MPVAQGRLTFRDVAVEFSLAEWKCLTPAQRAVYRDVMLENYRNLESVGEEPVPPDTRNLPLSILALPDSFLKSMMEFSSTG

SEQ ID NO: 7809 - protein, 81 aa, Callithrix jacchus
MALPQGLLTFRDVTIEFSQEEWRCLDPAQRILYWNVMLENYRNLVSLDISSKYKMKGLLSTAQGDTDGFHTGILDRHESHH

SEQ ID NO: 7810 - protein, 81 aa, Callithrix jacchus
MALPQGLLTFRDVTIEFSQEEWRCLDPAQRTLYRDVMLENYRNLVSLDISSKYKMKGLLSTAQGDTDGFHTGILDRHESHH

SEQ ID NO: 7811 - protein, 81 aa, Callithrix jacchus
MLENYRNLVSLDISSKYKMKGLLSTAQGDTDGFHTGILDRHESHHMGDFCFQEIDRDIHDFECRNSHEALMRKVEKLPCGT

SEQ ID NO: 7812 - protein, 81 aa, Callithrix jacchus
EAATRKAKEKEPGMPPPQGRLTFRDVAIEFSLAEWKCLTPAQRALYRDVMLENYRNLESVGEENIPPDTRNLPLSILALPD

SEQ ID NO: 7813 - protein, 81 aa, Callithrix jacchus
GRLTFRDVAIEFSLAEWKCLTPAQRALYRDVMLENYRNLESVDSFLKSMMKFSSTGQGSTGEGIHTATLGKCTSHHIGDSC

SEQ ID NO: 7814 - protein, 81 aa, Callithrix jacchus
MPVAQGHLTFRDVAVEFSLAEWKCLTSVQRALYRDVMMENYRNLEYVGEENVPPHTRNLPLSIWALPDSFLKSIMEFSSTG

SEQ ID NO: 7815 - protein, 81 aa, Callithrix jacchus
MTLPQGLLTFRDVAIEFSQEEWRCLDPAQKTLHRDVMLENYRNLVSLDISSICMMKEFSSTGPGNTDVFHTGTLQRHEIHQ

SEQ ID NO: 7816 - protein, 81 aa, Callithrix jacchus
EEAARKRKEKEPGMALPQGRLTFRDVAIEFSLAEWKCLTPAQRALYRDVMLENYRNLESVDISSKCMMKMVSSTGQGNTEV

SEQ ID NO: 7817 - protein, 81 aa, Callithrix jacchus
MALPQGRLTFRDVAVEFSLAEWKCLTPAQRALYRDVMLENYRNLESVGEENVPPDTRNLPLSILALPANGNLNCSSFLRKR

SEQ ID NO: 7818 - protein, 81 aa, Callithrix jacchus
EEAAQKRKEKEPGMALPQGRLTFRDVAVEFSLAEWKCLTPAQRALYRDVMLENYRNLESVGEENVPPDTRNLPLSILALPA

SEQ ID NO: 7819 - protein, 81 aa, Callithrix jacchus
MALPQGRLTFRDVAIEFSLAEWKCLTPAQRALYRDVMLENYRNLESVGEEPVPPDTRNLPLSILAFPDDSNLNYSSFLRKY

SEQ ID NO: 7820 - protein, 81 aa, Callithrix jacchus
MALPQGRLTFKDVSVEFSSAEWKCLTPAQRALYRDVMLENYRNLESVAAGNLNCSSLLKKHQINHLGKNKYKCDVCGKVIN

SEQ ID NO: 7821 - protein, 81 aa, Callithrix jacchus
MALPQGRLTFKDVSVEFSSAEWKCLTPAQRALYRDVMLENYRNLESVGEENVPPDTSNPSLFIWALPAAGNLNCSSLLKKH

SEQ ID NO: 7822 - protein, 81 aa, Callithrix jacchus
MALPQGRLTFKDVAIEFSSAEWKCLTPAQRALYRDVMLENYRNLESVAAGNLNCSSLLKKHQINHLGKNKYKCDVCGKVIN

SEQ ID NO: 7823 - protein, 81 aa, Callithrix jacchus
MALPQGRLTFKDVAVEFSLAEWKCLTPAQRALYRDVMLENYRNLESVANGNLNSSSFLKKDQINHLGKKQYECDVCGRVLN

SEQ ID NO: 7824 - protein, 81 aa, Callithrix jacchus
MALTQVRLTFRDVAIEFSQEEWKCLDPTQRALYRDVMLENYWSLVSLGLCHFDMNIISMLEEGKEPWTVKNYMKIARKPRM

SEQ ID NO: 7825 - protein, 81 aa, Callithrix jacchus
MKESGMAPPQGHLTFRDVAIEFSQEEWKCLTSTQRTLYRDVMLENYRNLVSLDLSHNGVMKELAPKQKRNMGEVFHTVARE

SEQ ID NO: 7826 - protein, 81 aa, Callithrix jacchus
ADGDGLTFRDVAIEFSQEEWKCLTSTQRTLYRDVMLENYRNLVSLDLSHNGVMKELAPKQKRNMGEVFHTVAREQHETPDT

SEQ ID NO: 7827 - protein, 81 aa, Callithrix jacchus
MALTQGQVTFRDVAIEFSQEEWTCLDPAQRSLYRDVMLENYRNLASLGISCFDLSIISMLEQGKGPFALESQVQRAGNPDG

SEQ ID NO: 7828 - protein, 81 aa, Callithrix jacchus
GNPDGWEWIKALITALSSEFVMKDLPHKGKSSTGEVFQTVMLERHESHDIEGCFFREVQKNVHDLEYQRRDAEGNYKAVLM

SEQ ID NO: 7829 - protein, 81 aa, Callithrix jacchus
MAPPQGHLTFRDVAIEFSQEEWKCLTSTQRTLYRDVMLENYRNLVSLDLSHNGVMKELAPKQKRNMGEVFHTVAREQHETP

SEQ ID NO: 7830 - protein, 81 aa, Callithrix jacchus
MAPPQLTFRDVAIEFSQEEWKCLTSTQRTLYRDVMLENYRNLVSLDLSHNGVMKELAPKQKRNMGEVFHTVAREQHETPDT

SEQ ID NO: 7831 - protein, 81 aa, Callithrix jacchus
MALPQERLTFRDVAIEFSQEEWKYLDPAQRTLYRNVMLENYRNLVSLGISLSEMNLVSMLEQGKETRTVESEVKRTKTSNG

SEQ ID NO: 7832 - protein, 81 aa, Callithrix jacchus
MIVSQRLFTFNVTIEFSQEWECLDPAQRALHRDVMLQNCRNLDEENTPPENHISVGFASKGLSPKETNKEEFYHLVILERK

SEQ ID NO: 7833 - protein, 81 aa, Callithrix jacchus
VMLQNCRNLDEENTPPENHISVGFASKGLSPKETNKEEFYHLVILERKESHGINSFDLKEAWEHVHKCDSLWEYDAKNKGV

SEQ ID NO: 7834 - protein, 81 aa, Callithrix jacchus
MAQGLVTFADVAIDFSQEEWACLNSAQRDLYWDVMLENYSNVVSLDLESAYETKNLPTEKSLHEIRVSKRHSDRRSKSLGH

SEQ ID NO: 7835 - protein, 81 aa, Callithrix jacchus
MPLGSELFRDVAIVFSQEEWQWLAPAQRDLYRDVMLETYSNLVSLGLAISKPDVISFLEQGKEPWMVERVVAGGLCPEAEL

SEQ ID NO: 7836 - protein, 81 aa, Callithrix jacchus
MPLGSELFRDVAIVFSQEEWQWLAPAQRDLYRDVMLETYSNLVSLGLAISKPDVISFLEQGKEPWMVERVVAGGLCPVLES

SEQ ID NO: 7837 - protein, 81 aa, Callithrix jacchus
MSKDLVTFGDVAVNFSQEEWEWLNPAQRNLYRKVMLENYRTLVSLGVSVSKPDVISLLEQGKEPWMVKKEGTRSSCPDWEY

SEQ ID NO: 7838 - protein, 81 aa, Callithrix jacchus
PEVQSKEYDKPWQTLPQDTVFGTQQRFPTREKEHKHEAQKKGYRKKSVEMKQRKVYMEKKLLKCNDCEKVFNQSSSLTLHQ

SEQ ID NO: 7839 - protein, 81 aa, Callithrix jacchus
MPAARGKSKSKAPITFGDLAIYFSQEEWEWLSPIQKDLYEDVMLENYRNLVSLGLSFRRPNVITLLEKGKAPWMVEPARRR

SEQ ID NO: 7840 - protein, 81 aa, Callithrix jacchus
MNVEVLKVISQDLVTFKDVAIDFSQEEWQWMNPAQKRLYRSMMLENYQSLVSLGLCVSKPYVISLLEQGREPWEMTSEMRR

SEQ ID NO: 7841 - protein, 81 aa, Callithrix jacchus
DDACMEGMTSYGLECSTFEENWKWEDLFEKQMGSQEMFSQEETITHKETLTKETEFKYTKFGKCIHVENIEGNIYNHTSDK

SEQ ID NO: 7842 - protein, 81 aa, Callithrix jacchus
NQKLEAAGTGTEPKAMSQGLVTFGDVAIDFSQEEWEWLSPVQRNLYRKVMLENYRNLALLGLCVSKPDVISLLEQGKEPWT

SEQ ID NO: 7843 - protein, 81 aa, Callithrix jacchus
LEYSLLGEHWDCDALFETQPGLVTMKNLAIDFPQQLHPAQKNSCKNGLWENYSDVGSAGHCMAKPDLASLLEQEKETWMVK

SEQ ID NO: 7844 - protein, 81 aa, Callithrix jacchus
SQEEGKVTGITLLKAMSLGSVTFTDVAIDFSQDEWQWLNLAQRSLYKKVMLENYRNLVSVGLCISKPDVISLLEQEKDPWV

SEQ ID NO: 7845 - protein, 81 aa, Callithrix jacchus
MAAQLLTDEVLESVTFRDVTVDFTQEEWQQLEPAQKDLYRDVMLENYRNLVSLDWETRPEMKELDSKNDILEDKPSVVGVA

SEQ ID NO: 7846 - protein, 81 aa, Callithrix jacchus
RDSRAYESRSQDAESYQNMVNLTEDRKPHNTIQDNMENYRKLLSLGFLAHDSVPAEERNTEMVDSPPSARSQLLDLEHIRA

SEQ ID NO: 7847 - protein, 81 aa, Callithrix jacchus
ARSQLLDLEHIRAFLLFQELVTFKDVVVHFSLEELRSLSAAQRSLYREVTLENYRNLVSLGYRFSKPDIISRLEKEESRAV

SEQ ID NO: 7848 - protein, 81 aa, Callithrix jacchus
MKNSQRVTFEDVTVSFTKGEWQQLNPEQRELYRDVMLENYGNLVSVGLEETSKPSVILRLEEGKEPWSEEEVLRGGRPEKN

SEQ ID NO: 7849 - protein, 81 aa, Callithrix jacchus
MAAAVLTDRVQVSVTFDDVAVTFTEEEWGQLDLAQRTLYQEVMLENCGLLVSLGCPVPRPELICHLDHGQEPWTGKEDLSQ

SEQ ID NO: 7850 - protein, 81 aa, Callithrix jacchus
MAAAVLTDRVQVSVTFDDVAVTFTEEEWGQLDLAQRTLYQEVMLENCGLLVSLGDKGKPKTTEPTTCDPALSEGISLQGQL

SEQ ID NO: 7851 - protein, 81 aa, Callithrix jacchus
MATALTDPAQVSVTFDDVAVTFTQEEWGQLDLAQRTLYQEVMLENCGLLVSLGCPVPRPELICHLDHGQEPWTGKEDLSQG

SEQ ID NO: 7852 - protein, 81 aa, Callithrix jacchus
MAAAWMAPTQESVTFEDVAVTFTQEEWGQLDVTQRALYVEVMLETCGLLVALGDSTKPETLEPVPSHPALPEEVSLQEQLA

SEQ ID NO: 7853 - protein, 81 aa, Callithrix jacchus
MAGLAQVSVTFEDVAVTFTQEEWGQLDATQRTLYQEVMLETCGLLASLGCPLSKPELIYRLDHRQEPWMVKRDLSQSSYPG

SEQ ID NO: 7854 - protein, 81 aa, Callithrix jacchus
TAAAVLMDRVQSCVTFEDVFVYFSREEWELLEEAQRFLYRDVMLENFALVATLGFWCETENEEAPSEQSISLEGVSQVRTA

SEQ ID NO: 7855 - protein, 81 aa, Callithrix jacchus
TAAAVLMDRVQSCVTFEDVFVYFSREEWELLEEAQRFLYRDVMLENFALVATLGFIFPVSGSCPSGGGRRPWADISPATIR

SEQ ID NO: 7856 - protein, 81 aa, Callithrix jacchus
MAEMNPAQDRVVFEDVAIYFSQEEWGHLDEAQRLLYRDVMLENLALLSSLGCCHGAEDEEAPFQQGVSSGVLQAMAPKPRL

SEQ ID NO: 7857 - protein, 81 aa, Callithrix jacchus
MYSSFPIWQDRVVFEDVAIYFSQEEWGHLDEAQRLLYRDVMLENLALLSSLGCCHGAEDEEAPFQQGVSSGVLQAMAPKPR

SEQ ID NO: 7858 - protein, 81 aa, Callithrix jacchus
VSSGVLQAMAPKPRLSTQKSQRCETCSSLLKDILRLAEHDGTHPEQGLYMSPAHLHQHQKEQIREKLCRGDGGRPSFVKNH

SEQ ID NO: 7859 - protein, 81 aa, Callithrix jacchus
MDPVQDRVVFEDVAIYFSQEEWGHLDEAQRLLYRDVMLENLALLSSLGCWHGAEDEVAPSQQGFSAGVSEVTTSESCMFTQ

SEQ ID NO: 7860 - protein, 81 aa, Callithrix jacchus
MNLTEGPAAEMDPVQDRVVFEDVAIYFSQEEWGHLDEAQRLLYRDVMLENLALLSSLGKALTLAQCPGLGWVMPVHPKAAL

SEQ ID NO: 7861 - protein, 81 aa, Callithrix jacchus
MNLTEGPAAEMDPVQDRVVFEDVAIYFSQEEWGHLDEAQRLLYRDVMLENLALLSSLGYTAVAAMFMDAGQDCMVFEDVAI

SEQ ID NO: 7862 - protein, 81 aa, Callithrix jacchus
AIYFSQEEWGHLDEAQRLLYRDVMLENLALLSSLGYTAVAAMFMDAGQDCMVFEDVAIHFSQEEWGILNDVQRHLHSDVML

SEQ ID NO: 7863 - protein, 81 aa, Callithrix jacchus
MFMDAGQDCMVFEDVAIHFSQEEWGILNDVQRHLHSDVMLENFALLSSVGCWHGAKDEEAPSKQYVSMEVSQVTTLKPALS

SEQ ID NO: 7864 - protein, 81 aa, Callithrix jacchus
MNLIEDCMVFEDVAIHFSQEEWGILNDVQRHLHSDVMLENFALLSSVGCWHGAKDEEAPSKQYVSMEVSQVTTLKPALSTQ

SEQ ID NO: 7865 - protein, 81 aa, Callithrix jacchus
MAATHKDPAQDCMVFEDVAIYFSQEEWGILNDAQRHLHSNVMLENFALLSSVGCWHGANDKEASSKQCVSVRVLQVTTPKS

SEQ ID NO: 7866 - protein, 81 aa, Callithrix jacchus
MAAAAPMGQAQVPLNSEVIMDPKQGQVNFEDVFVYFSQEEWVLLDEAQRLLYRDVMLENFALMASLEKQAVSVSAVQHPTG

SEQ ID NO: 7867 - protein, 81 aa, Callithrix jacchus
AAAAPMGQAQVPLNSEVIMDPKQGQVNFEDVFVYFSQEEWVLLDEAQRLLYRDVMLENFALMASLEKQAVSVSAVQHPTGW

SEQ ID NO: 7868 - protein, 81 aa, Callithrix jacchus
MGQAQVPLNSEVIMDPKQGQVNFEDVFVYFSQEEWVLLDEAQRLLYRDVMLENFALMASLGCWPGMKDEEIPFEQSFSIGL

SEQ ID NO: 7869 - protein, 81 aa, Callithrix jacchus
MDPKQGQVNFEDVFVYFSQEEWVLLDEAQRLLYRDVMLENFALMASLGHTSFTSHIVASPGLLSGSCWPGMKDEEIPFEQS

SEQ ID NO: 7870 - protein, 81 aa, Callithrix jacchus
MGQAQVPLNSEVIMDPKQGQVNFEDVFVYFSQEEWVLLDEAQRLLYRDVMLENFALMASLGHTSFTSHIVASPVMGCWPGM

SEQ ID NO: 7871 - protein, 81 aa, Callithrix jacchus
MGQAQVPLNSEVIMDPKQGQVNFEDVFVYFSQEEWVLLDEAQRLLYRDVMLENFALMASLGHTSFTSHIVASPVMVGVALA

SEQ ID NO: 7872 - protein, 81 aa, Callithrix jacchus
EPAQVLTAAELLTDNEKQGYVTFEDVAVYFSQEEWRLLDEAQRLLYRNVMLENFSLMASLGLASSKTHEITQLESWEEPFM

SEQ ID NO: 7873 - protein, 81 aa, Callithrix jacchus
MAAAAMREPAQQGYVTFEDVAVYFSQEEWRLLDEAQRLLYRNVMLENFSLMASLGLASSKTHEITQLESWEEPFMPAWEVV

SEQ ID NO: 7874 - protein, 81 aa, Callithrix jacchus
MAAAAMREPAQGYVTFEDVAVYFSQEEWRLLDEAQRLLYRNVMLENFSLMASLGLASSKTHEITQLESWEEPFMPAWEVVT

SEQ ID NO: 7875 - protein, 81 aa, Callithrix jacchus
MAAAAMREPAQQGYVTFEDVAVYFSQEEWRLLDEAQRLLYRNVMLENFSLMASLGCWHGVEAKKAPKQSASVGVLTSNVQQ

SEQ ID NO: 7876 - protein, 81 aa, Callithrix jacchus
MDAAALVNLPQGHVTFEDIAVYFSREEWGLLDEAQRCLYHDVMLENFSLMTSVGCLHGIGAEEAPSEQIVSVETVSQARTP

SEQ ID NO: 7877 - protein, 81 aa, Callithrix jacchus
VNLPQIPVATEEFVKPSQGHVTFEDIAVYFSREEWGLLDEAQRCLYHDVMLENFSLMTSVGCLHGIGAEEAPSEQIVSVET

SEQ ID NO: 7878 - protein, 81 aa, Callithrix jacchus
LVNLPQIPVATEEFVKPSQGHVTFEDIAVYFSREEWGLLDEAQRCLYHDVMLENFSLMTSVAGLSQNNHKDSCLWKVPVSM

SEQ ID NO: 7879 - protein, 81 aa, Callithrix jacchus
MAEGKEAAQMLVSFKDVAVTFTQEEWRQLDPAQRTLYQEVMLETCGLLVSLGYWVPKAELVHLLEHGQELWTVKSGRSHPT

SEQ ID NO: 7880 - protein, 81 aa, Callithrix jacchus
LSWEFAFLLPGTISLYQKMLVSFKDVAVTFTQEEWRQLDPAQRTLYQEVMLETCGLLVSLGYWVPKAELVHLLEHGQELWT

SEQ ID NO: 7881 - protein, 81 aa, Callithrix jacchus
MLVSFKDVAVTFTQEEWRQLDPAQRTLYQEVMLETCGLLVSLGYWVPKAELVHLLEHGQELWTVKSGRSHPTCVGDKAQVQ

SEQ ID NO: 7882 - protein, 81 aa, Callithrix jacchus
RALTPVSMTAEAKCTGFTQGSVTFEDVAIYFSQEEWGLLDEAQRLLYRDVMLENFALLTSLVCWHGMEDEETPEQSVSVNG

SEQ ID NO: 7883 - protein, 81 aa, Callithrix jacchus
MDLTKGCVTFEDIAIYFSQEEWGLLDEAQRLLFLEVMLENFALVASLGCGHGTEDEKTPSEQNVSIGVSQSKAGSSAQKTQ

SEQ ID NO: 7884 - protein, 81 aa, Callithrix jacchus
RAPTQVTVTPETHMDLTKGCVTFEDIAIYFSQEEWGLLDEAQRLLFLEVMLENFALVASLGCGHGTEDEKTPSEQNVSIGV

SEQ ID NO: 7885 - protein, 81 aa, Callithrix jacchus
MAAAALRAPTQEEWGLLDEAQRLLFLEVMLENFALVASLGCGHGTEDEKTPSEQNVSIGVSQSKAGSSAQKTQPCEMCVPI

SEQ ID NO: 7886 - protein, 81 aa, Callithrix jacchus
PPGRPPTRMATALTDPAPGSVTFEDVAVYFSWEEWDLLDETQKHLYFDVMLENFVLTSSLGYWCGLEHEEAPSSSVGTDVL

SEQ ID NO: 7887 - protein, 81 aa, Callithrix jacchus
TDPAPVPIATEVLSEPTGSVTFEDVAVYFSWEEWDLLDETQKHLYFDVMLENFVLTSSLGYWCGLEHEEAPSSSVGTDVLQ

SEQ ID NO: 7888 - protein, 81 aa, Callithrix jacchus
GSVTFEDVAVYFSWEEWDLLDETQKHLYFDVMLENFVLTSSLGYWCGLEHEEAPSSSVGTDVLQRISLKGAPQFRTSKEGS

SEQ ID NO: 7889 - protein, 81 aa, Callithrix jacchus
MAAFTMRDPAQRTTFEDVAIYFSQEEWELLDEAQRFLYCDVMLENFAHVTSLGYCHGTQNEAIASEHTASVGGKLQVRTSK

SEQ ID NO: 7890 - protein, 81 aa, Callithrix jacchus
MAAATPRAPAPGTVTFEDVAVHFSWEEWGLLDEAQRCLYRDVMLENLALLTSLDVHYQKENLGEKHFRSNVDQALFVNTCI

SEQ ID NO: 7891 - protein, 81 aa, Callithrix jacchus
TTFEDVAIYFSQEEWELLDEAQRFLYCDVMLENFAHVTSLGYCHGTQNEAIASEHTASVGGKLQVRTSKGDTPTQKTHLSA

SEQ ID NO: 7892 - protein, 81 aa, Callithrix jacchus
MAAAALRLPAQGTVTFEDVAVKFSQEEWSILTEAQRCLYHDVMLENLALISSLGCWYGAKDETPSKQTLSIQQQSPLRSHW

SEQ ID NO: 7893 - protein, 81 aa, Callithrix jacchus
MAAPAQSCVTFEDVAVKFSLEEWNLLNDAQRCLYGDVMLETMTLISSLGCWHGGEEEAAPSKQSTCVHVYRDQRVHSGERP

SEQ ID NO: 7894 - protein, 81 aa, Callithrix jacchus
MAAAAPRLPAQGTVTFEDVAVNFTWEEWNLLSEAQRCLYRDVMLENLALTSSLGCWCGVEDEEAPSKQSIYVQKETQVRTP

SEQ ID NO: 7895 - protein, 81 aa, Callithrix jacchus
MAAATLRLSAQGTVTFEDVAVNFTWEEWNLLSEAQRCLYRDVMLENLALTSSLGCWCGVEDEEAPSKQSIYVQKETQVRTP

SEQ ID NO: 7896 - protein, 81 aa, Callithrix jacchus
MAAATLRLSAQGTVTFEDVAVNFTWEEWNLLSEAQRCLYRDVMLENLALTSSLGCWCGVEDEEAPSKQSIYVQKETQRRGF

SEQ ID NO: 7897 - protein, 81 aa, Callithrix jacchus
VTFEDVAVNFTWEEWNLLSEAQRCLYRDVMLENLALTSSLGCWCGVEDEEAPSKQSIYVQKETQRRGFNHVEQDSLDLLTS

SEQ ID NO: 7898 - protein, 81 aa, Callithrix jacchus
MAAAAPRLPAQGTVTFEDVAVNFSKEEWCLLSEAQRCLYRDVMLENLALISSLGCWCGLKDEAAPSKQSMIVQTESQDRTP

SEQ ID NO: 7899 - protein, 81 aa, Callithrix jacchus
VKKTKSESKHGSPFQEGKTNYRRGERTKVFSTKHSLTPHQKLFTRDGCYVCSDCGKSFSKYDSFRNHQRIHTGKGPYECGE

SEQ ID NO: 7900 - protein, 81 aa, Callithrix jacchus
MAAAAPRLPAQQGTVTFEDVAVNFSKEEWCLLSEAQRCLYRDVMLENLALISSLGCWCGLKDEAAPSKQSMIVQTESQDRT

SEQ ID NO: 7901 - protein, 81 aa, Callithrix jacchus
MQGTVTFEDVAVNFSREEWSLLSEVQRCLYHDVMLENWVLTSSLGCWCESEYEEAPSKQNISIQRVSPVSSPRAGVSLKKA

SEQ ID NO: 7902 - protein, 81 aa, Callithrix jacchus
HRMTWDCIAIGNHGNSVQGTVTFEDVAVNFSREEWSLLSEVQRCLYHDVMLENWVLTSSLGCWCESEYEEAPSKQNISIQR

SEQ ID NO: 7903 - protein, 81 aa, Callithrix jacchus
MQQGTVTFEDVAVNFSREEWSLLSEVQRCLYHDVMLENWVLTSSLGCWCESEYEEAPSKQNISIQRVSPVSSPRAGVSLKK

SEQ ID NO: 7904 - protein, 81 aa, Callithrix jacchus
MAAAALRLPAQQGTVTFEDVAVNFSREEWSLLSEVQRCLYHDVMLENWVLTSSLGCWCESEYEEAPSKQNISIQRVSPVSS

SEQ ID NO: 7905 - protein, 81 aa, Callithrix jacchus
MAAAELTAPALGIVTFEDVAVYFSWKEWSLLDEAQKCLYHHVMLENLTLTTSLGGCGTEDEEAPYQQSTSPQRGSQVRIPK

SEQ ID NO: 7906 - protein, 81 aa, Callithrix jacchus
GSPEEGRRAAGLPAAQEQEPVTFKDVAVDFTQEEWGQLDLVQRTLYRDVMLETYGHLLSVGNQTAKPEVISLLEQGEEPWS

SEQ ID NO: 7907 - protein, 81 aa, Callithrix jacchus
ARRRSGGCRRRGLLAVRWEQVTFEDVVVDFTQEEWGQLEPAQRTLYYDVILGTFRLLVAVGHWLPKLNIISLLEQEAELRA

SEQ ID NO: 7908 - protein, 81 aa, Callithrix jacchus
VDPALCASGDPEQVTFEDVVVDFTQEEWGQLEPAQRTLYYDVILGTFRLLVAVGHWLPKLNIISLLEQEAELRAVDPGVPQ

SEQ ID NO: 7909 - protein, 81 aa, Callithrix jacchus
QQEKQEDAAICPVTVLPEEPVTFQDVAVDFSREEWGLLGPTQRTEYRDVMLETFGHLVSVGWETTLENKQLAPNSGIPGEE

SEQ ID NO: 7910 - protein, 81 aa, Callithrix jacchus
MASRLPTVWSCEPVTFEDVTLGFNPEEWGLLDLKQKSLYREVMLENYRNLVSVEHQLSKPDVVSQLEEAEDFWPVERGIPQ

SEQ ID NO: 7911 - protein, 81 aa, Callithrix jacchus
MASRLPTVWSCEPVTFEDVTLGFNPEEWGLLDLKQKSLYREVMLENYRNLVSVEYSELQLDPKLDPLSAESPLMNIEVVEV

SEQ ID NO: 7912 - protein, 81 aa, Callithrix jacchus
MLENYRNLVSVEHQLSKPDVVSQLEEAEDFWPVERGIPQDTIPEYSELQLDPKLDPLSAESPLMNIEVVEVLTLNQEVAGP

SEQ ID NO: 7913 - protein, 81 aa, Callithrix jacchus
DEAVAAVMSVGPPAAQLQEPVTFRDVAVDFTQEEWGQLDPTQRILYRDVMLETFGHLLSIGPELPKPEVISHLEQGTEPWV

SEQ ID NO: 7914 - protein, 81 aa, Callithrix jacchus
CNHCGKGFRHSSSLAQHQRKHAGEKPFECRQRLTFEQTAALTKQEWAEALGCDPPLRQDDRTHRSDRPFKCNQCGKCFIQS

SEQ ID NO: 7915 - protein, 81 aa, Callithrix jacchus
MAGEVQAQLDPSLQGLVMFEDVAVYFSREEWGLLNVTQKGLYRDVMLENFALLSSLGLAPSRSPVFTQLVDDEQSCVTSWV

SEQ ID NO: 7916 - protein, 81 aa, Callithrix jacchus
MAGEVQGLVMFEDVAVYFSREEWGLLNVTQKGLYRDVMLENFALLSSLGLAPSRSPVFTQLVDDEQSCVTSWVDVTLVSRT

SEQ ID NO: 7917 - protein, 81 aa, Callithrix jacchus
GPVQHTCWPCGSAVPSLKSLVTFEDVAVYFSQEEWGLLDVAQRHLYHNVMVENFELITSLGCWHGVEGEEAHPKKNASVEE

SEQ ID NO: 7918 - protein, 81 aa, Callithrix jacchus
PSLKSLVTFEDVAVYFSQEEWGLLDVAQRHLYHNVMVENFELITSLGNALPQHDVSVGADLPNSFPNWLPHFTSLSAVCKC

SEQ ID NO: 7919 - protein, 81 aa, Callithrix jacchus
MAFEDVAVYFSEEEWGLLDTAQRALYRHVMLENFTLVTSLGLSTSRPLVVIQLERGEDPWVPSVKDMTLARNAYGRRTTGS

SEQ ID NO: 7920 - protein, 81 aa, Callithrix jacchus
MAFEDVAVYFSQEEWGLLDTAQRALYRRVMLDNFALVASLGLSTSRPRVVIQLERGEEPWVPSETDMTMSRNTHRRRNPGS

SEQ ID NO: 7921 - protein, 81 aa, Callithrix jacchus
TLAAQSPEGHHGHQEPGSTSFHPPRIQEEWGLLDRSQKELYWDAMLEKYGTVVSLGLPTHQPEAQAQSELGMLLTGAGVCR

SEQ ID NO: 7922 - protein, 81 aa, Callithrix jacchus
MKLLTLRDVTIEFSPEEWRCLDPAQQNLYRDVMLENYRNLVSLGAALSNPDLVTCLEQRKEPYNVKIHQTVARSPAMCSPF

SEQ ID NO: 7923 - protein, 81 aa, Callithrix jacchus
MKLLTFRDVTIEFSPEEWRCLDPAQQNLYRDVMLENYRNLVSLGVALSNPDLVTCLEQRKEPYNVKIHQTVARSPAMCSPF

SEQ ID NO: 7924 - protein, 81 aa, Callithrix jacchus
MELLTFRDVAIEFSPEEWRCLDPAQQNLYRDVMLENYRNLVSLGVAISNPDLVTCLEQRKEPCNVKIRETVAKPPAVCSHF

SEQ ID NO: 7925 - protein, 81 aa, Callithrix jacchus
MELLTFRDVAIEFSSEEWKCLDPAQQNLYRDVMLENYRNLVSLGVVISNPDLVTYLEQRKEPYNLKIHETAAKLPATCSFT

SEQ ID NO: 7926 - protein, 81 aa, Callithrix jacchus
GSQGNLPQADITRMNQAQESVTFEDVAVNFTDREWQCLTDAQRHLYKDVMLENYGHVVSLGFPFPKPPLISHLERGVEPCV

SEQ ID NO: 7927 - protein, 81 aa, Callithrix jacchus
GGYCRGDAVTASRVPPESQGLLKVEDVALSLAPEWTQLDSSQVNLYRDEKQENHGSLASLGGEIQTQSRDLPPAEELPEKE

SEQ ID NO: 7928 - protein, 81 aa, Callithrix jacchus
DEAAMPVFNPVRSQTLVKTEEGTAQALAKEKWPHLSLAQRNLCGNSAQETVRSLSLMTEEIVTKDRLFNAKQETSEEIEKG

SEQ ID NO: 7929 - protein, 81 aa, Callithrix jacchus
KPRDEAAMPVFNPVRSQTLVKTEEGTAQALAKEKWPHLSLAQRNLCGNSAQETVRSLSLMKGVHSRFLVVLLSLLKGQLHI

SEQ ID NO: 7930 - protein, 81 aa, Callithrix jacchus
GGHCREDAMVASRLTPGPQGLLKMEDVALALSPGWTQLDSSQVNLYRDEKQENHGSLVSLGGEIQTQSRDLPPAEELPEKE

SEQ ID NO: 7931 - protein, 81 aa, Callithrix jacchus
GSSGNQEMTATLLTAGFQTLEKIEDMAVSLIREEWLLDPSQKDLSRDNRPENVRNMFSLGGETRSENRELASKQVISTGIQ

SEQ ID NO: 7932 - protein, 81 aa, Callithrix jacchus
DSTLLQGGHTLLSSASFQESVTFKDVIVDFTQEEWKQLDPGQRDLFRDVTLENYTHLVSIGLQVSKPDVISQLEQGTEPWI

SEQ ID NO: 7933 - protein, 81 aa, Callithrix jacchus
TTPQEAMKRDCWWEAWVKKKPVTFEDLAVNFTQEEWDCLDASQRVLYQDVMSETFKNLASVARMFLHKPELITKLEHQEKQ

SEQ ID NO: 7934 - protein, 81 aa, Callithrix jacchus
EQLKPIAPRDCWWEAWVKKKPVTFEDLAVNFTQEEWDCLDASQRVLYQDVMSETFKNLASVARMFLHKPELITKLEHQEKQ

SEQ ID NO: 7935 - protein, 81 aa, Callithrix jacchus
MAAGERRSLLFFQKPVTFEDLAVNFTQEEWDCLDASQRVLYQDVMSETFKNLASVARMFLHKPELITKLEHQEKQWRVTRV

SEQ ID NO: 7936 - protein, 81 aa, Callithrix jacchus
AQNRKAKGLPSNDTDWPQEKEEKVQIVVPVTFRGVTVIFTEAEWKRLSPEQRNLYKEVMLENYRNLLSLDGGQEQQDAAAY

SEQ ID NO: 7937 - protein, 81 aa, Callithrix jacchus
LPSNDTDWPQEKEEKVQIVVPVTFRGVTVIFTEAEWKRLSPEQRNLYKEVMLENYRNLLSLAEPKQEIYPCSSCLLAFSCQ

SEQ ID NO: 7938 - protein, 81 aa, Callithrix jacchus
PSNDTDWPQEKEEKVQIVVPVTFRGVTVIFTEAEWKRLSPEQRNLYKEVMLENYRNLLSLDGVLLLLPRLECNGMISTHCN

SEQ ID NO: 7939 - protein, 81 aa, Callithrix jacchus
ENIETMKKLAQNRKAKGLPSNDTDWPQEKEEKVQIVVPVTFRGVTVIFTEAEWKRLSPEQRNLYKEVMLENYRNLLSLGTE

SEQ ID NO: 7940 - protein, 81 aa, Callithrix jacchus
KNGENIETMKKLAQNRKAKGLPSNDTDWPQEKEEKVQIVVPVTFRGVTVIFTEAEWKRLSPEQRNLYKEVMLENYRNLLSL

SEQ ID NO: 7941 - protein, 81 aa, Callithrix jacchus
MAFRDVAVDFTQDEWRLLSPAQRTLYREVMLENYSNLVSLGISFSKPEIITQLEQGKETWREEKKCPPATCPDPEPELCLD

SEQ ID NO: 7942 - protein, 81 aa, Callithrix jacchus
PLFFGGADPFLMALTQLQAHMAFRDVAVDFTQDEWRLLSPAQRTLYREVMLENYSNLVSLGISFSKPEIITQLEQGKETWR

SEQ ID NO: 7943 - protein, 81 aa, Callithrix jacchus
MAFRDVAVDFTQDEWRLLSPAQRTLYREVMLENYSNLVSLGISFSKPEIITQLEQGKETWREEKKCPPATCPADPEPELCL

SEQ ID NO: 7944 - protein, 81 aa, Callithrix jacchus
MAFRDVAVDFTQDEWRLLSPAQRTLYREVMLENYSNLVSLGISFSKPEIITQLEQGKETWREEKKCPPATCPDHQEYGNNC

SEQ ID NO: 7945 - protein, 81 aa, Callithrix jacchus
MAHMAFRDVAVDFTQDEWRLLSPAQRTLYREVMLENYSNLVSLGISFSKPEIITQLEQGKETWREEKKCPPATCPDPEPEL

SEQ ID NO: 7946 - protein, 81 aa, Callithrix jacchus
MESQGAKTESFMAFGDVTVDFTQKEWRLLSPAQRALYREVTLENYSHLISLGILHSKPELIRRLEQGEAPWGEERRHQPGP

SEQ ID NO: 7947 - protein, 81 aa, Callithrix jacchus
MNTSQGSVLFEDVSVYFTQEEWQLLDPAQRFLYRDVMLENYRHLVSLGHCATKPELIVKLKQGDEPWILKRELPSQSHSDF

SEQ ID NO: 7948 - protein, 81 aa, Callithrix jacchus
PKMNKFQRSVSFQDLTVNFTQEEWQQLDPAQRLLYRDVMLENYSNLVSVGYHVSKPDVIFKLEQGEEPWIVEEFSNQNYPE

SEQ ID NO: 7949 - protein, 81 aa, Callithrix jacchus
MLENYSNLVSVGYHVSKPDVIFKLEQGEEPWIVEEFSNQNYPEVDDALEKNKEIQTVFFSNKTLITERENVFGTTFNLGMN

SEQ ID NO: 7950 - protein, 81 aa, Callithrix jacchus
ALFPEATAFEDMTKDWNYLEASQKDYYRDTMLDSYENMVPQGSFLEFSMMPQRAGNDPPGASNASEMEMEMSNMREKFLMS

SEQ ID NO: 7951 - protein, 81 aa, Callithrix jacchus
LQGKYGNVTKEVIVLYLTLCKQCHQKNPVPKRGLAPKPLTFKDIDSTCQVEILDMQSSADGEFKFILYYQDHLTKFIILRP

SEQ ID NO: 7952 - protein, 81 aa, Callithrix jacchus
MTKDWNYLEASQKDYYRDTMLDSYENMVPQGSFLEFSMMPQRAGNDPPGASNASEMEMEMSNMREKFLMSVTKLVESKSYN

SEQ ID NO: 7953 - protein, 81 aa, Callithrix jacchus
PVLLKLLLSPGLQQPALFPEATAFEDMTKDWNYLEASQKDYYRDTMLDSYENMVPQGSFLEFSMMPQRAGNDPPGASNASE

SEQ ID NO: 7954 - protein, 81 aa, Callithrix jacchus
QGKYGNVTKEVIVLYLTLCKQCHQKNPVPKRGLAPKPLTFKDIDSTCQVEILDMQSSADGEFKFILYYQDHLTKFIILRPL

SEQ ID NO: 7955 - protein, 81 aa, Callithrix jacchus
ASQPAGLAERLIRDQDLGTTLLPAAPQEQWRHLDSTQKEQYWDLMLETYGKMVSGAGISHSKPDLTNSIEYGEELAGLYLH

SEQ ID NO: 7956 - protein, 81 aa, Callithrix jacchus
ASQPAGLAERLIRDQDLGTTLLPAAPQEQWRHLDSTQKEQYWDLMLETYGKMVSGGISHSKPDLTNSIEYGEELAGLYLHV

SEQ ID NO: 7957 - protein, 81 aa, Callithrix jacchus
ASQPAGLAERLIRDQDLGTTLLPAAPQEQWRHLDSTQKEQYWDLMLETYGKMVSGGDRQENDKENLNLENHRDQELLHASC

SEQ ID NO: 7958 - protein, 81 aa, Callithrix jacchus
AASQPAGLAERLIRDQDLGTTLLPAAPQWRHLDSTQKEQYWDLMLETYGKMVSGGISHSKPDLTNSIEYGEELAGLYLHVN

SEQ ID NO: 7959 - protein, 81 aa, Callithrix jacchus
FQEKSTEEGEVAALRLTARSQETVTFKDVAMDFTPEEWGKLDPAQRDMMLENYRNLVSLWLPVSKLENYTLENGKEPLKLE

SEQ ID NO: 7960 - protein, 81 aa, Callithrix jacchus
RSQETVTFKDVAMDFTPEEWGKLDPAQRDMMLENYRNLVSLWLPVSKLENYTLENGKEPLKLERKAPKNSYSVTVAVIILY

SEQ ID NO: 7961 - protein, 81 aa, Callithrix jacchus
LRLTARSQETVTFKDVAMDFTPEEWGKLDPAQRDMMLENYRNLVSLWLPVSKLENYTLENGKEPLKLERKAPKNSYSELPF

SEQ ID NO: 7962 - protein, 81 aa, Callithrix jacchus
EGEVAALRLTARSQETVTFKDVAMDFTPEEWGKLDPAQRDMMLENYRNLVSLWLPVSKLENYTLENGKEPLKLERKAPKNS

SEQ ID NO: 7963 - protein, 81 aa, Callithrix jacchus
SQETVTFKDVAMDFTPEEWGKLDPAQRDMMLENYRNLVSLWLPVSKLENYTLENGKEPLKLERKAPKNSYSGESDRWESSE

SEQ ID NO: 7964 - protein, 81 aa, Callithrix jacchus
TFKDVAMDFTPEEWGKLDPAQRDMMLENYRNLVSLWLPVSKLENYTLENGKEPLKLERKAPKNSYSGAVAHTCNPCTLGGR

SEQ ID NO: 7965 - protein, 81 aa, Callithrix jacchus
TQPDEDLHLQAEETELVKESVTFKDVAIDFTLEEWRLMDPIQRNLHKDVMLENYRNLVFVGLAVSKPDMISHLENGKGPWV

SEQ ID NO: 7966 - protein, 81 aa, Callithrix jacchus
PEVTQPDEDLHLQAEETELVKESVTFKDVAIDFTLEEWRLMDPIQRNLHKDVMLENYRNLVFVGLAVSKPDMISHLENGKG

SEQ ID NO: 7967 - protein, 81 aa, Callithrix jacchus
LRGKHAFQAGWLNDLVTKESMTFKDVAVDITQEDWELMRPVQKELYKTVTLQNYWNMVSLGLTVYRPTVIPILEEPWMVIK

SEQ ID NO: 7968 - protein, 81 aa, Callithrix jacchus
LWSKQEGSFCHRSLVKLHEGLVSFEDVAVHFTWEEWQDLGDAQRTLYRDVMLETYTSLLSLAIQTVNDLIERNQESHDRFF

SEQ ID NO: 7969 - protein, 81 aa, Callithrix jacchus
WSKQEGSFCHRSLVKLHEGLVSFEDVAVHFTWEEWQDLGDAQRTLYRDVMLETYTSLLSLGHCITKPEMIFKLEQGAGPWM

SEQ ID NO: 7970 - protein, 81 aa, Callithrix jacchus
EWQDLGDAQRTLYRDVMLETYTSLLSLGHCITKPEMIFKLEQGAGPWMVEEAPNRDFQLSRLLMTLLKGTRKVMIDFSGKL

SEQ ID NO: 7971 - protein, 81 aa, Callithrix jacchus
LCFQCPLGVSKSNKKCINLWSKQEGSFCHRSLVKLHEGLVSFEDVAVHFTWEEWQDLGDAQRTLYRDVMLETYTSLLSLGV

SEQ ID NO: 7972 - protein, 81 aa, Callithrix jacchus
MAATLLMAGSQAPVTFEDMAMYLTREEWRPLDPAQRDLYRDVMQENYGNVVSLDFEIRSDSEVNPKQEISEDVQFGTASER

SEQ ID NO: 7973 - protein, 81 aa, Callithrix jacchus
FGTASERPAENAEENPESEEVFESRDRSERQWGDLTAEEWVSYPLQQVTDLLVHKEVHTGIRYHICSHCGKAFSQISDLNR

SEQ ID NO: 7974 - protein, 81 aa, Callithrix jacchus
GENLESRVTLGSPAAESQELLTFKDVSVDFTQEEWGQLAPAHRNLYREVMLENYGNLVSVGYQLSKPGLISQLEKGEEPWL

SEQ ID NO: 7975 - protein, 81 aa, Callithrix jacchus
EESLEDEVNPGLPTAESQELLTFKDISIDFTQEEWGQLTPAYQNLYREVMLENYSNLVSVGYQLSKPSVISQLEKGEEPWM

SEQ ID NO: 7976 - protein, 81 aa, Callithrix jacchus
EEPWMTEKEGSGDPSSDLKSNTETTESTAKNTISQEQLYHGIMMERFMRDDIIYSTLRKVSTYDDVLERHQETCVRDVRQA

SEQ ID NO: 7977 - protein, 81 aa, Callithrix jacchus
MINFQESVTFQDVAVDFTPEEWQLLDCAERTLYWDVMLENYRNFISVGCPVTKTKVIIKAEQGQEPWMVERVNPHQSSPES

SEQ ID NO: 7978 - protein, 81 aa, Callithrix jacchus
MINFQESVTFQDVAVDFTPEEWQLLDCAERTLYWDVMLENYRNFISVGCPVTKTKVIIKAEQGQEPWMVERVNPHQSSPDK

SEQ ID NO: 7979 - protein, 81 aa, Callithrix jacchus
MEPRESGKAPVTFDDITVYLLQEEWVLLSQQQKELCGSDKLVPPLGPTVANPELFRKFRRGPEPWLGSVQGQRSLLEHHPG

SEQ ID NO: 7980 - protein, 81 aa, Callithrix jacchus
QDPSAERLMEEVPVVFEELPVVFEDVAVYFTREEWGMLDKRQKELYRDVMRMNYELLASLGPAAAKPDLISKLERRAAPWI

SEQ ID NO: 7981 - protein, 81 aa, Callithrix jacchus
MARKVSITFKDLAVRFSEEEWRLLEEGQREFYRDVMRENYETLVSVGTAELLPLSAFLSPSEPGGAIGGGSRTDEGQEPAG

SEQ ID NO: 7982 - protein, 81 aa, Callithrix jacchus
MRENYETLVSVGTAELLPLSAFLSPSEPGGAIGGGSRTDEGQEPAGCGGPQGGQPRHSLHLTALVQLVKEIPEFLFGEVKG

SEQ ID NO: 7983 - protein, 81 aa, Callithrix jacchus
KKLADCEKTAVEFGNQLEGKWAVLGTLLQEYGLLQRRLENVENLLRNRNFWILRLPPGSKGEAPKVPVTFDDVAVYFSEQE

SEQ ID NO: 7984 - protein, 81 aa, Callithrix jacchus
RNFWILRLPPGSKGEAPKVPVTFDDVAVYFSEQEWGKLEDWRKELYKHVMRGNYETLVSLDYAISKPEVLSQIEQGKEPCS

SEQ ID NO: 7985 - protein, 81 aa, Callithrix jacchus
KKLADCEKTAVEFGNQLEGKWAVLGTLLQEYGLLQRRLENVENLLRNRNFWILRLPPGSKGEAPKEWGKLEDWRKELYKHV

SEQ ID NO: 7986 - protein, 81 aa, Callithrix jacchus
LENVENLLRNRNFWILRLPPGSKGEAPKEWGKLEDWRKELYKHVMRGNYETLVSLDYAISKPEVLSQIEQGKEPCSWRCPG

SEQ ID NO: 7987 - protein, 81 aa, Callithrix jacchus
RNFWILRLPPGSKGEAPKVPVTFDDVAVYFSEQEWGKLEDWQKELYKHVMRGNYETLVSLDYAISKPEVLSQIEQGKEPCS

SEQ ID NO: 7988 - protein, 81 aa, Callithrix jacchus
KKLADCEKTAVEFGNQLEGKWAVLGTLLQEYGLLQRRLENVENLLRNRNFWILRLPPGSKGEAPKEWGKLEDWQKELYKHV

SEQ ID NO: 7989 - protein, 81 aa, Callithrix jacchus
LENVENLLRNRNFWILRLPPGSKGEAPKEWGKLEDWQKELYKHVMRGNYETLVSLDYAISKPEVLSQIEQGKEPCSWRRPG

SEQ ID NO: 7990 - protein, 81 aa, Callithrix jacchus
KKLADCEKTAMEFRNQLEGKWAVLGTLLQEYGLLQRRLENMENLLRNRNFWILRLPPGSKGEAPKVPVTFDDVAVYFSELE

SEQ ID NO: 7991 - protein, 81 aa, Callithrix jacchus
RNFWILRLPPGSKGEAPKVSRSLENDGVCFTEQEWENLEDWQKELYRNVMESNYETLVSLKVLGQPEGEAELGTGMLGDLE

SEQ ID NO: 7992 - protein, 81 aa, Callithrix jacchus
PGGAHPAGGVMIKQELQYTQEGPADLPGEFSCIAEEQAFLSPEQTELWDGQGGSVLLETSPGDSTLEEPVGSGDPSSGRTL

SEQ ID NO: 7993 - protein, 81 aa, Callithrix jacchus
NFWILRLPPGSKGEAPKVSRSLENDGVCFTEQEWENLEDWQKELYRNVMESNYETLVSLSGVLLCRPGWSAMAGSWLTATT

SEQ ID NO: 7994 - protein, 81 aa, Callithrix jacchus
NFWILRLPPGSKGEAPKVSRSLENDGVCFTEQEWENLEDWQKELYRNVMESNYETLVSLSSSDSPTSASIAGITEVLGQPE

SEQ ID NO: 7995 - protein, 81 aa, Callithrix jacchus
LEEEGPGGAHPAGGVMIKQELQYTQEGPADLPGEFSCIAEEQAFLSPEQTELWDGQGGSVLLETSPGDSTLEEPVGSGDPS

SEQ ID NO: 7996 - protein, 81 aa, Callithrix jacchus
KKLADCEKTAVEFGNHMESKWAMLGTLLQEYGLLQRRLENLENLLRNRNFWVLRLPPGSKGEAPKVPVTFVDIAVYFSEDE

SEQ ID NO: 7997 - protein, 81 aa, Callithrix jacchus
RNFWVLRLPPGSKGEAPKVPVTFVDIAVYFSEDEWKNLDEWQKELYNNLVKENYKTLMSLDADGPVPKPDAPAQAEPREEP

SEQ ID NO: 7998 - protein, 81 aa, Callithrix jacchus
EEALCVRGQRSLEERAIPTESITDSPVCAQDLLSRIKQEEHQCVWDQQDLADREIPTDPNSESLISAHDILSWIKQEEQPY

SEQ ID NO: 7999 - protein, 81 aa, Callithrix jacchus
MAEPASGTLTFDDVALYFSEQEWEILEKWQKQMYKQEMKTNYETLDSLGYAFSKPDLITWMEKGRMLLISDQGRLHKTKRT

SEQ ID NO: 8000 - protein, 81 aa, Callithrix jacchus
QGRLHKTKRTAGPPTDEQLVMKNTEKLPCFDDRGTLGTKEEDCHLNGPQKQDLCAALPRRERKILSAQRASFQSPNLQETE

SEQ ID NO: 8001 - protein, 81 aa, Callithrix jacchus
GRGCRLCRNSGPCRGWSGGTLTFDDVALYFSEQEWEILEKWQKQMYKQEMKTNYETLDSLGYAFSKPDLITWMEKGRMLLI

SEQ ID NO: 8002 - protein, 81 aa, Callithrix jacchus
SLGYAFSKPDLITWMEKGRMLLISDQGRLHKTKRTAGPPTDEQLVMKNTEKLPCFDDRGTLGTKEEDCHLNGPQKQDLCAA

SEQ ID NO: 8003 - protein, 81 aa, Callithrix jacchus
MTEPLRLPLTFEDVAIYFSEQEWQDLQAWQKELYKRVMRSNYETLISLDDGLPKPELIAWIEQGEEPFRNWRESQKSGNII

SEQ ID NO: 8004 - protein, 81 aa, Callithrix jacchus
MIQSQISFEDVAVDFTLEEWQLLNPTQKNLYREVMLENYSNLVFLGYQIIKPDAISKWEQQDPWIIDQEILSQNFSEVWLD

SEQ ID NO: 8005 - protein, 81 aa, Callithrix jacchus
MIQSQISFEDVAVDFTLEEWQLLNPTQKNLYREVMLENYSNLVFLEVWLDNPKMWLQDNQDNLKSMERGNKYGVFGNIFKS

SEQ ID NO: 8006 - protein, 81 aa, Callithrix jacchus
MATSFRIASWWGWLSFKDISMEFTWDEWQLLDSTQKYLYREVILENYHNLISVGYHGAKPDLIFKLEQGEDPWIVNAKISR

SEQ ID NO: 8007 - protein, 80 aa, Callithrix jacchus
MATSFRIASWWGWLSFKDISMEFTWDEWQLLDSTQKYLYREVILENYHNLISVDGWEEWYQKNQDELESVERSYACSVLG

SEQ ID NO: 8008 - protein, 81 aa, Callithrix jacchus
TFRNLGGTPWPQGNSALPGWLSFKDISMEFTWDEWQLLDSTQKYLYREVILENYHNLISVGYHGAKPDLIFKLEQGEDPWI

SEQ ID NO: 8009 - protein, 81 aa, Callithrix jacchus
REVILENYHNLISVGYHGAKPDLIFKLEQGEDPWIVNAKISRESCPDGWEEWYQKNQDELESVERSYACSVLGRLNLSKTH

SEQ ID NO: 8010 - protein, 81 aa, Callithrix jacchus
MTMLQDSFSFDDLSVDFTQKEWQLLDPSQKNLYKDVMLENYSSLVSLGYEAMKPDVIFKLEQGEEPWIGDEEIPSSWSPDI

SEQ ID NO: 8011 - protein, 81 aa, Callithrix jacchus
MTMLQDSFSFDDLSVDFTQKEWQLLDPSQKNLYKDVMLENYSSLVSLGYEAMKPDVIFKLEQGEEPWIGDEEIPSSWSPVW

SEQ ID NO: 8012 - protein, 81 aa, Callithrix jacchus
MTMLQDSFSFDDLSVDFTQKEWQLLDPSQKNLYKDVMLENYSSLVSLGYEAMKPDVIFKLEQGEEPWIGDEEIPSSWSPGT

SEQ ID NO: 8013 - protein, 81 aa, Callithrix jacchus
MSQGSVTFRDVAIDFSQEEWKWLQPAQRDLYRCVMLENYGHLVSLGLSISKPDVVSLLEQGKEPWLGKRDVKRDLFPVSES

SEQ ID NO: 8014 - protein, 81 aa, Callithrix jacchus
MLENYGHLVSLGLSISKPDVVSLLEQGKEPWLGKRDVKRDLFPVSESNGEIKDFSSKNVIYDDSSQYLIMEGILSQGPVYS

SEQ ID NO: 8015 - protein, 81 aa, Callithrix jacchus
MSQGSVTFRDVAIDFSQEEWKWLQPAQRDLYRCVMLENYGHLVSLAGLSISKPDVVSLLEQGKEPWLGKRDVKRDLFPVRV

SEQ ID NO: 8016 - protein, 81 aa, Callithrix jacchus
MSQGSVTFRDVAIDFSQEEWKWLQPAQRDLYRCVMLENYGHLVSLGLSISKPDVVSLLEQGKEPWLGKRDVKRDLFPVLKE

SEQ ID NO: 8017 - protein, 81 aa, Callithrix jacchus
IREFGGMGAGIANIWSFQGSVTFRDVAIDFSQEEWKWLQPAQRDLYRCVMLENYGHLVSLGLSISKPDVVSLLEQGKEPWL

SEQ ID NO: 8018 - protein, 81 aa, Callithrix jacchus
RSADEERMIAVFLTTWLQEPMTFKDIAVEFTQEEWIMLDSSQRSLYKDVMLENYRNLTSVEYQLCKLTVISPLHQEEIRSM

SEQ ID NO: 8019 - protein, 81 aa, Callithrix jacchus
SMNKINPQAICPDQKIQPKTKESTMQNILGEEPFNAVKIKFTMDNWSSTLREDWECHKIRKQHKIPGVHWRQVTYAPKETV

SEQ ID NO: 8020 - protein, 81 aa, Callithrix jacchus
MDAKSLTAWSQTLVTFKDVFVDFTREEWKLLDTAQQIVYRNVMLENYKNLVSLGYQLTKPDVILRLEKGEEPWVVERGIHQ

SEQ ID NO: 8021 - protein, 81 aa, Callithrix jacchus
VLECLFISQEQTQITRSWGPLSFMDVFVDFTWEEWQLLDPAQKCLYRSVMLENYSNLVSLGYQHTKPDIIFKLEQGEELCM

SEQ ID NO: 8022 - protein, 81 aa, Callithrix jacchus
MDVFVDFTWEEWQLLDPAQKCLYRSVMLENYSNLVSLGYQHTKPDIIFKLEQGEELCMVQAPIPNQCCPNKVWKIDDLMEW

SEQ ID NO: 8023 - protein, 81 aa, Callithrix jacchus
QRQKSHRTEKVLECLFISQEQTQITRSWEWQLLDPAQKCLYRSVMLENYSNLVSLGYQHTKPDIIFKLEQGEELCMVQAPI

SEQ ID NO: 8024 - protein, 81 aa, Callithrix jacchus
MATRVRTASVWGPLSFMDVFVDFTWEEWQLLDPAQKCLYRSVMLENYSNLVSLGYQHTKPDIIFKLEQGEELCMVQAPIPN

SEQ ID NO: 8025 - protein, 81 aa, Callithrix jacchus
SFMDVFVDFTWEEWQLLDPAQKCLYRSVMLENYSNLVSLGYQHTKPDIIFKLEQGEELCMVQAPIPNQCCPILEAGKLEAK

SEQ ID NO: 8026 - protein, 81 aa, Callithrix jacchus
MGPLTFRDVAIEFSLEEWQCLDTAQQDLYRKVMLENYRNLVFLAGIAVSKADLITCLQQEKVPWNMKRHSMAATPPVLCSH

SEQ ID NO: 8027 - protein, 81 aa, Callithrix jacchus
MGPLTFRDVAIEFSLEEWQCLDTAQQDLYRKVMLENYRNLVFLGIAVSKADLITCLQQEKVPWNMKRHSMAATPPVLCSHF

SEQ ID NO: 8028 - protein, 81 aa, Callithrix jacchus
MAMSQESLTFKDVFVDFTLEEWQQLDSAQKNLYRDVMLENYSHLVSVGYLLAKPDMIFRLGPGEESWRADGGTPVRTCAEV

SEQ ID NO: 8029 - protein, 81 aa, Callithrix jacchus
MAMSQESLTFKDVFVDFTLEEWQQLDSAQKNLYRDVMLENYSHLVSVGYLLAKPDMIFRLGPGEESWRADGGTPVRTCAGE

SEQ ID NO: 8030 - protein, 81 aa, Callithrix jacchus
MAMSQESLTFKDVFVDFTLEEWQQLDSAQKNLYRDVMLENYSHLVSVGYLLAKPDMIFRLGPGEESWRADGGTPVRTCAGK

SEQ ID NO: 8031 - protein, 81 aa, Callithrix jacchus
MAMSQESLTFKDVFVDFTLEEWQQLDSAQKNLYRDVMLENYSHLVSVGYLLAKPDMIFRLGPGEESWRADGGTPVRTCAGN

SEQ ID NO: 8032 - protein, 81 aa, Callithrix jacchus
MATSQESLTFKDVFVDFTLEEWQQLDSAQKNLYRDVMLENYSHLVSVGYLLAKPDMIFRLGPGEESWRADGGTPVRTCAGE

SEQ ID NO: 8033 - protein, 81 aa, Callithrix jacchus
MATSQESLTFKDVFVDFTLEEWQQLDSAQKNLYRDVMLENYSHLVSVGYLLAKPDMIFRLGPGEESWRADGGTPVRTCAVW

SEQ ID NO: 8034 - protein, 81 aa, Callithrix jacchus
MKTKTFKESLTFKDVFVDFTLEEWQQLDSAQKNLYRDVMLENYSHLVSVGYLLAKPDMIFRLGPGEESWRADGGTPVRTCA

SEQ ID NO: 8035 - protein, 81 aa, Callithrix jacchus
MATSQESLTFKDVFVDFTLEEWQQLDSAQKNLYRDVMLENYSHLVSVGYLLAKPDMIFRLGPGEESWRADGGTPVRTCAVF

SEQ ID NO: 8036 - protein, 81 aa, Callithrix jacchus
SPQAFPALIPGEHGRSFEGSVSFEDVAVDFTRQEWHRLDPAQRTMHKDVMLETYSNLASVGLCVAKPEMIFKLERGEELWI

SEQ ID NO: 8037 - protein, 81 aa, Callithrix jacchus
SSPWSLALATEGRGSSYEISVSFEDVTVDFSKEEWQHLDPAQRRLYWDVTLENYSHLLSVGYHIPKSEATFKLEQGEGPWT

SEQ ID NO: 8038 - protein, 81 aa, Callithrix jacchus
EAHMSADHAALNRIVSLQISVSFEDVTVDFSKEEWQHLDPAQRRLYWDVTLENYSHLLSVGYHIPKSEATFKLEQGEGPWT

SEQ ID NO: 8039 - protein, 81 aa, Callithrix jacchus
MPANEDTPQPGGHGSACEVSVSFEDVTVDFSREEWQQLDSTQRRLYQDVMLENYSHLLSVGFEVPKPEVIFKLEQGEGPWT

SEQ ID NO: 8040 - protein, 81 aa, Callithrix jacchus
MAKPQGLVTFEDVAVAFTQEEWQYLNPLQRTLYRDVMLETYSNLVFVGQQVTKPDLILKLEVEECPVEEKIPFWSFPEICQ

SEQ ID NO: 8041 - protein, 81 aa, Callithrix jacchus
GLVTFEDVAVAFTQEEWQYLNPLQRTLYRDVMLETYSNLVFVGQQVTKPDLILKLEVEECPVEEKIPFWSFPEICQVNEQI

SEQ ID NO: 8042 - protein, 81 aa, Callithrix jacchus
MIESQESVTFEDVAVDFTQEEQQLNPAQKTLHRDVMLETYSHLVSVGCSGIKPDVIFKVEHEKDPWTKDSVLSRWIYPGRL

SEQ ID NO: 8043 - protein, 81 aa, Callithrix jacchus
MIESQESVTFEDVAVDFTQEEQQLNPAQKTLHRDVMLETYSHLVSVGCSGIKPDVIFKVEHEKDPWTKDSVLSRWIYPDRE

SEQ ID NO: 8044 - protein, 81 aa, Callithrix jacchus
MVEGEEEQQLNPAQKTLHRDVMLETYSHLVSVGCSGIKPDVIFKVEHEKDPWTKDSVLSRWIYPDREKGLKSSQQIISGEL

SEQ ID NO: 8045 - protein, 80 aa, Callithrix jacchus
MIESQESVTFEDVAVDFTQEEQQLNPAQKTLHRDVMLETYSHLVSVGCSGIKPDVIFKVEHEKDPWTKDSVLSRWIYPER

SEQ ID NO: 8046 - protein, 81 aa, Callithrix jacchus
MIESQEEQQLNPAQKTLHRDVMLETYSHLVSVGCSGIKPDVIFKVEHEKDPWTKDSVLSRWIYPDREKGLKSSQQIISGEL

SEQ ID NO: 8047 - protein, 81 aa, Callithrix jacchus
GDGSFAKNPSDDEQISENKRKAFADIAQYFSKKDWKKLKYSEKITYVYMKRNYEAMRTLGFQVTIPLFMRDKQAEDSQEDD

SEQ ID NO: 8048 - protein, 81 aa, Callithrix jacchus
QAPDMLHRFYGKNSSYVHGGLDSNGKPADAIYGQKEIHRKVMSENFTNCHTKIRHVDAHAMLNDGVVVQVMGLLSNNNQAL

SEQ ID NO: 8049 - protein, 81 aa, Callithrix jacchus
KSTKDWKMASEFILPASQSLLTFEDVAVYFSEEEWQLLDPPEKTLYNDVMQDIYETVISLGLKLKSDTGNDHPVSVSTSEM

SEQ ID NO: 8050 - protein, 81 aa, Callithrix jacchus
MAAILLTTRPKVPVSFEDVSLYFTKTEWKLLDLRQKVLYKRVMLENYSHLVSLGFSFSKPHLISQLERGEGPWVADIPRTR

SEQ ID NO: 8051 - protein, 81 aa, Aotus trivirgatus
MGVLTFRDVAIEFSPEEWECLDSAQQHLYRDVMLENYRNLVSLGLAIFKPDLITCLEQRKEPWNLKKQETLAKYPAKHKII

SEQ ID NO: 8052 - protein, 81 aa, Aotus trivirgatus
MGVLTFRDVAIEFSPEEWECLDSAQQHLYRDVMLENYRNLVSLGLAIFKPDLITCLEQRKEPWNLKKQETLAKYPDLAKHK

SEQ ID NO: 8053 - protein, 80 aa, Aotus trivirgatus
MGVLTFRDVAIEFSPEEWECLDSAQQHLYRDVMLENYRNLVSLGLAIFKPDLITCLEQRKEPWNLKKQETLAKYPVNIRL

SEQ ID NO: 8054 - protein, 81 aa, Aotus trivirgatus
MEEKEMNDGSQMVRSQESLTFQDVAVDFTREEWDQLYPAQKDLYRDVMLENYRNLVALGHQLYKPEVIAQLELEEEWMIER

SEQ ID NO: 8055 - protein, 81 aa, Aotus trivirgatus
MPSQSAVFSQEENMEEKEMNDGSQMVRSQESLTFQDVAVDFTREEWDQLYPAQKDLYRDVMLENYRNLVALGHQLYKPEVI

SEQ ID NO: 8056 - protein, 81 aa, Aotus trivirgatus
ENMEEKEMNDGSQMVRSQESLTFQDVAVDFTREEWDQLYPAQKDLYRDVMLENYRNLVALGHQLYKPEVIAQLELEEEWMI

SEQ ID NO: 8057 - protein, 81 aa, Aotus trivirgatus
GGLWDFDYHPEFNQEDQQRYLGQVTLTHKKITHQRNLECNKFTENCNLNSTLRHQRIPSIKIPLNSDTQGSNIKHNSDLIY

SEQ ID NO: 8058 - protein, 81 aa, Aotus trivirgatus
DSLGDEMLAAALLKAKSQELVTFEDVAVYFIRKEWKRLEPAQRDLYRDVMLENYGNVFSLDRIRVSLTIQKVMLAWFTGTL

SEQ ID NO: 8059 - protein, 81 aa, Aotus trivirgatus
EGSPRDQAMASALFTADSQAMVKIEDMAVSLILEEWGCQNLARRNLSRDNRQENYGSAFPQGGENRNENEESTSKAETAKD

SEQ ID NO: 8060 - protein, 81 aa, Aotus trivirgatus
MASALFTADSQAMVKIEDMAVSLILEEWGCQNLARRNLSRDNRQENYGSAFPQGGENRNENEESTSKAETAKDSASRGETA

SEQ ID NO: 8061 - protein, 81 aa, Aotus trivirgatus
GPGLPTMNPRDQEMAAGFFTAGSQGLGPFKDMALAFPEEEWRHVTPAQIDCFGEYVEPQDCRVSPGIGSKEKEAKPPQEDL

SEQ ID NO: 8062 - protein, 81 aa, Aotus trivirgatus
SQELTTSLLSTGSQKLVKIEEVADVAVSFILEEWGHLDQSQKSLYRDDRKENYGSITSMDYESRDNMDLMVKQVSDDTESH

SEQ ID NO: 8063 - protein, 81 aa, Aotus trivirgatus
HLKRHFREKSQRCSDKRSKNAKLSVKKKISEFSEADMDLSGKTQRNISQDQDFGECCELQGKLDRKQGIPMKEILGQPSSK

SEQ ID NO: 8064 - protein, 81 aa, Aotus trivirgatus
EEAVAVVQALQRALDGTSPQGMMTFEDMAMSLTWEEWERLDPARKDFYRESMQKDSGSTVPPSLESRTENKELIPVQEILE

SEQ ID NO: 8065 - protein, 81 aa, Aotus trivirgatus
GEEHGNTCNQSFHVVTWHVLKPHKSHSGDSFHHSSLFKTQRQLHEERPYKCDNCGKSFKQRSDLFRHQRIHTGEKPYGCQE

SEQ ID NO: 8066 - protein, 81 aa, Aotus trivirgatus
MFPPVCGKELLSFEDVAMYFTREEWGHLDWGQKDLYRDVMLENYRNMVLLGFQFPKPEVICQLENWDEQWILDLPRAGNRK

SEQ ID NO: 8067 - protein, 81 aa, Aotus trivirgatus
MELLSFEDVAMYFTREEWGHLDWGQKDLYRDVMLENYRNMVLLGFQFPKPEVICQLENWDEQWILDLPRAGNRKASGSACP

SEQ ID NO: 8068 - protein, 81 aa, Aotus trivirgatus
EDEDEDEDEDDLLTAGSQGLVTFEDVAVYFSLEEWERLEADQRGLYQEVMQENYGILVSLGYPIPKPDLIFRLEQGEEPWV

SEQ ID NO: 8069 - protein, 81 aa, Aotus trivirgatus
MLENYSNLVSVGYHIIKPDVITKLEQGEEPWIVEGEFLLQSYPDEVWQTDDLIERVQEDENKPSRQTVFIKTLTEEREYIS

SEQ ID NO: 8070 - protein, 81 aa, Aotus trivirgatus
MNKSLGPVSFKDVAVDFTQEEWQQLDPEQKITYRDVMLENYSNLVSVGYHIIKPDVITKLEQGEEPWIVEGEFLLQSYPDE

SEQ ID NO: 8071 - protein, 81 aa, Aotus trivirgatus
MNKLQGPMSFKDVAVDFTQEEWQQLDPDEKITYRDVMLENYSHLVSVGCNITKPNVIIKLEQGEEPWIMEDEFPCQHSPEV

SEQ ID NO: 8072 - protein, 81 aa, Aotus trivirgatus
MNKLQGPMSFKDVAVDFTQEEWQQLDPDEKITYRDVMLENYSHLVSVGCNITKPNVIIKLEQGEEPWIMEDEFPCQHSPAA

SEQ ID NO: 8073 - protein, 81 aa, Aotus trivirgatus
MLENYSNLVSVGYHVSKPDVIFKLEQGEEPWIVEEFSNQNYPEVDHTLEKNREIQDKHLRPTAFFSNKTLITERENVFGTT

SEQ ID NO: 8074 - protein, 81 aa, Aotus trivirgatus
LAQNHKAKGLPSNDTDWPQEKERKAIVVPVTFRDVTVIFTEAEWKRLSPEQRNLYKEVMLESYRNLLSLDGGQEQQDAAAY

SEQ ID NO: 8075 - protein, 81 aa, Aotus trivirgatus
LPSNDTDWPQEKERKAIVVPVTFRDVTVIFTEAEWKRLSPEQRNLYKEVMLESYRNLLSLAELKPEIYPCSSCLLAFSCQQ

SEQ ID NO: 8076 - protein, 81 aa, Aotus trivirgatus
PSNDTDWPQEKERKAIVVPVTFRDVTVIFTEAEWKRLSPEQRNLYKEVMLESYRNLLSLDRVLLLLPRLQCNGIILTHCNL

SEQ ID NO: 8077 - protein, 81 aa, Aotus trivirgatus
SKSGENIETMKKLAQNHKAKGLPSNDTDWPQEKERKAIVVPVTFRDVTVIFTEAEWKRLSPEQRNLYKEVMLESYRNLLSL

SEQ ID NO: 8078 - protein, 81 aa, Aotus trivirgatus
EKETWKRKRRAKESVALPQGLLTFRDVAIEFSQEEWKSDPAQRTLYRDAMLENYRNLVSLDLSSKCVKKFLSMGQGNTVVF

SEQ ID NO: 8079 - protein, 81 aa, Aotus trivirgatus
MAATLLMAGSQAPVTFEDMAMYLTREEWRPLDPAQRDLYRDVMQENYGNVVSLDFEIRSESEVNPKQEISEDVQFGTTSER

SEQ ID NO: 8080 - protein, 81 aa, Aotus trivirgatus
FGTTSERPVENAEENPESEEPFESRDRSERQWGDLTAEEWVSYPLQQVTDLLVHKEVHTGIRYHICSHCGKAFSQISDLNR

SEQ ID NO: 8081 - protein, 81 aa, Aotus trivirgatus
MAVTFEDVTIIFTWEEWKFLDSSQKRLYREVMWENYTNVMSVGNWNESYKSQEEKFRYLEYENFSCWQAWWNAGTQIYEIQ

SEQ ID NO: 8082 - protein, 81 aa, Aotus trivirgatus
RKNLSMEKEQKLRVQHSYIPMEEALPQYIGVICQKDLLKDSMEEKYCRCNKCKEIYYWNSQCVFHKRNQPGENLYQCSISK

SEQ ID NO: 8083 - protein, 81 aa, Aotus trivirgatus
QKGSIKDKMKADSQTGKPQEPVTFKDVVVEFSKEEWGQLDSAVKNLYRDVMLENFRNVNSLRKAHLLSKPVESLELTKKKK

SEQ ID NO: 8084 - protein, 81 aa, Aotus trivirgatus
GPLEHLCCNLEEEPQSLQEKAQSAPWVPAIPQEGNTGDWEMAAALLAAGSQGLVTIKDVSLCFSQEEWRSLDPSQTDFYGE

SEQ ID NO: 8085 - protein, 81 aa, Aotus trivirgatus
MMKSQGLVSFKDVAVDFTQEEWQQLDPTQRTLYRDVMLENYSHLVSMGYPVSKPDVISKLEQGEEPWIVKRDISNWIYPDE

SEQ ID NO: 8086 - protein, 81 aa, Aotus trivirgatus
MLENYSHLVSMGYPVSKPDVISKLEQGEEPWIVKRDISNWIYPDEYQADGIQDRKSNLHNSESCILGTVFSQHKILKGVTK

SEQ ID NO: 8087 - protein, 81 aa, Aotus trivirgatus
ADPSSSGLLEEQKMMKSQGLVSFKDVAVDFTQEEWQQLDPTQRTLYRDVMLENYSHLVSMGYPVSKPDVISKLEQGEEPWI

SEQ ID NO: 8088 - protein, 81 aa, Aotus trivirgatus
NILDQEVTTTRLPSGSQEAVKDVHVARGFSYKKSVHQIPVHRGLYRDFRKENVGNMVSLGSTVSTSNRITRLEQRKEPWTL

SEQ ID NO: 8089 - protein, 81 aa, Aotus trivirgatus
APLPSWDPNRAGTDWREPGTVSFGDVAVYFSREEWGCLRPAQRALYRDVMRETYSHLGALGVGGSKPALISWVEEEAELWG

SEQ ID NO: 8090 - protein, 81 aa, Aotus trivirgatus
APLPSWDPNRAGTDWREPGTVSFGDVAVYFSREEWGCLRPAQRALYRDVMRETYSHLGALGESPTCSPGPCAFTSPAAPQE

SEQ ID NO: 8091 - protein, 81 aa, Aotus trivirgatus
ATLYSRDPNGAGPEWREPGAVTFGDVAVYFSREEWGCLRPAQRALYRDVTRETYSHLGALGVGGSKPALISWMEEEAELWG

SEQ ID NO: 8092 - protein, 81 aa, Aotus trivirgatus
PAHVTGETRPRLTRESRPGAVSFADVAVYFSPEEWGCMRPAQRALYRDVMRETCGHLGALGFSGPKSAFISWVEGEVEAWS

SEQ ID NO: 8093 - protein, 81 aa, Aotus trivirgatus
FISWVEGEVEAWSPEVQDPEGSRDGNEEKERVKNCPKQKEVAHEVALKEWLPSATFPELCSSPRQSPIKPWLMDTVTRRPP

SEQ ID NO: 8094 - protein, 81 aa, Aotus trivirgatus
VQDPEGESPGTVSRGQGQKAGSRDGNEEKERVKNCPKQKEVAHEVALKEWLPSATFPELCSSPRQSPIKPWLMDTVTRRPP

SEQ ID NO: 8095 - protein, 81 aa, Aotus trivirgatus
PARGPGEARPSRKRGRRPRALKFVDVAVYFSSEEWGCLRPAQRALYRDVMRETYGHLGALGCAGPKPALISWLERNTDDWE

SEQ ID NO: 8096 - protein, 81 aa, Aotus trivirgatus
MGLLTFRDVAIEFSLEEWEHLDSDQKNLYGDVMLENYRNLVCLGLAVSKPDLITFLEQRKEPWNVKSGETVETVAIQPDIF

SEQ ID NO: 8097 - protein, 81 aa, Aotus trivirgatus
HCAVTEHLTGAPAVPSVEGLLTFRDVAIEFSLEEWEHLDSDQKNLYGDVMLENYRNLVCLGLAVSKPDLITFLEQRKEPWN

SEQ ID NO: 8098 - protein, 81 aa, Aotus trivirgatus
MGLLTFRDVAIEFSVEEWEYLEPAQKNLYWDVMLENYRNLVSLGLAVSKPDLITFLEQRKEPWNVKSAETVAIQPDIFSHY

SEQ ID NO: 8099 - protein, 81 aa, Aotus trivirgatus
MLENYRNLVSLGLAVSKPDLITFLEQRKEPWNVKSAETVAIQPDIFSHYNKDLLTQHCTEASFQKVILRRHESCDLENLHI

SEQ ID NO: 8100 - protein, 81 aa, Aotus trivirgatus
MITAQGPVSFRDVTVGFTQEEWQHLDPAQRTLYRDVMIENYSHLVSVGYCIPKPEVILKLEKGEEPWISEEKFPSQSHLGC

SEQ ID NO: 8101 - protein, 81 aa, Aotus trivirgatus
MITAQGPVSFRDVTVGFTQEEWQHLDPAQRTLYRDVMIENYSHLVSVGYCIPKPEVILKLEKGEEPWISEEKFPSQSHLGS

SEQ ID NO: 8102 - protein, 81 aa, Aotus trivirgatus
MITAQGPVSFRDVTVGFTQEEWQHLDPAQRTLYRDVMIENYSHLVSVGYCIPKPEVILKLEKGEEPWISEEKFPSQSHLEL

SEQ ID NO: 8103 - protein, 81 aa, Aotus trivirgatus
MNKFQEQVSFKDVCVDFTQEEWYLLDPAQKILYRDVILENYSNLVSVGYCITKPEVIFKIEQGEEPWILEKGFPSQCHPER

SEQ ID NO: 8104 - protein, 81 aa, Aotus trivirgatus
MNKFQGPVTLKDVTVEFTKEEWKLLTPAQRTLYKDVMLENYSHLASVGYRVNKPNVVFKLKQGKEPWMLVVEFPHRGLPED

SEQ ID NO: 8105 - protein, 81 aa, Aotus trivirgatus
SSWISSPVCSTDVEQKFQGSISFKDVTVGFTQEEWQHLDLSQRALYRDVMLENYSNLVSVGYCLHKPEVIFRLEQGEEPWR

SEQ ID NO: 8106 - protein, 81 aa, Aotus trivirgatus
RANATRGSGVEQKFQGSISFKDVTVGFTQEEWQHLDLSQRALYRDVMLENYSNLVSVGYCLHKPEVIFRLEQGEEPWRLEE

SEQ ID NO: 8107 - protein, 81 aa, Aotus trivirgatus
MNKVEQKFQGSISFKDVTVGFTQEEWQHLDLSQRALYRDVMLENYSNLVSVGYCLHKPEVIFRLEQGEEPWRLEEEFPCQS

SEQ ID NO: 8108 - protein, 81 aa, Aotus trivirgatus
MSAVEQKFQGSISFKDVTVGFTQEEWQHLDLSQRALYRDVMLENYSNLVSVGYCLHKPEVIFRLEQGEEPWRLEEEFPCQS

SEQ ID NO: 8109 - protein, 81 aa, Aotus trivirgatus
HLDLSQRALYRDVMLENYSNLVSVGYCLHKPEVIFRLEQGEEPWRLEEEFPCQSFPEVWTAHHLKEQSQENQSKHLWEVVF

SEQ ID NO: 8110 - protein, 81 aa, Aotus trivirgatus
MNTFQASVSFKDVTVEFTQEEWQHMGPVERTLYRDVMLENYSHLISVGCCFTKPELIFTLEQGEDPWLLEKEKGFLSRTSP

SEQ ID NO: 8111 - protein, 81 aa, Aotus trivirgatus
PLRFSTLVEEQQKMNISQESVSFKDVTIEFTQEEWQQMAPVQRNLYRDVMLENYSHLVSVGYCLFKPEVIFKLEQGAEPWF

SEQ ID NO: 8112 - protein, 81 aa, Aotus trivirgatus
EFTQEEWQQMAPVQRNLYRDVMLENYSHLVSVGYCLFKPEVIFKLEQGAEPWFSEEEFSNKSHPSELLSSSKQNSAGVVRL

SEQ ID NO: 8113 - protein, 81 aa, Aotus trivirgatus
MLENYGNVASLGFPLLKPAVISQLEGGGELGGPSPLAAGTGLHGLWTDIQTDSDFTKEMYDGKEDVSFELQRDFSQETGFL

SEQ ID NO: 8114 - protein, 81 aa, Aotus trivirgatus
MLENYGNVASLGFPLLKPAVISQLEGGGELGGPSPLAAGTGLHGLWTARVSLCLPGWSAVACTWLTATSASWVQTILLSQP

SEQ ID NO: 8115 - protein, 81 aa, Aotus trivirgatus
MHLTAWPQKSVTFEDVAVYFTQAEWDGLSPAQRTLYRDVMLENYGNVASLGFPLLKPAVISQLEGGGELGGPSPLAAGTGL

SEQ ID NO: 8116 - protein, 81 aa, Aotus trivirgatus
MLENYGNVASLGFPLLKPAVISQLEGGVDIQTDSDFTKEMYDGKEDVSFELQRDFSQETGFLETSLLEKQQEVYSAGNIKK

SEQ ID NO: 8117 - protein, 81 aa, Aotus trivirgatus
ISQLEGGVDIQTDSDFTKEMYDGKEDVSFELQRDFSQETGFLETSLLEKQQEVYSAGNIKKEKSNTIDGTVTDETSPMEEC

SEQ ID NO: 8118 - protein, 81 aa, Aotus trivirgatus
MAAIPLKAQCQETVTFRDVAVYFTKTEWTGLSPAQRALYRSVMLENYGNLTAVGYPVPKPALISLLEGGDMAWGLEAQDDP

SEQ ID NO: 8119 - protein, 81 aa, Aotus trivirgatus
TVTFRDVAVYFTKTEWTGLSPAQRALYRSVMLENYGNLTAVGYPVPKPALISLLEGGDMAWGLEAQDDPLAEGTKNICKVI

SEQ ID NO: 8120 - protein, 80 aa, Aotus trivirgatus
VTFRDVAVYFTKTEWTGLSPAQRALYRSVMLENYGNLTAVGYPVPKPALISLLEGGDMAWGLEAQDDPLAEGTKNICKGR

SEQ ID NO: 8121 - protein, 81 aa, Aotus trivirgatus
ESVTFKDVSVDFTQEEWYHVDPAQRSLYRDVMLENYSHLVSLGYQVSKPEVIFKLEQGEEPWISEGEIQRPFCPGLVCLLL

SEQ ID NO: 8122 - protein, 81 aa, Aotus trivirgatus
DRRISTGTTKETRRPLEMAVSEPEASAAEWEQLDPAQRNLYKDVMLENYSNLASMGCQAPKPDLISKLEKGEAPCLGKGKR

SEQ ID NO: 8123 - protein, 81 aa, Aotus trivirgatus
RRISTGTTKETRRPLEMAVSEPEASAAKEWEQLDPAQRNLYKDVMLENYSNLASMGCQAPKPDLISKLEKGEAPCLGKGKR

SEQ ID NO: 8124 - protein, 81 aa, Aotus trivirgatus
ETRRPLEMAVSEPEASAAGSVTFKDVTMAFTQKEWEQLDPAQRNLYKDVMLENYSNLASMGCQAPKPDLISKLEKGEAPCL

SEQ ID NO: 8125 - protein, 81 aa, Aotus trivirgatus
EQFLTILPGEIRIWVKSQHPESSEEVVTLIEDLTQMLEEKEDLVSQDSVSQEENSKENKVVAICPNTESCESITLNDVAVN

SEQ ID NO: 8126 - protein, 81 aa, Aotus trivirgatus
ENSKENKVVAICPNTESCESITLNDVAVNFSRGEWKKLEPFQKELYKEVLLENFRNLEFLDFPVSKLELISQLKWVELPWL

SEQ ID NO: 8127 - protein, 81 aa, Aotus trivirgatus
MASPSPPPEPKELLTFEDVAVFFTQEEWDYLDPAQRSLYKDVMMENYGNLVSLDVLNRDKDEEPTVKQEIEEIEEEVEPQG

SEQ ID NO: 8128 - protein, 81 aa, Aotus trivirgatus
MASPSPPPEPKEEWDYLDPAQRSLYKDVMMENYGNLVSLGLTLLPRLECSDTIMPRCSFDLLGLSDQSCCYLSSWDYTCFE

SEQ ID NO: 8129 - protein, 81 aa, Aotus trivirgatus
MAFRDVAVDFTQDEWRLLSPAQRTLYREVMLENYSNLVSLGISFSKPEIITQLEQGKETWREEKKCPPATCPADPEPELYL

SEQ ID NO: 8130 - protein, 81 aa, Aotus trivirgatus
MAFRDVAVDFTQDEWRLLSPAQRTLYREVMLENYSNLVSLGISFSKPEIITQLEQGKETWREEKKCPPATCPDPEPELYLD

SEQ ID NO: 8131 - protein, 81 aa, Aotus trivirgatus
MAHMAFRDVAVDFTQDEWRLLSPAQRTLYREVMLENYSNLVSLGISFSKPEIITQLEQGKETWREEKKCPPATCPADPEPE

SEQ ID NO: 8132 - protein, 81 aa, Aotus trivirgatus
GLLTFRDVAIEFSLEEWQCLDTAQRNLYRNVILENYRNLVFLGIAVSKPDLITCLEQEKEPLIMKRDETADEPPESCSGSL

SEQ ID NO: 8133 - protein, 81 aa, Aotus trivirgatus
SNEELVGQNHGMEGEACTGGDVTFSDVAIDFSHEEWGWLDSAQRDLYKDVMVQNYENLVSLAGLSWESGWENKELSTKKDI

SEQ ID NO: 8134 - protein, 81 aa, Aotus trivirgatus
MPQVTFSDVAIDFSHEEWGWLDSAQRDLYKDVMVQNYENLVSLAGLSITKPYVITLLEDGKEPWMMEKKLSKGVTPDWESG

SEQ ID NO: 8135 - protein, 81 aa, Aotus trivirgatus
MPQVTFSDVAIDFSHEEWGWLDSAQRDLYKDVMVQNYENLVSLGLSWESGWENKELSTKKDIYDEDPLPTVIIEKVIKQSY

SEQ ID NO: 8136 - protein, 80 aa, Aotus trivirgatus
MPQVTFSDVAIDFSHEEWGWLDSAQRDLYKDVMVQNYENLVSLAGLSITKPYVITLLEDGKEPWMMEKKLSKGVTPGESW

SEQ ID NO: 8137 - protein, 81 aa, Aotus trivirgatus
MPQVTFSDVAIDFSHEEWGWLDSAQRDLYKDVMVQNYENLVSLGLSITKPYVITLLEDGKEPWMMEKKLSKGVTPVVKTMC

SEQ ID NO: 8138 - protein, 81 aa, Aotus trivirgatus
MPQVTFSDVAIDFSHEEWGWLDSAQRDLYKDVMVQNYENLVSLAGLSITKPYVITLLEDGKEPWMMEKKLSKGVTPGESCS

SEQ ID NO: 8139 - protein, 81 aa, Aotus trivirgatus
MPQVTFSDVAIDFSHEEWGWLDSAQRDLYKDVMVQNYENLVSLAGLSITKPYVITLLEDGKEPWMMEKKLSKGVTPVVKTM

SEQ ID NO: 8140 - protein, 81 aa, Aotus trivirgatus
MPQVTFSDVAIDFSHEEWGWLDSAQRDLYKDVMVQNYENLVSLAGLSITKPYVITLLEDGKEPWMMEKKLSKGVTPVKKNK

SEQ ID NO: 8141 - protein, 81 aa, Aotus trivirgatus
NEELVGQNHGMEGEACTGGDVTFSDVAIDFSHEEWGWLDSAQRDLYKDVMVQNYENLVSLGLSITKPYVITLLEDGKEPWM

SEQ ID NO: 8142 - protein, 81 aa, Aotus trivirgatus
VTFSDVAIDFSHEEWGWLDSAQRDLYKDVMVQNYENLVSLGLSITKPYVITLLEDGKEPWMMEKKLSKDWESGWENKELST

SEQ ID NO: 8143 - protein, 81 aa, Aotus trivirgatus
VTFSDVAIDFSHEEWGWLDSAQRDLYKDVMVQNYENLVSLGLSITKPYVITLLEDGKEPWMMEKKLSKVYPFLLSHSVSAS

SEQ ID NO: 8144 - protein, 81 aa, Aotus trivirgatus
VTFSDVAIDFSHEEWGWLDSAQRDLYKDVMVQNYENLVSLAGLSITKPYVITLLEDGKEPWMMEKKLSKDWESGWENKELS

SEQ ID NO: 8145 - protein, 81 aa, Aotus trivirgatus
MEAPALALISFEDVVVTFTGEEWGHLDLAQRTLYQEVMLETCRLLISLGHPVPKPELIYLLEHGQEPWTVKRGLSQSTCAG

SEQ ID NO: 8146 - protein, 81 aa, Aotus trivirgatus
MAAALRDPAQGCVTFEDVTIYFSKEEWGLLDEAQRLLYCDVMLENFALIASLGLISFRSHIVSQLEMGKEPWVPDSMDMTS

SEQ ID NO: 8147 - protein, 81 aa, Aotus trivirgatus
MAQGLVTFRDVAIEFSLEEWKCLEPAQRDLYREVTLENFGHLVSLGLSIPKPDVISLLEQGKEPWMIANDVTGPWCPDLES

SEQ ID NO: 8148 - protein, 81 aa, Aotus trivirgatus
ESREIRAGQIVLKAMAQGLVTFRDVAIEFSLEEWKCLEPAQRDLYREVTLENFGHLVSLGLSIPKPDVISLLEQGKEPWMI

SEQ ID NO: 8149 - protein, 81 aa, Aotus trivirgatus
MNMEGLVMFQDLSIDFSQEEWECLNPTQKDLYRDVMMENYSSLLSLGLSIPKPDVISLLEQGKEPWMVSRDVLGGWCPDRL

SEQ ID NO: 8150 - protein, 81 aa, Aotus trivirgatus
MNMEGLVMFQDLSIDFSQEEWECLNPTQKDLYRDVMMENYSSLLSLDLEFRCKTKYSCLPKEIYEVTSSQWVRMEKRHSLV

SEQ ID NO: 8151 - protein, 81 aa, Aotus trivirgatus
MNMEGLVMFQDLSIDFSQEEWECLNPTQKDLYRDVMMENYSSLLSLGLSIPKPDVISLLEQGKEPWMVSRDVLGGWCPDLE

SEQ ID NO: 8152 - protein, 81 aa, Aotus trivirgatus
MDVMLENYCHLISVGCHMTKPDVILKLERGEEPWTSFAGHTYLEENWKAEDFLVKFREQREKYSRSVVSINHKKLVKEKSK

SEQ ID NO: 8153 - protein, 81 aa, Aotus trivirgatus
MAQGSVSFNDVTVDFTQEEWQHLDHAQKTLYMDVMLENYCHLISVGCHMTKPDVILKLERGEEPWTSFAGHTYLEENWKAE

SEQ ID NO: 8154 - protein, 81 aa, Aotus trivirgatus
QWVNMEEFESRNLERSIFRDIWEGNCHIEQHQGQKEGYFRQFLINYENMTIFSQHTLLTPEFYDREKISECKKCRKNFSYH

SEQ ID NO: 8155 - protein, 81 aa, Aotus trivirgatus
FHMTKPDMIRKLEQGEELWTQRIFPSYSYLEEDGKTEDVLVKFKEYQDRHSRSLILINHKKLIKQRSNIYGKTLTLGKNHI

SEQ ID NO: 8156 - protein, 81 aa, Aotus trivirgatus
GFHMTKPDMIRKLEQGEELWTQRIFPSYSYLEDGKTEDVLVKFKEYQDRHSRSLILINHKKLIKQRSNIYGKTLTLGKNHI

SEQ ID NO: 8157 - protein, 81 aa, Aotus trivirgatus
MMENYSNLLSLDLESKYETKLLSVETDIIKNTCSQWEVMESSNLCENSIFRNDWQSKSTIEVQGPKVGYFSQMKTISQNVP

SEQ ID NO: 8158 - protein, 81 aa, Aotus trivirgatus
MPEVKFPDQFFTVLSMDHELVTFRDVLINFSQEEWEYLDSAQRNLYWDVMMENYSNLLSLDLESKYETKLLSVETDIIKNT

SEQ ID NO: 8159 - protein, 81 aa, Aotus trivirgatus
TVLSMDHELVTFRDVLINFSQEEWEYLDSAQRNLYWDVMMENYSNLLSLDLESKYETKLLSVETDIIKNTCSQWEVMESSN

SEQ ID NO: 8160 - protein, 81 aa, Aotus trivirgatus
MAQESVMFSDVSIDFSQEEWECLNDDQRDLYRDVMLENYSNLVSMAGHSISKPNVISYLEQGKEPWLVDRELTRGQWPALE

SEQ ID NO: 8161 - protein, 81 aa, Aotus trivirgatus
MAQESVMFSDVSIDFSQEEWECLNDDQRDLYRDVMLENYSNLVSMGHSISKPNVISYLEQGKEPWLVDRELTRGQWPALES

SEQ ID NO: 8162 - protein, 81 aa, Aotus trivirgatus
MAHRSVMFSDISIDFSPEEWEYLDLEQKDLYRDVMLENYSNLVSLGCFISKPDVISLLEQGKEPWKVVRKRRRQYPDLETK

SEQ ID NO: 8163 - protein, 81 aa, Aotus trivirgatus
MAHGSVTFRDVAIDFSQEEWEFLDPAQRDLYRDVMWENYSNFISLGPSISKPDVITLLDEEGKEPGMVVREGIRRYCPDLD

SEQ ID NO: 8164 - protein, 81 aa, Aotus trivirgatus
MAHGSVTFRDVAIDFSQEEWEFLDPAQRDLYRDVMWENYSNFISLAGPSISKPDVITLLDEEGKEPGMVVREGIRRYCPGE

SEQ ID NO: 8165 - protein, 81 aa, Aotus trivirgatus
CSQESALSEEEEDTTRSLETVTFKDVAVDLTQEEWEQMKPAQRNLYRDVMLENYSNLVTVGCQVTKPDVIFKLEQEEEPWV

SEQ ID NO: 8166 - protein, 81 aa, Aotus trivirgatus
EEWEQMKPAQRNLYRDVMLENYSNLVTVGCQVTKPDVIFKLEQEEEPWVMEEEMFGRHCPVDFLFCYSGQSASRLTVTSAC

SEQ ID NO: 8167 - protein, 81 aa, Aotus trivirgatus
MKPAQRNLYRDVMLENYSNLVTVGCQVTKPDVIFKLEQEEEPWVMEEEMFGRHCPEVWKVDEQIKKQQETLVRKVTSISKK

SEQ ID NO: 8168 - protein, 81 aa, Aotus trivirgatus
EDTTRSLETVTFKDVAVDLTQEEWEQMKPAQRNLYRDVMLENYSNLVTVGCQVTKPDVIFKLEQEEEPWVMEEEMFGRHCP

SEQ ID NO: 8169 - protein, 81 aa, Aotus trivirgatus
HPEEEERMHDELLQAVSKGSLMFRDVSIDFSQEEWECLDSGQMNLYKEVMLENFSNLVSVGLSSSKPAVISLLEQGREPWM

SEQ ID NO: 8170 - protein, 81 aa, Aotus trivirgatus
EEEERMHDELLQAVSKGSLMFRDVSIDFSQEEWECLDSGQMNLYKEVMLENFSNLVSVGLSSSKPAVISLLEQGREPWMVD

SEQ ID NO: 8171 - protein, 81 aa, Aotus trivirgatus
MAHLMLFRDVAVDFSQEEWEGLDLKQRDLYRDVMLENYSNMVSLGLCIYQPDVFSLLETGKEPWKILRDETRGPCPDMQSR

SEQ ID NO: 8172 - protein, 81 aa, Aotus trivirgatus
MNCFQELVTFRDVAIDFSRQEWEYLDPHQRDLYRDVMLENYRNLVSLGGHSISKPVLVDLLEQGKEPWMILREETQFPDLD

SEQ ID NO: 8173 - protein, 81 aa, Aotus trivirgatus
CRVGLIRSYNSKTMNCFQELVTFRDVAIDFSRQEWEYLDPHQRDLYRDVMLENYRNLVSLEMRSHCVAQVGLKLLVSSDPP

SEQ ID NO: 8174 - protein, 81 aa, Aotus trivirgatus
NCNWRRPLKCCPTKYVKFQELVTFRDVAIDFSRQEWEYLDPHQRDLYRDVMLENYRNLVSLGGHSISKPVLVDLLEQGKEP

SEQ ID NO: 8175 - protein, 81 aa, Aotus trivirgatus
ELCRVGLIRSYNSKTMNCELVTFRDVAIDFSRQEWEYLDPHQRDLYRDVMLENYRNLVSLGGHSISKPVLVDLLEQGKEPW

SEQ ID NO: 8176 - protein, 81 aa, Aotus trivirgatus
CNWRRPLKCCPTKYVKFQELVTFRDVAIDFSRQEWEYLDPHQRDLYRDVMLENYRNLVSLGGHSISKPVLVDLLEQGKEPW

SEQ ID NO: 8177 - protein, 81 aa, Aotus trivirgatus
MNCFQELVTFRDVAIDFSRQEWEYLDPHQRDLYRDVMLENYRNLVSLGGHSISKPVLVDLLEQGKEPWMILREETQFPEMG

SEQ ID NO: 8178 - protein, 81 aa, Aotus trivirgatus
MLENYRNLVSLDLDLQCEIISYIEVPTYDTDISSTQHQSIYQREKLYECKKCQKKFSSGYQLILHDRFHIIQRPYKCKECG

SEQ ID NO: 8179 - protein, 81 aa, Aotus trivirgatus
MAHDLVMFRDVAVDFSQEEWECLNSYQRNLYKDVILENYSNLVSLAGCSISKPDVITLLEQGKEPWLVVRDEKRRWSLDLE

SEQ ID NO: 8180 - protein, 81 aa, Aotus trivirgatus
MAHDLVMFRDVAVDFSQEEWECLNSYQRNLYKDVILENYSNLVSLGCSISKPDVITLLEQGKEPWLVVRDEKRRWSLDLES

SEQ ID NO: 8181 - protein, 81 aa, Aotus trivirgatus
MAHDLVMFRDVAVDFSQEEWECLNSYQRNLYKDVILENYSNLVSLGCSISKPDVITLLEQGKEPWLVVRDEKRRWSLAPTF

SEQ ID NO: 8182 - protein, 81 aa, Aotus trivirgatus
MAHALVTFTDVAIDFSQKEWECLDPTQRKLYRDVMLENYSNLVSLGYSGSKPDVITLLEQGKEPCMAVRDMTGRQYPGLLS

SEQ ID NO: 8183 - protein, 81 aa, Aotus trivirgatus
MAHALVTFTDVAIDFSQKEWECLDPTQRKLYRDVMLENYSNLVSLGLLSRHKTKKLSSEKDIHEISFSKGNIIEKSKTLHL

SEQ ID NO: 8184 - protein, 81 aa, Aotus trivirgatus
MAHALVTFTDVAIDFSQKEWECLDPTQRKLYRDVMLENYSNLVSLAGYSGSKPDVITLLEQGKEPCMAVRDMTGRQYPGLL

SEQ ID NO: 8185 - protein, 81 aa, Aotus trivirgatus
MPHLLVTFRDVAIDFSQEEWECLDPAQRDLYRDVMLENYSNLISLDLESSCEINKLSPEKEIYEVESFQWENMGKFINHHL

SEQ ID NO: 8186 - protein, 81 aa, Aotus trivirgatus
MDLLFQLLVTFRDVAIDFSQEEWECLDPAQRDLYRDVMLENYSNLISLDLESSCEINKLSPEKEIYEVESFQWENMGKFIN

SEQ ID NO: 8187 - protein, 81 aa, Aotus trivirgatus
MINYQTPVSFKDVVVGFTQEEWHRLNPTQRALYRDVMLETYSNLVSVGYEGTKPDVILRLEQEEAPWIGEAACLGCHCWED

SEQ ID NO: 8188 - protein, 81 aa, Aotus trivirgatus
MINYQTPVSFKDVVVGFTQEEWHRLNPTQRALYRDVMLETYSNLVSVGYEGTKPDVILRLEQEEAPWIGEAACLGCHCWGI

SEQ ID NO: 8189 - protein, 81 aa, Aotus trivirgatus
DVVVGFTQEEWHRLNPTQRALYRDVMLETYSNLVSVGYEGTKPDVILRLEQEEAPWIGEAACLGCHCWGISKLPADWPLAL

SEQ ID NO: 8190 - protein, 81 aa, Aotus trivirgatus
MINYQTPVSFKDVVVGFTQEEWHRLNPTQRALYRDVMLETYSNLVSVGYEGTKPDVILRLEQEEAPWIGEAACLGCHCWGK

SEQ ID NO: 8191 - protein, 81 aa, Aotus trivirgatus
EWHRLNPTQRALYRDVMLETYSNLVSVGYEGTKPDVILRLEQEEAPWIGEAACLGCHCWGKCDKSSKRGPEAGWHLWNFVQ

SEQ ID NO: 8192 - protein, 81 aa, Aotus trivirgatus
EWHRLNPTQRALYRDVMLETYSNLVSVGYEGTKPDVILRLEQEEAPWIGEAACLGCHCWEDIWQVNIQRKRRQDMPLRQGA

SEQ ID NO: 8193 - protein, 81 aa, Aotus trivirgatus
SFKDVVVGFTQEEWHRLNPTQRALYRDVMLETYSNLVSVGYEGTKPDVILRLEQEEAPWIGEAACLGCHCWALTFLRELQP

SEQ ID NO: 8194 - protein, 81 aa, Aotus trivirgatus
KDVVVGFTQEEWHRLNPTQRALYRDVMLETYSNLVSVGYEGTKPDVILRLEQEEAPWIGEAACLGCHCWALTFLRELQPHE

SEQ ID NO: 8195 - protein, 81 aa, Aotus trivirgatus
PLCETEELTSKQDFYEEHQSQQIIETLTRYNLEYSSLREEWKCEGYFERQTGNQKACFKEEIITHEEALVDEREQEYKSWG

SEQ ID NO: 8196 - protein, 81 aa, Aotus trivirgatus
KSQEEGRMAVGLLKAMYQELVTFRDVAVDFSQEEWDCLDSSQRHLYSNVMLENYRILVSLGLCFSKPSVILLLEQGKAPWM

SEQ ID NO: 8197 - protein, 81 aa, Aotus trivirgatus
QGKAPWMVKRELTKGLCSGWEPLCETEELTSKQDFYEEHQSQQIIETLTRYNLEYSSLREEWKCEGYFERQTGNQKACFKE

SEQ ID NO: 8198 - protein, 81 aa, Aotus trivirgatus
MAVGLCKAMSQGLVTFRDVALDFSQEEWEWLKPSQKDLYRDVMLENYRNLVWLGDGCSCYSTLRTTGMAEASSSSSSIQVS

SEQ ID NO: 8199 - protein, 81 aa, Aotus trivirgatus
MAVGLCKAMSQGLVTFRDVALDFSQEEWEWLKPSQKDLYRDVMLENYRNLVWLDWESWCEIKELSPKWFTDEDEISQEVVM

SEQ ID NO: 8200 - protein, 81 aa, Aotus trivirgatus
MTEGSVMFSDVSIDFSQEEWDCLDPVQRDLYRDVMLENYSNLVSMGLYTPKPQVISLLEQGKEPWMVGRELTRGLCSDLES

SEQ ID NO: 8201 - protein, 81 aa, Aotus trivirgatus
MTEGSVMFSDVSIDFSQEEWDCLDPVQRDLYRDVMLENYSNLVSMGKGIHTTDSQFSSGMSASSTVNFSAAFQDFTLLSLK

SEQ ID NO: 8202 - protein, 81 aa, Aotus trivirgatus
GSVSFRDVAINFSREEWRHLDLSQRNLYRDVMLETYSHLLSVGYQGKEPWTLQGERPRHSCPGEKLWDHNLRRKILSYKPA

SEQ ID NO: 8203 - protein, 81 aa, Aotus trivirgatus
SPQKSPALAPEDHGSSYEGSVSFRDVAINFSREEWRHLDLSQRNLYRDVMLETYSHLLSVGYQGKEPWTLQGERPRHSCPA

SEQ ID NO: 8204 - protein, 81 aa, Aotus trivirgatus
LAPEDHGSSYEGSVSFRDVAIDFSREEWRHLDLSQRNLYRDVMLETYSHLLSVGYQVPEAEVVMLEQGNEPWSLQGERPHQ

SEQ ID NO: 8205 - protein, 81 aa, Aotus trivirgatus
REEWRHLDLSQRNLYRDVMLETYSHLLSVGYQVPEAEVVMLEQGNEPWSLQGERPHQSCPVTHWLPFPSTMTKSFLGLTRS

SEQ ID NO: 8206 - protein, 81 aa, Aotus trivirgatus
SPSKSPALALEDHGSSYTGSVSFRDVAIDFSREEWRHLDLSQRNLYRDVMLETYSHLLSVGYQVPEAEVVMLEQGNEPWSL

SEQ ID NO: 8207 - protein, 81 aa, Aotus trivirgatus
DVAIDFSREEWRHLDLSQRNLYRDVMLETYSHLLSVGYQVPEAEVVMLEQGNEPWSLQGERPHQSCPAQCLVNSHQLQESF

SEQ ID NO: 8208 - protein, 81 aa, Aotus trivirgatus
MAWKVVMFRDVAIDFSQEEWECLDAAQRDLYRDVMLENYSNLVSLDLPSRCARKDLSPEKNTYETELPQWEMSDRLEKCDL

SEQ ID NO: 8209 - protein, 81 aa, Aotus trivirgatus
TELPQWEMSDRLEKCDLEESNSRNYLEAKGKMEKQQENQKEYFRQGMIIYDKMSIFNQHTYLSQHSKCHSTEKPYKCKECG

SEQ ID NO: 8210 - protein, 81 aa, Aotus trivirgatus
DLYKDVMFENYSNLVSLGYTIPKPDVITLLEQEKEPWIVMREGTRSWYTGSRCVTQAGEQWRDLSSLQRPPAGFKFFCLSL

SEQ ID NO: 8211 - protein, 81 aa, Aotus trivirgatus
MQVDPHGPLNELLIFQIIPLHSLSMMPWLLWILCFSMEEAQGELTSSCGAKTMAHVSLAFRDVSIDLSQEEWECLDPAQRD

SEQ ID NO: 8212 - protein, 81 aa, Aotus trivirgatus
MVHGSVTFRDVAIDFSQEEWECLQPAQRTLYRDVMLENYSHLISLGSSISKPDVITLLEQEKEPWMVIRKETNRWYPDECK

SEQ ID NO: 8213 - protein, 81 aa, Aotus trivirgatus
GRSPRKTDQFCNSKNMVPGSVTFRDVAIDFSQEEWECLQPAQRTLYRDVMLENYSHLISLGSSISKPDVITLLEQEKEPWM

SEQ ID NO: 8214 - protein, 81 aa, Aotus trivirgatus
MLENYSHLISLGSSISKPDVITLLEQEKEPWMVIRKETNRWYPDLESKYGPEKVSSENDISEVNLPKQVIKQISKTVGLEA

SEQ ID NO: 8215 - protein, 81 aa, Aotus trivirgatus
LLQRQLEPSRNFWILRLPPGSKREAPKVPVTFDDVAVFFSEQEWGKLEDWQKELYKHVMRGNYETLVSLDYAISKPEILSD

SEQ ID NO: 8216 - protein, 81 aa, Aotus trivirgatus
MFPGLLTTREEALMAFWDVAVAFTQKEWQLLSSAQRTLYREVMLENYSHLVSLGIVFSKPKLITQLEQGDEPWGEENKHLL

SEQ ID NO: 8217 - protein, 81 aa, Aotus trivirgatus
AASQSAGLAERLIRDQDLGTSLLPAAPQQWRHLDSTQKEQYWDLMLETYGKMVSGAGISHSKPDLTNSIEYGEELAGLYLH

SEQ ID NO: 8218 - protein, 81 aa, Aotus trivirgatus
AASQSAGLAERLIRDQDLGTSLLPAAPQQWRHLDSTQKEQYWDLMLETYGKMVSGGISHSKPDLTNSIEYGEELAGLYLHV

SEQ ID NO: 8219 - protein, 81 aa, Aotus trivirgatus
AASQSAGLAERLIRDQDLGTSLLPAAPQRHLDSTQKEQYWDLMLETYGKMVSGGISHSKPDLTNSIEYGEELAGLYLHVNE

SEQ ID NO: 8220 - protein, 81 aa, Aotus trivirgatus
AASQSAGLAERLIRDQDLGTSLLPAAPQQWRHLDSTQKEQYWDLMLETYGKMVSGGDRQENDKENLNLENHRDQELLHASV

SEQ ID NO: 8221 - protein, 81 aa, Aotus trivirgatus
MVAGWRVMGEDSVTFEDVAVDFTPEEWTLLDQTQRHLYRDVMLDELQESSCSRLRDHISTKWTSTAAEFFQEENISMVKMR

SEQ ID NO: 8222 - protein, 81 aa, Aotus trivirgatus
LDQTQRHLYRDVMLDELQESSCSRLRDHISTKWTSTAAEFFQEENISMVKMRCSLAVLPSLLSNSCYQVILLPEPPECVYI

SEQ ID NO: 8223 - protein, 81 aa, Aotus trivirgatus
MAAGWLTARSQNSVTFQEVAVDFSQEEWALLDLAQKNLYKDVMLENFRNLTSVGYQLCRHNLISKVDQEELKTDERGILQS

SEQ ID NO: 8224 - protein, 81 aa, Aotus trivirgatus
MVAGWRVMGEDSVTFEDVAVDFTPEEWTLLDQTQRHLYRDVMLDELQESSCSRLRDHISTKWTSTAAEFFQEENISMVKMV

SEQ ID NO: 8225 - protein, 81 aa, Aotus trivirgatus
VDFTPEEWTLLDQTQRHLYRDVMLDELQESSCSRLRDHISTKWTSTAAEFFQEENISMVKMVRFRRYNFLACKLEEDLEIP

SEQ ID NO: 8226 - protein, 81 aa, Aotus trivirgatus
EKTEVERMVADCLTNCYQDSVTFDDLAVDFTPEEWTLLDPTQRNLYRDVMLENYKNLSTVGCQLFKPSLISWLEQEESRTV

SEQ ID NO: 8227 - protein, 81 aa, Aotus trivirgatus
MTYCLTNCYQESVTFEDVSVDFTQEEWTLLDPLQRNFYRDVMLENYENLAKVGFQLLKPSLISWLEEEEELRTLQQEVLQE

SEQ ID NO: 8228 - protein, 81 aa, Aotus trivirgatus
SAVQQDFCKIQTSNGIQTDLVTFDSVAVEFTQEEWTLLDPTERNLYRDMMLENYKNLSSVGYQLFKPSLISWMEEEEELST

SEQ ID NO: 8229 - protein, 81 aa, Aotus trivirgatus
EKTAAGRIVADCLTNCYQDSVTFDDVAVDFTQEEWTLLDPTQRSLYSDVMLENYKNLATVGWELQLETQWSTLQQNCLRGQ

SEQ ID NO: 8230 - protein, 81 aa, Aotus trivirgatus
MDSVTFDDVAVDFTQEEWTLLDPTQRSLYSDVMLENYKNLATVGWELQLETQWSTLQQNCLRGQTSIGVQLEGNHNGGKLC

SEQ ID NO: 8231 - protein, 81 aa, Aotus trivirgatus
YLSGDPVCLHEEKTAAGRIVADCLTNCYQDSVTFDDVAVDFTQEEWTLLDPTQRSLYSDVMLENYKNLATVGRKPQWRETL

SEQ ID NO: 8232 - protein, 81 aa, Aotus trivirgatus
EKTKVERTVVDYLANGYQDSVTFDDVAVEFTPEEWALLDTTQKYLYRDVMLENYKNLASVEWEIQPRTQGLSLQQSLLKNE

SEQ ID NO: 8233 - protein, 81 aa, Aotus trivirgatus
EKTKVERTVVDYLANGYQDSVTFDDVAVEFTPEEWALLDTTQKYLYRDVMLENYKNLASVDYFFCLTSEWEIQPRTQGLSL

SEQ ID NO: 8234 - protein, 81 aa, Aotus trivirgatus
GFFSREAICPFEEKTKVERTVVDYLANGYQDSVTFDDVAVEFTPEEWALLDTTQKYLYRDVMLENYKNLASVADKLWMETL

SEQ ID NO: 8235 - protein, 81 aa, Aotus trivirgatus
VDSVTFDDVAVEFTPEEWALLDTTQKYLYRDVMLENYKNLASVDYFFCLTSEWEIQPRTQGLSLQQSLLKNELFNGIQMQT

SEQ ID NO: 8236 - protein, 81 aa, Aotus trivirgatus
GYQDSVTFDDVAVEFTPEEWALLDTTQKYLYRDVMLENYKNLASVDYFFCLTSEWEIQPRTQGLSLQQSLLKNELFNGIQM

SEQ ID NO: 8237 - protein, 81 aa, Aotus trivirgatus
MDSVAFEDVAVNFTLEEWALLDPSQKNLYRDVMRETFRNLASIGKQWEDQNIEDPFKLPGRNTSHTSERICEHKEGSQGEE

SEQ ID NO: 8238 - protein, 81 aa, Aotus trivirgatus
MDSVAFEDVAVNFTQEEWALLGPSQKSLYRNVMQETIRNLDCIGHTCEIIDNSQCGETFSQIPESIVNKNTPGVNPCDSSE

SEQ ID NO: 8239 - protein, 81 aa, Aotus trivirgatus
MDSVAFEDVAINFTCEEWALLGPSQKSLYRDVMQETIRNLDCIGMKWQNLDVEEDKYKNPGRNLRCYMVERSCEIKDNSQC

SEQ ID NO: 8240 - protein, 81 aa, Aotus trivirgatus
MDPVAFEDVAVKFTQEEWALLDISQKNLYREVMLETFRNLTSIGKKWKDKSIEDECQNPRRNLRSLIEEKVNEIKEDSHCE

SEQ ID NO: 8241 - protein, 81 aa, Aotus trivirgatus
MMFQDPVAFEDVAVKFTQEEWALLDISQKNLYREVMLETFRNLTSIGKKWKDKSIEDECQNPRRNLRSLIEEKVNEIKEDS

SEQ ID NO: 8242 - protein, 81 aa, Aotus trivirgatus
MFQDPVAFEDVAVKFTQEEWALLDISQKNLYREVMLETFRNLTSIGKKWKDKSIEDECQNPRRNLRSLIEEKVNEIKEDSH

SEQ ID NO: 8243 - protein, 81 aa, Aotus trivirgatus
MDSVAFEDVAVSFTQEEWALLDPSQKNLYRDVMQEIFKNLASVGKTWQVQNIEDKYKNSRRNLRWESSFVAQAGVQWCDLG

SEQ ID NO: 8244 - protein, 81 aa, Aotus trivirgatus
MDSVAFEDVAVSFTQEEWALLDPSQKNLYRDVMQEIFKNLASVGKTWQVQNIEDKYKNSRRNLSLLIREKLFESKESNHCG

SEQ ID NO: 8245 - protein, 81 aa, Aotus trivirgatus
CSHRSCREDSGTSENWEMDPVAFEDVAVKFTQEEWALLDISQKNLYREVMLETFRNLTSIGKKWKDKSIEDECQNPRRNLR

SEQ ID NO: 8246 - protein, 81 aa, Aotus trivirgatus
MSCCSHRSCREDSGTSENWEMEEWALLDISQKNLYREVMLETFRNLTSIGKKWKDKSIEDECQNPRRNLRSLIEEKVNEIK

SEQ ID NO: 8247 - protein, 81 aa, Aotus trivirgatus
LVLSLSPILLHTCGMFQDPVAFEDVAVKFTQEEWALLDISQKNLYREVMLETFRNLTSIGKKWKDKSIEDECQNPRRNLRS

SEQ ID NO: 8248 - protein, 81 aa, Aotus trivirgatus
MMFQVSVAFEDVAVTFTQEEWALLDPSQKTLYRDVMQENFRNLASVGKKWKAQNIYVEYKNLRRNLRNLRGKRLFESKEDH

SEQ ID NO: 8249 - protein, 81 aa, Aotus trivirgatus
MVSVAFEDVAVTFTQEEWALLDPSQKTLYRDVMQENFRNLASVGKKWKAQNIYVEYKNLRRNLRNLRGKRLFESKEDHQDG

SEQ ID NO: 8250 - protein, 81 aa, Aotus trivirgatus
MQENFRNLASVGKKWKAQNIYVEYKNLRRNLRNLRGKRLFESKEDHQDGEILTQVPDDMLKKTTTGVKSCESSVCGEVGSG

SEQ ID NO: 8251 - protein, 81 aa, Aotus trivirgatus
CGMFQVSVAFEDVAVTFTQEEWALLDPSQKTLYRDVMQENFRNLASVGKKWKAQNIYVEYKNLRRNLRNLRGKRLFESKED

SEQ ID NO: 8252 - protein, 81 aa, Aotus trivirgatus
MQIIYLVLTCVSISSSLSLYHSVMAELAANTARHPVSSLQAVSVAFEDVAVTFTQEEWALLDPSQKTLYRDVMQENFRNLA

SEQ ID NO: 8253 - protein, 81 aa, Aotus trivirgatus
IIYLVLTCVSISSSLSLYHSVMAELAANTARHPVSSLQAVSVAFEDVAVTFTQEEWALLDPSQKTLYRDVMQENFRNLASV

SEQ ID NO: 8254 - protein, 81 aa, Aotus trivirgatus
LGSLQLLPPSHVKIILLKKDSVAFEDVAVNFTQEEWALLDPSQKNLYREVMQETLRNLASIGQRWSNQNAEDKHQNPRRNL

SEQ ID NO: 8255 - protein, 81 aa, Aotus trivirgatus
MDSVAFEDVDVNFTQDEWALLDPSQKNLYRDVMQETFRNLASVGKKWKDQKIEDEYKNPRSNLRPSQKVELVAVPKTTNIG

SEQ ID NO: 8256 - protein, 81 aa, Aotus trivirgatus
QKNLYRDVMQETFRNLASVGKKWKDQKIEDEYKNPRSNLRPSQKVELVAVPKTTNIGAGLSISGPEEVVVNLPISCSERPG

SEQ ID NO: 8257 - protein, 81 aa, Aotus trivirgatus
DSVAFEDVDVNFTQDEWALLDPSQKNLYRDVMQETFRNLASVGKKWKDQKIEDEYKNPRSNLSLRRWSWLYPRQPTLGLDS

SEQ ID NO: 8258 - protein, 81 aa, Aotus trivirgatus
MDSVAFEDVDVNFTQDEWALLDPSQKNLYRDVMQETFRNLASVGKKWKDQKIEDEYKNPRSNLRGLMGERLLESKKDHQLE

SEQ ID NO: 8259 - protein, 81 aa, Aotus trivirgatus
MDLVAFEDIDVNFTQEEWALLDPSQKNLYRDVMWETMRNLASIGKKWKDQNIKDHYKHQGINLRRHMVERLYQSKDGSQHG

SEQ ID NO: 8260 - protein, 81 aa, Aotus trivirgatus
TLRRGQPKVLEWGFPKDQDSVAFEDVAVNFTHEEWALLGPSQKNLYRDVMQETIRNLNCIGMKWENQNADDQYQNLRRNLR

SEQ ID NO: 8261 - protein, 81 aa, Aotus trivirgatus
MDSVAFEDVAVNFTHEEWALLGPSQKNLYRDVMQETIRNLNCIGMKWENQNADDQYQNLRRNLRCDVVERFGKSKDGSQCG

SEQ ID NO: 8262 - protein, 81 aa, Aotus trivirgatus
GPSQKNLYRDVMQETIRNLNCIGMKWENQNADDQYQNLRRNLRCDVVERFGKSKDGSQCGETLSQIRSSIVNKNSPARVDA

SEQ ID NO: 8263 - protein, 81 aa, Aotus trivirgatus
RNDFFLPDSQTSEERKQYDSVAFEDVAVNFTQEEWALLGPSQKSLYRDVMWETIRNLDYIGHIVERFRKSSQISDSIVDEK

SEQ ID NO: 8264 - protein, 81 aa, Aotus trivirgatus
MDSVVFEDVAVNFTQEEWALLGPSQKKLYRDVMQETFVNLASIGENWEDKNIEDHRNQGRKLRSHMVERLCERKEGNQLGE

SEQ ID NO: 8265 - protein, 81 aa, Aotus trivirgatus
SDQRSRNKETRTPGSGEMDSVVFEDVAVNFTQEEWALLGPSQKKLYRDVMQETFVNLASIGENWEDKNIEDHRNQGRKLRS

SEQ ID NO: 8266 - protein, 81 aa, Aotus trivirgatus
VLQMQNSVHHGQNVKTQTDSISLEDVAVNFTLEEWALLDPGQRNIYRDVMRATFKNLACIGEKWKDQDIEDDHKNQGRNLR

SEQ ID NO: 8267 - protein, 81 aa, Aotus trivirgatus
MDSISLEDVAVNFTLEEWALLDPGQRNIYRDVMRATFKNLACIGEKWKDQDIEDDHKNQGRNLRGPMVETLCENKEDRQCR

SEQ ID NO: 8268 - protein, 81 aa, Aotus trivirgatus
MDSVAFEDVSVKFSQEEWALLAPSQKKLYRDVMQETFKNLASIGKKWEDQNIEDQHKNQGKNLRSHMVERLCESKEGSQCG

SEQ ID NO: 8269 - protein, 81 aa, Aotus trivirgatus
MESVTFEDVAVEFIQEWALLDSAQRNLCRYGMLDKCRSLASRGTPLFSLSPLFISAWESQLKPKELPSMRDILEEASSRDM

SEQ ID NO: 8270 - protein, 81 aa, Aotus trivirgatus
RDILEEASSRDMQMGPGLFLRMQLVPSMEDGETPSTQEDWPALQEPPWSLGCMRPKAAVQIQRTAMPVPTLGHPDLWVAGN

SEQ ID NO: 8271 - protein, 81 aa, Aotus trivirgatus
DRVEEEAMASGLPIACSQEPVTFADVAVVFTPEEWVFLDSTQRSLYRDVMLENYRNLASVDDQLCKPNALSYLEQRGEQWT

SEQ ID NO: 8272 - protein, 81 aa, Aotus trivirgatus
MESVTFEDVAVEFIQEWALLDSAQRNLCRYGMLDKCRSLASRGTPLFWESQLKPKELPSMRDILEEASSRDMQMGPGLFLR

SEQ ID NO: 8273 - protein, 81 aa, Aotus trivirgatus
ILEEASSRDMQMGPGLFLRMQLVPSMEDGETPSTQEDWPALQEPPWSLGCMRPKAAVQIQRTAMPVPTLGHPDLWVAGNSA

SEQ ID NO: 8274 - protein, 81 aa, Aotus trivirgatus
MESVTFEDVAVEFIQEWALLDSAQRNLCRYGMLDKCRSLASRGAGAVPEDATGAVHGRRGDTINSRGLASSPGATLVSGMH

SEQ ID NO: 8275 - protein, 81 aa, Aotus trivirgatus
ILEEASSRDMQMGPGLFLRMQLVPSMEDGETPSTQEDWPALQEPPWSLGCMRPKAAVQIQRTAMPVPTLGHPDLWVAGNSG

SEQ ID NO: 8276 - protein, 81 aa, Aotus trivirgatus
MAAGLLTAGPRGSTSFSSVTVAFAQEEWRCLVSTPRDRFKEGLPEKSRNLVLLGLPVSQPGMNSQLELREGAWMLEGEDLR

SEQ ID NO: 8277 - protein, 81 aa, Aotus trivirgatus
ENTGEEGMAAGLLTAGPRGSTSFSSVTVAFAQEEWRCLVSTPRDRFKEGLPEKSRNLVLLGLPVSQPGMNSQLELREGAWM

SEQ ID NO: 8278 - protein, 81 aa, Aotus trivirgatus
APEASALSQEENPRNQLMALMLLTAQPQELVMFEEVSVCFTSEEWACLGPIQRALYWDVMLENYGNVTSLGYRKYRRERNK

SEQ ID NO: 8279 - protein, 81 aa, Aotus trivirgatus
TLPQVGNSGDQAGATVLRMVRPQDTVVFEDLSVDYTQKKQKCPAVSQRAMHWNVMPENDHSMASLDGETGTEEVLIPKHHS

SEQ ID NO: 8280 - protein, 81 aa, Aotus trivirgatus
HHFASGDFAQCASPVPTLPQVGNSGDQAGATVLRMVRPQDTVVFEDLSVDYTQKKQKCPAVSQRAMHWNVMPENDHSMASL

SEQ ID NO: 8281 - protein, 81 aa, Aotus trivirgatus
GNSGDQAGATVLRMVRPQDTVVFEDLSVDYTQKKQKCPAVSQRAMHWNVMPENDHSMASLGENKLESSELTPKKEIFKSSN

SEQ ID NO: 8282 - protein, 81 aa, Aotus trivirgatus
VGNSGDQAGATVLRMVRPQDTVVFEDLSVDYTQKKQKCPAVSQRAMHWNVMPENDHSMASLAGENKLESSELTPKKEIFKS

SEQ ID NO: 8283 - protein, 81 aa, Aotus trivirgatus
AQILELLVLEQFLSILPGELRVWVQLHNPESGEEAVALLEELQRDLDGTSYRDPGPAQSPDVHWMGTGALRSAQIWSLASP

SEQ ID NO: 8284 - protein, 81 aa, Aotus trivirgatus
TMTTVSSTARPQESVAFDDVAVYFTKKEWAIMVPDQRALYRDVMLENYEAVAFVVPPTSKPALVSHLEQGKEPCFTQPQGV

SEQ ID NO: 8285 - protein, 81 aa, Aotus trivirgatus
LGSALELLPGQPTLSRACPSVTFEDVAVYFSENEWIGLGPAQTALYRDVMLENYGSVASLTFPFPKPALISQLEGKAPWCS

SEQ ID NO: 8286 - protein, 81 aa, Aotus trivirgatus
MTKSLESVSFKDVTVDFSRDEWQQLNVAQKSLYRDVMLENYFNLISVGCQVPKPEVIFNLEQEEPCMLNGGISSQSCPDGK

SEQ ID NO: 8287 - protein, 81 aa, Aotus trivirgatus
MSVVSHPESVSFKDVTVDFSRDEWQQLNVAQKSLYRDVMLENYFNLISVGCQVPKPEVIFNLEQEEPCMLNGGISSQSCPD

SEQ ID NO: 8288 - protein, 81 aa, Aotus trivirgatus
MAKRPRPPRSPEMGLLTFRDVAIEFSLEEWQCLNHAQQNLYRDVMFENYRNLVSLGIAVSKPELITCLEENNEPWNIKRNE

SEQ ID NO: 8289 - protein, 81 aa, Aotus trivirgatus
GLLTFRDVAIEFSLEEWQCLNHAQQNLYRDVMFENYRNLVSLGIAVSKPELITCLEENNEPWNIKRNEMVAKHPVTYSYLT

SEQ ID NO: 8290 - protein, 81 aa, Aotus trivirgatus
MNMSQASVSFQDVAVEFTQEEWQHLGPVEWTLYRDVMLENYRHLVSVGYCITKPKVISQLEQGEEPWSLEDEFLNQKYPGH

SEQ ID NO: 8291 - protein, 81 aa, Aotus trivirgatus
MLENYRHLVSVGYCITKPKVISQLEQGEEPWSLEDEFLNQKYPGHFEVDDYIKGIWEKQEKPLWKEIFIDDADKILSKEGQ

SEQ ID NO: 8292 - protein, 81 aa, Aotus trivirgatus
GDPSSEGTPGSGSVSISVRKPASEMQLQVQSQQEELERLKKDLSSQKELVRLLQQTVRSSQYDKYFTSSRLCEGVPKDTLE

SEQ ID NO: 8293 - protein, 81 aa, Aotus trivirgatus
CFYQEERMAAGHPPRWSQELVTFEDVSMDFSQEEWELLDPAQKNLYREVMLENYRNLVSLEALKNPRAHAGIEEGPFSTAH

SEQ ID NO: 8294 - protein, 81 aa, Aotus trivirgatus
HLLLQPVASAHVEQSEALWMEEKGTPQASCSDWTTVLKNQDSTYKKVVLQEEPAGGINIIRLIREDGGWKQSEESHEDPQG

SEQ ID NO: 8295 - protein, 81 aa, Aotus trivirgatus
MDSVVFEDVAVDFTLEEWALLDSAQRDLYRDVMLETFRNLASVDDETQFKASGSVSQQDIYGEEISKESKIAEFTRNVSWA

SEQ ID NO: 8296 - protein, 81 aa, Aotus trivirgatus
MDSVVFEDVAVDFTREEWALLDSAQRDLYRDVMLETFQNLASVACETWERTDRSVSQQDMYGAKISQEQTIPNFTRNNSCA

SEQ ID NO: 8297 - protein, 81 aa, Aotus trivirgatus
MDSVVFEDVAVDFTREEWALLDSAQRDLYRDVMLETFQNLASVDDETPCKADRSVSQQDMYGAKISQEQTIPNFTRNNSCA

SEQ ID NO: 8298 - protein, 81 aa, Aotus trivirgatus
MDSVVFEEVAVRFTPEEWALLSHAQRRLYRDVMLEICRNLASLDSCIYVRTSGSSSQREVFGNEISNEEEIAKFTRSDYWS

SEQ ID NO: 8299 - protein, 81 aa, Aotus trivirgatus
FQEKNTEEGEVAALRLTARSQETVTFKDVAMDFTPEEWGKLDPAQRDVMLENYRNLVSLWLPVSKPENYTLENGKEPLKLE

SEQ ID NO: 8300 - protein, 81 aa, Aotus trivirgatus
QEKNTEEGEVAALRLTARSQETVTFKDVAMDFTPEEWGKLDPAQRDVMLENYRNLVSLWLPVSKPENYTLENGKEPLKLER

SEQ ID NO: 8301 - protein, 81 aa, Aotus trivirgatus
EGEVAALRLTARSQETVTFKDVAMDFTPEEWGKLDPAQRDVMLENYRNLVSLWLPVSKPENYTLENGKEPLKLERKAPKNS

SEQ ID NO: 8302 - protein, 81 aa, Aotus trivirgatus
TQPDEDLHLQAEETELVKESVTFKDVAIDFTLEEWRLMDPTQRNLHKDVMLENYRNLVFVGLAVSKPDMISHLENGKGPWV

SEQ ID NO: 8303 - protein, 81 aa, Aotus trivirgatus
PEVTQPDEDLHLQAEETELVKESVTFKDVAIDFTLEEWRLMDPTQRNLHKDVMLENYRNLVFVGLAVSKPDMISHLENGKG

SEQ ID NO: 8304 - protein, 81 aa, Aotus trivirgatus
WPERGPPAPQHQEMASASPLLSAWSQAPVNLEDVAVYLSGEEPGCLGPTQQDAPLENEGPVIQLVDGGDGGEDAPVRMEWY

SEQ ID NO: 8305 - protein, 81 aa, Aotus trivirgatus
DDNSSAKKPGDDEQILEDKCEDFDDIAQYFSKNEWEKLKYSEKSTYAYIKENYESLRRLGFHIPLPLFMHSKWTENFWEDD

SEQ ID NO: 8306 - protein, 81 aa, Aotus trivirgatus
MLQTTWPQESVAFEDVAVYFTQNQWASLDPAQRALYREVMLENYANVASLVAFPFPKPALISHLEKGEAPWGPDPWDAEIP

SEQ ID NO: 8307 - protein, 81 aa, Aotus trivirgatus
EGRTRDRQMAAALLTAWSQMPVTFEDVALYLSREEWGRLDHTQQNFYRDVLQKRNGLSLGFPFSRPFWAPQVQGKGEASGS

SEQ ID NO: 8308 - protein, 81 aa, Aotus trivirgatus
EGRTRDRQMAAALLTAWSQMPVTFEDVALYLSREEWGRLDHTQQNFYRDVLQKRNGLSLGPIQEGQGVPIPPVAALGDVKP

SEQ ID NO: 8309 - protein, 81 aa, Aotus trivirgatus
LKEGQTREPMATCFVSGVHGPVASGDIPFYFSQEEWGTLDPAQRDLFWDIKRGNSRNTTLGLGLKGQSERSRLEEVVPALP

SEQ ID NO: 8310 - protein, 81 aa, Aotus trivirgatus
HPLVNLLPKGIQQKQETVSLCLKANPELVVFEDLNVFHCQEECVSLDPTQQLTSEKEDDSSVGEMMLLAVNGSNPEGEDSE

SEQ ID NO: 8311 - protein, 81 aa, Aotus trivirgatus
PLVNLLPKGIQQKQETVSLCLKANPEELVVFEDLNVFHCQEECVSLDPTQQLTSEKEDDSSVGEMMLLAVNGSNPEGEDSE

SEQ ID NO: 8312 - protein, 81 aa, Aotus trivirgatus
PLVNLLPKGIQQKQETVSLCLKANPEELVVFEDLNVFHCQEECVSLDPTQQLTSEKEDDSSVGEMMLLVNGSNPEGEDSEK

SEQ ID NO: 8313 - protein, 81 aa, Aotus trivirgatus
SLFPPEGNMEDKMTGPQLPESLEDVAMYISQEEWGHQDPSKRALSRDTVQESYENVDSLESHIPSQEIPSTQVGQGGKLWD

SEQ ID NO: 8314 - protein, 81 aa, Aotus trivirgatus
QTNSKDWTVAPEHVLPESQSLLTFEEVAMYFSQEEWELLDPTQKALYNDVMQENYETVISLALFVLPKPKVISCLEQGEEP

SEQ ID NO: 8315 - protein, 81 aa, Aotus trivirgatus
MYFSQEEWELLDPTQKALYNDVMQENYETVISLALFVLPKPKVISCLEQGEEPWVQVSQEFKDSARGSSTGLKLKNDTENH

SEQ ID NO: 8316 - protein, 81 aa, Aotus trivirgatus
TCDNRAVSLCQQEWMRPGPARRALYRDATQRKDRHVSLATGVPWGYEETRTLLAILSSSQFYGKLQTCQQNSQIYRAMAER

SEQ ID NO: 8317 - protein, 81 aa, Aotus trivirgatus
NTGLHDQETGAVVWTAEFQGPATCDNRAVSLCQQEWMRPGPARRALYRDATQRKDRHVSLATGVPWGYEETRTLLAILSSS

SEQ ID NO: 8318 - protein, 81 aa, Aotus trivirgatus
MASVFPTPEAQGPMLFEDLAVYFSQEECVTLHPAQRSLSRDATQECLEDAALMGEEGKPEINQQLSLESMELDELALEKYP

SEQ ID NO: 8319 - protein, 81 aa, Aotus trivirgatus
MALSQGPLTFMDVAIEFSQEEWRCLDPAQRTLYRDVMLENYRNLVSLGVGLPDLSFISMLEQKREPWTLQSEEKMARNPDG

SEQ ID NO: 8320 - protein, 81 aa, Aotus trivirgatus
GHLTFMDVAIEFSQEEWRCLDPAQQALYRDVMLENYRNLVSLGICLPDLSIISMLEQRREPSTLQGEVKIVKIQDGRECIR

SEQ ID NO: 8321 - protein, 80 aa, Aotus trivirgatus
MDVAIEFSQEEWRCLDPAQQALYRDVMLENYRNLVSLGICLPDLSIISMLEQRREPSTLQGEVKIVKIQDGRECIRSVNT

SEQ ID NO: 8322 - protein, 81 aa, Aotus trivirgatus
LYRDVMLENYRNLVSLGICLPDLSIISMLEQRREPSTLQGEVKIVKIQDGRECIRSVNTDSPLLQRISVPFVFCTASITVC

SEQ ID NO: 8323 - protein, 81 aa, Aotus trivirgatus
GHLTFRDVAIEFSQEEWECLEPAQRALYRDVMLENYRNLVSLGICLPDLSIISTLEQSRGPWNLQSEVKIANTSDVRECIK

SEQ ID NO: 8324 - protein, 81 aa, Aotus trivirgatus
GHLTFMDVAIEFSQEEWRCLDPAQQALYRDVMLENYRNLVSLGICLPDLSIISMLEQRREPSTLQGEVKIVKIQACCTITR

SEQ ID NO: 8325 - protein, 81 aa, Aotus trivirgatus
DEEAQKRKEKESGMALPQGHLTFMDVAIEFSQEEWRCLDPAQQALYRDVMLENYRNLVSLGICLPDLSIISMLEQRREPST

SEQ ID NO: 8326 - protein, 81 aa, Aotus trivirgatus
DEEAQKRKEKESGMALPQGHLTFMDVAIEFSQEEWRCLDPAQQALYRDVMLENYRNLVSLGRSCILRSNAGNKPIKNHLGL

SEQ ID NO: 8327 - protein, 81 aa, Aotus trivirgatus
EPRKRKRKAKESGMALPQGHLTFTDVAIEFSQEEWKCLDPAQRALYKDVMLENYRNLVSLGISLPDLNINSMLEQRRELWS

SEQ ID NO: 8328 - protein, 81 aa, Aotus trivirgatus
EPRKRKRKAKESGMALPQGHLTFTDVAIEFSQEEWKCLDPAQRALYKDVMLENYRNLVSLGSGCALGGNAENKPIETQLGV

SEQ ID NO: 8329 - protein, 81 aa, Aotus trivirgatus
EWKCLDPAQRALYKDVMLENYRNLVSLGISLPDLNINSMLEQRRELWSGESEVRIAKSADRRERIKVVNTGWSAMAPSKLT

SEQ ID NO: 8330 - protein, 81 aa, Aotus trivirgatus
LWSGESEVRIAKSADRRERIKVVNTGWSAMAPSKLTAASPSQIQAILLPQPPELVGLQGAAVHWEAMQKTSQLKHSLEYPF

SEQ ID NO: 8331 - protein, 81 aa, Aotus trivirgatus
MALTQGPLTFRDVTIEFSQEEWKCLDPAQKALYKDVMLENYRNLVFLGEDKFSLEVQICPCAFLYFLCCISWEPLHYLTET

SEQ ID NO: 8332 - protein, 81 aa, Aotus trivirgatus
MALTQGPLTFRDVTIEFSQEEWKCLDPAQKALYKDVMLENYRNLVFLGIIPKCTTKELPPIGNSNTGEKIQTMTLERHECY

SEQ ID NO: 8333 - protein, 81 aa, Aotus trivirgatus
LDPAQKALYKDVMLENYRNLVFLGIIPKCTTKELPPIGNSNTGEKIQTMTLERHECYDIEDIYLREIQKNLLDLEFQWKHG

SEQ ID NO: 8334 - protein, 81 aa, Aotus trivirgatus
LCKVQGPLTFRDVTIEFSQEEWKCLDPAQKALYKDVMLENYRNLVFLGIIPKCTTKELPPIGNSNTGEKIQTMTLERHECY

SEQ ID NO: 8335 - protein, 81 aa, Aotus trivirgatus
MESLTLEDVAVDFTWEEWQLLSPTQKDLYRDVMLENYSNLVAVGYQASKPNALLKLEREEPCCTTEDESYTQICSDSGSAY

SEQ ID NO: 8336 - protein, 81 aa, Aotus trivirgatus
ESLTLEDVAVDFTWEEWQLLSPTQKDLYRDVMLENYSNLVAVGYQASKPNALLKLEREEPCCTTEDESYTQICSEIRKIDD

SEQ ID NO: 8337 - protein, 81 aa, Aotus trivirgatus
ESLTLEDVAVDFTWEEWQLLSPTQKDLYRDVMLENYSNLVAVGYQASKPNALLKLEREEPCCTTEDESYTQICSDSGSAYA

SEQ ID NO: 8338 - protein, 81 aa, Aotus trivirgatus
MESLTLEDVAVDFTWEEWQLLSPTQKDLYRDVMLENYSNLVAVGYQASKPNALLKLEREEPCCTTEDESYTQICSEIRKID

SEQ ID NO: 8339 - protein, 81 aa, Aotus trivirgatus
MRPELTNFWEESLTLEDVAVDFTWEEWQLLSPTQKDLYRDVMLENYSNLVAVGYQASKPNALLKLEREEPCCTTEDESYTQ

SEQ ID NO: 8340 - protein, 81 aa, Aotus trivirgatus
ESLTLEDVAVDFTWEEWQLLSPTQKDLYRDVMLENYSNLVAVGYQASKPNALLKLEREEPCCTTEDESYTQICSGRGPPDG

SEQ ID NO: 8341 - protein, 81 aa, Aotus trivirgatus
ESLTLEDVAVDFTWEEWQLLSPTQKDLYRDVMLENYSNLVAVGYQASKPNALLKLEREEPCCTTEDESYTQICSDSGKIRK

SEQ ID NO: 8342 - protein, 81 aa, Aotus trivirgatus
MIKTQESLTLEDVAVEFSWEEWQLLDTAQKDLYRDVMVENYNHLVSLGYQTSKPDALSKLAHGQEPWMTDAKIQNKNCPGI

SEQ ID NO: 8343 - protein, 81 aa, Aotus trivirgatus
MALTQGSLTFKDVAIEFSQEEWKCLDPVQKALYRDVMLENYRNLGFLGLCLPDLNIISMLEQGKEPWTVVSQVKITRNPNW

SEQ ID NO: 8344 - protein, 81 aa, Aotus trivirgatus
FSQKPQVLGPEEQDGSCEASMSFEDVTMDFSREEWQQLDPAQKRLYQDVMLELYSHLFSVGYQIPNPDVIFRRLKEKEPCM

SEQ ID NO: 8345 - protein, 81 aa, Aotus trivirgatus
MPADVNFSQKPQVLGPEEQDGSCEASMSFEDVTMDFSREEWQQLDPAQKRLYQDVMLELYSHLFSVGYQIPNPDVIFRRLK

SEQ ID NO: 8346 - protein, 81 aa, Aotus trivirgatus
MAEEFVTLKDVAMDFTLEDWEQFGLDQGDLFWDTALDNYQNLFLLNPPRPNLTSHPDGSEDLEPLARGSPEATGPDLAETT

SEQ ID NO: 8347 - protein, 81 aa, Aotus trivirgatus
MDFTLEDWEQFGLDQGDLFWDTALDNYQNLFLLNPPRPNLTSHPDGSEDLEPLARGSPEATGPDLAETTNSPLMQDFLEEG

SEQ ID NO: 8348 - protein, 81 aa, Aotus trivirgatus
FQEESPEGDTGRTEQKPMVKDAFKDISIYFSKEEWAEMGDWEKTRYRNVKRNYNALITIGLRATRPAFMCHRRQAIKLQVD

SEQ ID NO: 8349 - protein, 81 aa, Aotus trivirgatus
QKPMVKDAFKDISIYFSKEEWAEMGDWEKTRYRNVKRNYNALITIGLRATRPAFMCHRRQAIKLQVDDTEDSDEEWTPRQQ

SEQ ID NO: 8350 - protein, 81 aa, Aotus trivirgatus
VKRNYNALITIGLRATRPAFMCHRRQAIKLQVDDTEDSDEEWTPRQQVKPPGTAFRVEQSKHQKIVRCVRTSSLAAVLLMG

SEQ ID NO: 8351 - protein, 81 aa, Aotus trivirgatus
VSLTFEDVAVLFTRDEWRKLAPSQRNLYRDVMLENYRNLVSLGLPFTKPKVISLLQQGEDPWKVEKDCSGGSSPGCKSNPK

SEQ ID NO: 8352 - protein, 81 aa, Aotus trivirgatus
MAVSHLPSMVQESVTFKDVAVLFTQEEWGQLSPAQRALYRDVMLENYSNLVSLGLLGPKPDIFSQLEKKEEWMPEDPSGGF

SEQ ID NO: 8353 - protein, 81 aa, Aotus trivirgatus
MARRLLPAQVQESVTFRDVAVFFSPDEWLHLDSAQRALYREVMLENYSSLVSLGILLSKPKVISHLEQGEDPWMVESGVPQ

SEQ ID NO: 8354 - protein, 81 aa, Aotus trivirgatus
MAVDLLPAQESMTFRDVAVFFSQDEWLHLDSAQRALYREVMLENYSTLVSLGIPFSMPKVIHQLQQGQDPCMVEGEVPSDI

SEQ ID NO: 8355 - protein, 81 aa, Aotus trivirgatus
PLAAQSPEGHHGHQEPGSTYFHPPRIQEEWGLLDRSQKELYWDAMLEKYGTVVSLGLPPHQPEAQAPSELGMLLTGAGVCR

SEQ ID NO: 8356 - protein, 81 aa, Aotus trivirgatus
MAFEDVAVYFSQDEWGLLDTAQRALYRHVMLENFTLVTSLGLSTSRPLVVIQLERGEDPWVPSVKDMTLARNAYGRRNTGS

SEQ ID NO: 8357 - protein, 81 aa, Aotus trivirgatus
MAFEDVAVYFSQDEWGLLDTAQRALYRHVMLENFTLVTSLGLSTSRPLVVIQLERGEDPWVPSVKDMTLARNAYGRRNTGE

SEQ ID NO: 8358 - protein, 81 aa, Aotus trivirgatus
GPARHTCWPCGSAVPSLKSLVIFEDVAVYFSQEEWGLLNAAQRHLYHNVMVENFELITSLGCWHGVEGEEPHPKKNASVEE

SEQ ID NO: 8359 - protein, 81 aa, Aotus trivirgatus
PSLKSLVIFEDVAVYFSQEEWGLLNAAQRHLYHNVMVENFELITSLGNALPQHDVFACSVGADLPNCFPNWLPHFTFLSAV

SEQ ID NO: 8360 - protein, 81 aa, Aotus trivirgatus
MAGEVQAQLDPSLQGLVMFEDVAVYFSREEWGLLNVTQKGLYRDVMLENFALLSSLGLAPSRSPVFTQLVDDEQSFVPSWV

SEQ ID NO: 8361 - protein, 81 aa, Aotus trivirgatus
MAGEVQGLVMFEDVAVYFSREEWGLLNVTQKGLYRDVMLENFALLSSLGLAPSRSPVFTQLVDDEQSFVPSWVDVTLVSRT

SEQ ID NO: 8362 - protein, 81 aa, Aotus trivirgatus
DEAAAAVMSVGPAAAQLQEPVTFRDVAVDFTQEEWGQLDPTQRILYRDVMLETFGHLLSIGSELPKPEVISHLEQGTEPWV

SEQ ID NO: 8363 - protein, 81 aa, Aotus trivirgatus
MEARSHQVPPQASVCFEDVAMAFTQEEWGQLDLAQRTLYREVTLETWEHLVSLGLLLSKPDVISQLEQEEDLCRAEQVALQ

SEQ ID NO: 8364 - protein, 81 aa, Aotus trivirgatus
MEARSHQVPPQASVCFEDVAMAFTQEEWGQLDLAQRTLYREVTLETWEHLVSLDWKATLEKNRLNSGKDQAWDEISHHVEV

SEQ ID NO: 8365 - protein, 81 aa, Aotus trivirgatus
EDVAMAFTQEEWGQLDLAQRTLYREVTLETWEHLVSLGLLLSKPDVISQLEQEEDLCRAEQVALQDGVSLSLPRLECNGAI

SEQ ID NO: 8366 - protein, 81 aa, Aotus trivirgatus
QEEKQEDAAICPVTVLPEEPVTFQDVAVDFSREEWGLLGPTQRTEYRDVMLETFGHLVSVGWETTLENKQLASNSGIPGEE

SEQ ID NO: 8367 - protein, 81 aa, Aotus trivirgatus
MASRLPTVWSCEPVTFEDVTLGFNPEEWGLLDLKQKSLYREVMLENYRNLVSVEHQLSKPDVVSQLEEAEDFWPVEKGIPQ

SEQ ID NO: 8368 - protein, 81 aa, Aotus trivirgatus
MASRLPTVWSCEPVTFEDVTLGFNPEEWGLLDLKQKSLYREVMLENYRNLVSVEYPELQLDAKLDPLSAESPLMNIEVVEV

SEQ ID NO: 8369 - protein, 81 aa, Aotus trivirgatus
MLENYRNLVSVEHQLSKPDVVSQLEEAEDFWPVEKGIPQDTIPEYPELQLDAKLDPLSAESPLMNIEVVEVLTLNQEVAGP

SEQ ID NO: 8370 - protein, 81 aa, Aotus trivirgatus
ARMRDVHCRRRGLLAVRREQVTFEDVVVDFTQEEWGQLELAERTLYCDVMLDTFRLLVAVGHWLPKPNIISLLEQEAKLWA

SEQ ID NO: 8371 - protein, 81 aa, Aotus trivirgatus
NPGLCAARDPEQVTFEDVVVDFTQEEWGQLELAERTLYCDVMLDTFRLLVAVGHWLPKPNIISLLEQEAKLWAVDPGVPRG

SEQ ID NO: 8372 - protein, 81 aa, Aotus trivirgatus
GSPEEGRRAAGLPAAQVQEPVTFKDVAVDFTQEEWGQLDLVQRTLYRDVMLETYGHLLSVGNQIAKPEVISLLEQGAEPWS

SEQ ID NO: 8373 - protein, 81 aa, Aotus trivirgatus
MAAAALMAPARGIVTFEDVAVYFSWKEWSLLDEAQKCLYHDVMLENLTLTTSLGGCGTEDEEAPYQQSTSPQRVSQVRIPK

SEQ ID NO: 8374 - protein, 81 aa, Aotus trivirgatus
MQQGTVTFEDVAVNFSREEWSLLSEVQRCLYHDVMLENWVLISSLGCWCESEDEEAPSKQNISILQRVSQVSTPRAGVSLK

SEQ ID NO: 8375 - protein, 81 aa, Aotus trivirgatus
HRMTWDCIAIGNHENSVQGTVTFEDVAVNFSREEWSLLSEVQRCLYHDVMLENWVLISSLGCWCESEDEEAPSKQNISILQ

SEQ ID NO: 8376 - protein, 81 aa, Aotus trivirgatus
MQGTVTFEDVAVNFSREEWSLLSEVQRCLYHDVMLENWVLISSLGCWCESEDEEAPSKQNISILQRVSQVSTPRAGVSLKK

SEQ ID NO: 8377 - protein, 81 aa, Aotus trivirgatus
MAAAALRLPAQGTVTFEDVAVKFSQEEWSLLSEAQRCLYHDVMLENLALISSLGCWYGANDETPSKQTLSIQQQSPLRSHW

SEQ ID NO: 8378 - protein, 81 aa, Aotus trivirgatus
MAALALRDPAQGTVTFEDVAVKFSQEEWSLLSEAQRCLYHDVMLENLALISSLGCWYGANDETPSKQTLSIQQQSPLRSHW

SEQ ID NO: 8379 - protein, 81 aa, Aotus trivirgatus
MAAAALRAPAPGTVTFEDVAVHFSWEEWGLLDEAQRCLYHDVMLENLALLTSLDVHYQKQHFGEKHFRSNVDRALFVKTCI

SEQ ID NO: 8380 - protein, 81 aa, Aotus trivirgatus
SQPGPQSSMAALALRDPAQGMTFEDVAIYFSQEEWELLDEAQRFLYCNVMLENFAHVTSLGFCHGTENEAIASEHSVSVGG

SEQ ID NO: 8381 - protein, 81 aa, Aotus trivirgatus
MTFEDVAIYFSQEEWELLDEAQRFLYCNVMLENFAHVTSLGFCHGTENEAIASEHSVSVGGKLQVRTSKGDTPTQNTHLTE

SEQ ID NO: 8382 - protein, 81 aa, Aotus trivirgatus
TDPAPVPIGTEVLSEPRGSVTFEDVAVYFSWEEWDLLDETQKHLYFDVMLENFVLTSSLGYWRGLEREEAPSSSVGTDIPQ

SEQ ID NO: 8383 - protein, 81 aa, Aotus trivirgatus
VQLRPPTRMATALTDPAPGSVTFEDVAVYFSWEEWDLLDETQKHLYFDVMLENFVLTSSLGYWRGLEREEAPSSSVGTDIP

SEQ ID NO: 8384 - protein, 81 aa, Aotus trivirgatus
VQLRPPTRMATALTDPAPGSVTFEDVAVYFSWEEWDLLDETQKHLYFDVMLENFVLTSSLGLTSSWSHVVAQLGLGEVSSV

SEQ ID NO: 8385 - protein, 81 aa, Aotus trivirgatus
TDPAPVPIGTEVLSEPRGSVTFEDVAVYFSWEEWDLLDETQKHLYFDVMLENFVLTSSLGLTSSWSHVVAQLGLGEVSSVL

SEQ ID NO: 8386 - protein, 81 aa, Aotus trivirgatus
GSVTFEDVAVYFSWEEWDLLDETQKHLYFDVMLENFVLTSSLGYWRGLEREEAPSSSVGTDIPQRISVKGVPQFRTSKEGS

SEQ ID NO: 8387 - protein, 81 aa, Aotus trivirgatus
MASALRVPTRQGFVTFEDVAIYFSQEEWELLSETQRLLYRDVMLENFAVMASLGCWCGAEDKEAPSAESISEEELSQGRTP

SEQ ID NO: 8388 - protein, 81 aa, Aotus trivirgatus
MAAAALRAPTQGCVTFEDIAIYFSQEEWGRLDEAQRLLYLEVMLENFALVASLGCGHGTEDEKTPSEQNVSIGVSQSKAGS

SEQ ID NO: 8389 - protein, 81 aa, Aotus trivirgatus
RAPTQVTVTPETHMDLTKGCVTFEDIAIYFSQEEWGRLDEAQRLLYLEVMLENFALVASLGCGHGTEDEKTPSEQNVSIGV

SEQ ID NO: 8390 - protein, 81 aa, Aotus trivirgatus
MAAAALRAPTQEEWGRLDEAQRLLYLEVMLENFALVASLGCGHGTEDEKTPSEQNVSIGVSQSKAGSSTQKTQPCEMCVPV

SEQ ID NO: 8391 - protein, 81 aa, Aotus trivirgatus
MDLTKGCVTFEDIAIYFSQEEWGRLDEAQRLLYLEVMLENFALVASLGCGHGTEDEKTPSEQNVSIGVSQSKAGSSTQKTQ

SEQ ID NO: 8392 - protein, 81 aa, Aotus trivirgatus
RALTPVPMTAEAKFTGFTQGSVTFEDVAIYFSQEEWGLLDEAQRLLYRDVMLENFALLTSLVCWHGMEDEETPQQSVSVKG

SEQ ID NO: 8393 - protein, 81 aa, Aotus trivirgatus
MAEGKDAAQLLVTFKDVAVTFTQEEWRQLDLAQRTLYQEVMLETCGLLVSLGYWVPKPELVHLLEHGQELWTVKRGRSHPT

SEQ ID NO: 8394 - protein, 81 aa, Aotus trivirgatus
LLVTFKDVAVTFTQEEWRQLDLAQRTLYQEVMLETCGLLVSLGDKAQVQTREPTTYLPVLSERAFLRGSLTLECSSDSKLG

SEQ ID NO: 8395 - protein, 81 aa, Aotus trivirgatus
LANPPQIPVATEEFVKPSQGHVTFEDIAVYFSQEEWGLLDEAQRCLYHDVMLENFSLMTSVAGLSQNNHKDSCLQWKVPVS

SEQ ID NO: 8396 - protein, 81 aa, Aotus trivirgatus
MDAAALANPPQGHVTFEDIAVYFSQEEWGLLDEAQRCLYHDVMLENFSLMTSVGCLHGIGAEEAPSEQIVSVEGVSQARTP

SEQ ID NO: 8397 - protein, 81 aa, Aotus trivirgatus
ANPPQIPVATEEFVKPSQGHVTFEDIAVYFSQEEWGLLDEAQRCLYHDVMLENFSLMTSVGCLHGIGAEEAPSEQIVSVEG

SEQ ID NO: 8398 - protein, 81 aa, Aotus trivirgatus
EPAQVLVAAESLIDNEEQGYVTFEDVAVYFSQEEWRLLDEAQRLLYRNVMLENFSLMASLGCWHGVEAKEAPKQSASVGVL

SEQ ID NO: 8399 - protein, 81 aa, Aotus trivirgatus
REPAQVLVAAESLIDNEEGYVTFEDVAVYFSQEEWRLLDEAQRLLYRNVMLENFSLMASLGLASSKTHEITQLESWEEPFV

SEQ ID NO: 8400 - protein, 81 aa, Aotus trivirgatus
MAAAALREPAQGYVTFEDVAVYFSQEEWRLLDEAQRLLYRNVMLENFSLMASLGCWHGVEAKEAPKQSASVGVLSSNTQQH

SEQ ID NO: 8401 - protein, 81 aa, Aotus trivirgatus
MAAAALREPAQQGYVTFEDVAVYFSQEEWRLLDEAQRLLYRNVMLENFSLMASLGLASSKTHEITQLESWEEPFVPAWDVM

SEQ ID NO: 8402 - protein, 81 aa, Aotus trivirgatus
EPAQVLVAAESLIDNEEQGYVTFEDVAVYFSQEEWRLLDEAQRLLYRNVMLENFSLMASLGLASSKTHEITQLESWEEPFV

SEQ ID NO: 8403 - protein, 81 aa, Aotus trivirgatus
MAAAALREPAQGYVTFEDVAVYFSQEEWRLLDEAQRLLYRNVMLENFSLMASLGLASSKTHEITQLESWEEPFVPAWDVMT

SEQ ID NO: 8404 - protein, 81 aa, Aotus trivirgatus
ALREPAQVLVAAESLIDNDYVTFEDVAVYFSQEEWRLLDEAQRLLYRNVMLENFSLMASLGCWHGVEAKEAPKQSASVGVL

SEQ ID NO: 8405 - protein, 81 aa, Aotus trivirgatus
MAAAALREPAQQGYVTFEDVAVYFSQEEWRLLDEAQRLLYRNVMLENFSLMASLGCWHGVEAKEAPKQSASVGVLSSNTQQ

SEQ ID NO: 8406 - protein, 81 aa, Aotus trivirgatus
FEDVAVYFSQEEWRLLDEAQRLLYRNVMLENFSLMASLGLASSKTHEITQLESWEEPFVPAWDVMTSAIPRGTRWVELREV

SEQ ID NO: 8407 - protein, 81 aa, Aotus trivirgatus
MAAAALREPAQGYVTFEDVAVYFSQEEWRLLDEAQRLLYRNVMLENFSLMASLGKVLTPRPSILGWAQLFLLFLGTSLFFP

SEQ ID NO: 8408 - protein, 81 aa, Aotus trivirgatus
REPAQVLVAAESLIDNEEGYVTFEDVAVYFSQEEWRLLDEAQRLLYRNVMLENFSLMASLGKVLTPRPSILGWAQLFLLFL

SEQ ID NO: 8409 - protein, 81 aa, Aotus trivirgatus
LREPAQVLVAAESLIDNEGYVTFEDVAVYFSQEEWRLLDEAQRLLYRNVMLENFSLMASLGKVLTPRPSILGWAQLFLLFL

SEQ ID NO: 8410 - protein, 81 aa, Aotus trivirgatus
LREPAQGYVTFEDVAVYFSQEEWRLLDEAQRLLYRNVMLENFSLMASLGLASSKTHEITQLESWEEPFVPAWDVMTSAIPR

SEQ ID NO: 8411 - protein, 81 aa, Aotus trivirgatus
MGQAQVPMNSEVIMDPIQGQVNFEDVFVYFSQEEWVLLDEAQRLLYRDVMLENFALMASLGCRPGMKDEEIPFEQSISIGL

SEQ ID NO: 8412 - protein, 81 aa, Aotus trivirgatus
MNSEVIMDPIQGQVNFEDVFVYFSQEEWVLLDEAQRLLYRDVMLENFALMASLGHTSFTSHTVASPVMVPDWVDVTPAVAT

SEQ ID NO: 8413 - protein, 81 aa, Aotus trivirgatus
MAAAAPMGQAQGQVNFEDVFVYFSQEEWVLLDEAQRLLYRDVMLENFALMASLGHTSFTSHTVASPVMVPDWVDVTPAVAT

SEQ ID NO: 8414 - protein, 81 aa, Aotus trivirgatus
VNLTEDCMVFEDVAIHFSQEEWGILNDAQRHLHSNVMLENFALLSSVGCWHGAKDKEAPSKQCVSVRVLQVTTPKPALSTL

SEQ ID NO: 8415 - protein, 81 aa, Aotus trivirgatus
MFMDAGQDCMVFEDVAIHFSQEEWGILNDVQRHLHSDVMLENFALLSSVGCWHGAKDEEAPSKQYVSVGVSQVTTLKPALS

SEQ ID NO: 8416 - protein, 81 aa, Aotus trivirgatus
VNLIEDCMVFEDVAIHFSQEEWGILNDVQRHLHSDVMLENFALLSSVGCWHGAKDEEAPSKQYVSVGVSQVTTLKPALSTQ

SEQ ID NO: 8417 - protein, 81 aa, Aotus trivirgatus
LTEVGVLVPWLAEMDPAQDRVVFEDVAIYFSQEEWGHLDEAQRLLYRDVMLENLALLSSLGFIAVAAMFMDAGQDCMVFED

SEQ ID NO: 8418 - protein, 81 aa, Aotus trivirgatus
RLLYRDVMLENLALLSSLGFIAVAAMFMDAGQDCMVFEDVAIHFSQEEWGILNDVQRHLHSDVMLENFALLSSVGFISIIH

SEQ ID NO: 8419 - protein, 81 aa, Aotus trivirgatus
MNLTEGPAAEMDPAQDCMVFEDVAIHFSQEEWGILNDVQRHLHSDVMLENFALLSSVGCWHGAKDEEAPSKQYVSVGVSQV

SEQ ID NO: 8420 - protein, 81 aa, Aotus trivirgatus
LTEVGVLVPWLAEMDPAQDRVVFEDVAIYFSQEEWGHLDEAQRLLYRDVMLENLALLSSLGCWHGAEDEVAPSQQDFSAGV

SEQ ID NO: 8421 - protein, 81 aa, Aotus trivirgatus
MNLTEDRVVFEDVAIYFSQEEWGHLDEAQRLLYRDVMLENLALLSSLGCWHGAEDEVAPSQQDFSAGVSEVTTSKSCMFTQ

SEQ ID NO: 8422 - protein, 81 aa, Aotus trivirgatus
AEMDPAQDRVVFEDVAIYFSQEEWGHLDEAQRLLYRDVMLENLALLSSLGCWHGAEDEVAPSQQDFSAGVSEVTTSKSCMF

SEQ ID NO: 8423 - protein, 81 aa, Aotus trivirgatus
MNLTEGPAAEMDPAQDRVVFEDVAIYFSQEEWGHLDEAQRLLYRDVMLENLALLSSLGKALTLVQCPGLGCVIPFPQAALR

SEQ ID NO: 8424 - protein, 81 aa, Aotus trivirgatus
MAEVNPAQDRVVFEDVAIYFSQEEWGHLDEAQRLLYRDVMLENLALLSSLGCWHGAEDEVAPSQQDFSAGVSEVTTSKSCM

SEQ ID NO: 8425 - protein, 81 aa, Aotus trivirgatus
MAEVNPAQDRVVFEDVAIYFSQEEWGHLDEAQRLLYRDVMLENLALLSSLGCCHGAEDEEAPLEQGVSVGLSQVMAPKPCL

SEQ ID NO: 8426 - protein, 81 aa, Aotus trivirgatus
TYSSFPFWQDRVVFEDVAIYFSQEEWGHLDEAQRLLYRDVMLENLALLSSLGCCHGAEDEEAPLEQGVSVGLSQVMAPKPC

SEQ ID NO: 8427 - protein, 81 aa, Aotus trivirgatus
VSVGLSQVMAPKPCLSTQKTQPCETCSSLLKDILRLAEHDGTHPQQGPYTCPAHLHQHQKEQMREKLCRGDGGRPSFVKKH

SEQ ID NO: 8428 - protein, 81 aa, Aotus trivirgatus
MAAAVLMDRVQRSVTFEDVFVYFSRDEWELLEEAQRFLYRDVMLENFALVATLGFWCEAENEEAPSEQSISVEGVSQVRTA

SEQ ID NO: 8429 - protein, 81 aa, Aotus trivirgatus
MAAAVLMDRVQRSVTFEDVFVYFSRDEWELLEEAQRFLYRDVMLENFALVATLAFIFQFHVVAHLERGRKPWVPNRADITP

SEQ ID NO: 8430 - protein, 81 aa, Aotus trivirgatus
MAGLAQVSVTFEDVAVTFTQEEWGQLDATQRTLYQEVMLEICGLLVSLGCPLSKPELIYQLDHRQELWMAKKDLSQSSYPG

SEQ ID NO: 8431 - protein, 81 aa, Aotus trivirgatus
MAAAWMAPTQESVTFEDVAVTFTQEEWGQLDVTQRALYVEVMLETCGLLVALGDSTKPETLEPNPSHPALPEEVSLQEQLA

SEQ ID NO: 8432 - protein, 81 aa, Aotus trivirgatus
MATALTDPAQVSVTFDDVAVTFTQEEWGQLDLAQRTLYQEVMLENCGLLVSLGCPVPRPELIYHLEHGQEPWTRKEDLSQG

SEQ ID NO: 8433 - protein, 81 aa, Aotus trivirgatus
MAAAVLTDRAQVSVTFDDVAVTFTKEEWGQLDLGQRTLYQEVMLENCGLLVSLGCPVPRPELIYHLEHGQEPWTRKEDLSQ

SEQ ID NO: 8434 - protein, 81 aa, Aotus trivirgatus
MAAAVLTDRAQVSVTFDDVAVTFTKEEWGQLDLGQRTLYQEVMLENCGLLVSLGDKGKPKTTEPTTCDPALSEGVSFQGQL

SEQ ID NO: 8435 - protein, 81 aa, Aotus trivirgatus
MKNSQGRVTFEDVTVTFTKGEWQQLNPEQRNLYRDVMLENYSNLVSVGREETTKPNVILRLEQGKEPWSEEEEVLRGGLAE

SEQ ID NO: 8436 - protein, 81 aa, Aotus trivirgatus
MAAQLLTDEVLESVTFRDVTVDFTQEEWQQLEPAQKDLYRDVMLENYRNLVSLDWETRPEMKELDPKNDILEDKPSVVGVA

SEQ ID NO: 8437 - protein, 81 aa, Aotus trivirgatus
SQEEGEVTGIKLLKAMSPGSVTFTDVAIDFSQDEWEWLNLAQRSLYKKVMLENYRNLVSVGLCISKPDVISLLEQEKDPWV

SEQ ID NO: 8438 - protein, 81 aa, Aotus trivirgatus
NQKLEAAGMGIEPKAVSQGLVTFGDVAIDFSQEEWEWLSPIQRNLYRKVMLENYRNLASLGLCVSKPDVISLLEQGKEPWT

SEQ ID NO: 8439 - protein, 81 aa, Aotus trivirgatus
LEYSLLGEHWDCDALFETQPGLVTMKNLAIDFPQQLHPALKNFCKNGLWENYSDLGSAGRCMAKPDLVSLLEQEKEPWMVK

SEQ ID NO: 8440 - protein, 81 aa, Aotus trivirgatus
LEYSLLGEHWDCDALFETQPGLVTMKNLAIDFPQQLHPALKNFCKNGLWENYSDLGSAGRCMAKPDLVSLLEQEKEPWMET

SEQ ID NO: 8441 - protein, 81 aa, Aotus trivirgatus
MNVEVLKVISQDLVTFKDVAIDFSQEEWQWMNPAQKRLYRSMMLENYQSLVSLGLCVSKPYVISLLEQGREPWEMTSEMTR

SEQ ID NO: 8442 - protein, 81 aa, Aotus trivirgatus
MSKDLVTFGDVAVNFSQEEWEWLNPAQRNLYRKVMLENYRTLVSLGVSVSKPDVISLLEQGKEPWMVKKEGTRGACPGWEH

SEQ ID NO: 8443 - protein, 81 aa, Aotus trivirgatus
EILPEVQSKEYDKSWQTLHQDTVFDIQQSFPTKEKEHKHEAQKKGYRKKSVEMKQRKVYMEKKLLKCNDCEKVFNQSSSLT

SEQ ID NO: 8444 - protein, 81 aa, Aotus trivirgatus
MSLGSELFRDVAIVFSQEEWQWLAPAQRDLYRDVMLETYSNLVSLGLAISKPDVISFLEQGREPWMVERVVAGGLCPVLES

SEQ ID NO: 8445 - protein, 81 aa, Aotus trivirgatus
MSLGSELFRDVAIVFSQEEWQWLAPAQRDLYRDVMLETYSNLVSLGLAISKPDVISFLEQGREPWMVERVVAGGLCPEAKD

SEQ ID NO: 8446 - protein, 81 aa, Aotus trivirgatus
MAAILLTARPKVPVSFEDVSVYFTKTEWKLLDLRQKVLYKRVMLENYSHLVSLGFSFSKPHLISQLERGEGPWVADIPRTW

SEQ ID NO: 8447 - protein, 81 aa, Aotus trivirgatus
MINFQESVTFQDVAVDFTPEEWQLLDCAERTLYWDVMLENYKNLISVGCPVTKTKVILKAEQGQEPWMVEGVNPHQSSPES

SEQ ID NO: 8448 - protein, 81 aa, Aotus trivirgatus
EESLENEVNPGLPTAESQELLTFKDISIDFTQEEWGQLTPAHQSLYREVMLENYSNLVSVGYQLSKPSVISQLEKGEEPWM

SEQ ID NO: 8449 - protein, 81 aa, Aotus trivirgatus
EEPWMTEKEGPGDPSSDLKSNTETTESTAKSTISQERLYHGIVMERFMRDDIIYSTLRKVSTYDDVLERYQETCVRDVRQA

SEQ ID NO: 8450 - protein, 81 aa, Aotus trivirgatus
EIIIKVEGEDTESLTIPSQEGVNFKIVTVDFTQEEQGTWNPAQRSLDRNILESHRDKVSWDLATAVGKEDSTSKQNIFDEE

SEQ ID NO: 8451 - protein, 81 aa, Aotus trivirgatus
ESMEEQDEKPPEPPKACAQEGVNFKIVTVDFTQEEQGTWNPAQRSLDRNILESHRDKVSWDLATAVGKEDSTSKQNIFDEE

SEQ ID NO: 8452 - protein, 81 aa, Aotus trivirgatus
MIKLQMVTFKDVAVVFTEEELGLLDSVQRKLYRDVMLENFRNLLLVAHQPFKPDLISQLEREEKLLMVDTETPRDGCSGRK

SEQ ID NO: 8453 - protein, 81 aa, Aotus trivirgatus
EKLLMVDTETPRDGCSGRKNQQKMETIQEVRVSYLSPRELSSCQTWQQSAGGLIRCQDFLNVFQGKNYQLQEQGESLCKVW

SEQ ID NO: 8454 - protein, 81 aa, Aotus trivirgatus
MIKFQEMVTFKDVAVVFTEEELGLLDSVQRKLYRDVMLENFRNLLLVAHQPFKPDLISQLEREEKLLMVDTETPRDGCSGR

SEQ ID NO: 8455 - protein, 81 aa, Aotus trivirgatus
MVTFKDVAVVFTEEELGLLDSVQRKLYRDVMLENFRNLLLVAHQPFKPDLISQLEREEKLLMVDTETPRDGCSGRKNQQKM

SEQ ID NO: 8456 - protein, 81 aa, Aotus trivirgatus
GLFLSLPSPRKRRKMIKFQEMVTFKDVAVVFTEEELGLLDSVQRKLYRDVMLENFRNLLLVAHQPFKPDLISQLEREEKLL

SEQ ID NO: 8457 - protein, 81 aa, Aotus trivirgatus
HQPFKPDLISQLEREEKLLMVDTETPRDGCSGRKNQQKMETIQEVRVSYLSPRELSSCQTWQQSAGGLIRCQDFLNVFQGK

SEQ ID NO: 8458 - protein, 81 aa, Aotus trivirgatus
REEKLLMVDTETPRDGCSGRKNQQKMETIQEVRVSYLSPRELSSCQTWQQSAGGLIRCQDFLNVFQGKNYQLQEQGESLCK

SEQ ID NO: 8459 - protein, 81 aa, Aotus trivirgatus
SQDYDFPQKEQEKMTKFQEAVTFKDVAVVFSSEELRLLDLTQRKLYRDVMVENFKNLVAVGHLPFQPDMVSQLEAEEKLWM

SEQ ID NO: 8460 - protein, 81 aa, Aotus trivirgatus
MLSQDYDFPQKEQEKMTKFQEAVTFKDVAVVFSSEELRLLDLTQRKLYRDVMVENFKNLVAVGSKHQNKMETLQKFALKYL

SEQ ID NO: 8461 - protein, 81 aa, Aotus trivirgatus
SQDYDFPQKEQEKMTKFQEAVTFKDVAVVFSSEELRLLDLTQRKLYRDVMVENFKNLVAVGSKHQNKMETLQKFALKYLSN

SEQ ID NO: 8462 - protein, 81 aa, Aotus trivirgatus
MLSQDYDFPQKEQEKMTKFQEAVTFKDVAVVFSSEELRLLDLTQRKLYRDVMVENFKNLVAVGHLPFQPDMVSQLEAEEKL

SEQ ID NO: 8463 - protein, 81 aa, Aotus trivirgatus
LSQDYDFPQKEQEKMTKFQEAVTFKDVAVVFSSEELRLLDLTQRKLYRDVMVENFKNLVAVGHLPFQPDMVSQLEAEEKLW

SEQ ID NO: 8464 - protein, 81 aa, Aotus trivirgatus
MNMFKEAVTFKDVAVAFTEEELGLLGPAQRKLYRDVMVENFRNLLSVGHQPFKGDVSPIERKEQLCIMKTATQRQRNLGKN

SEQ ID NO: 8465 - protein, 81 aa, Aotus trivirgatus
TFKDVAVAFTEEELGLLGPAQRKLYRDVMVENFRNLLSVGHQPFKGDVSPIERKEQLCIMKTATQRQRNLGKNQTVVSSYG

SEQ ID NO: 8466 - protein, 81 aa, Aotus trivirgatus
MNMFKEAVTFKDVAVAFTEEELGLLGPAQRKLYRDVMVENFRNLLSVGHQPFKGDVSPIERKEQLCIMKTATQRQRNLGEN

SEQ ID NO: 8467 - protein, 81 aa, Aotus trivirgatus
RKEQLCIMKTATQRQRNLGENNQSKLMTVQDRESEEELSCWQIWQQIASDLTRCQDFMINNSQFHKQGDFPCQVGAGLSIQ

SEQ ID NO: 8468 - protein, 81 aa, Aotus trivirgatus
MVENFRNLLSVGHQPFKGDVSPIERKEQLCIMKTATQRQRNLGENNQSKLMTVQDRESEEELSCWQIWQQIASDLTRCQDF

SEQ ID NO: 8469 - protein, 81 aa, Aotus trivirgatus
IERKEQLCIMKTATQRQRNLGENNQSKLMTVQDRESEEELSCWQIWQQIASDLTRCQDFMINNSQFHKQGDFPCQVGAGLS

SEQ ID NO: 8470 - protein, 81 aa, Aotus trivirgatus
VGHQPFKGDVSPIERKEQLCIMKTATQRQRNLGENNQSKLMTVQDRESEEELSCWQIWQQIASDLTRCQDFMINNSQFHKQ

SEQ ID NO: 8471 - protein, 81 aa, Aotus trivirgatus
MNMFKEAVTFKDVAVAFTEEELGLLGPAQRKLYRDVMVENFRNLLSVGHQPFKGDVSPIERKEQLCIMKTATQRQRNLDTL

SEQ ID NO: 8472 - protein, 81 aa, Aotus trivirgatus
AVAFTEEELGLLGPAQRKLYRDVMVENFRNLLSVGHQPFKGDVSPIERKEQLCIMKTATQRQRNLDTLLVKAVLFYDLAQT

SEQ ID NO: 8473 - protein, 81 aa, Aotus trivirgatus
MVENFRNLLSVGHQPFKGDVSPIERKEQLCIMKTATQRQRNLGKNQTVVEFLWLTVHLLCFPPALLPSPGPNCQISFLDYC

SEQ ID NO: 8474 - protein, 81 aa, Aotus trivirgatus
EAVTFKDVAVAFTEEELGLLGPAQRKLYRDVMVENFRNLLSVGHQPFKGDVSPIERKEQLCIMKTATQRQRNLGKNQTVVS

SEQ ID NO: 8475 - protein, 81 aa, Aotus trivirgatus
MVENFRNLLSVGHQPFKGDVSPIERKEQLCIMKTATQRQRNLGKNQTVVSSYGLSIALLPSSLVAIMAQTAKSLPGLLQHP

SEQ ID NO: 8476 - protein, 81 aa, Aotus trivirgatus
MTTFKEGLTFKDVAVVFTEEELGLLDPLQRNLYRDVMLENFRNLLSVADKIQSEMEAGPHEELSWGQIWKQIASDLVKYED

SEQ ID NO: 8477 - protein, 81 aa, Aotus trivirgatus
MTTLKEALTFKDVAVVFTEEELGLLDPAQRKLYRDVMLENFRNLLSVGHQPLHGDTFHFPREEKFWMVKTATRRKGNLGGK

SEQ ID NO: 8478 - protein, 81 aa, Aotus trivirgatus
MTTLKEALTFKDVAVVFTEEELGLLDPAQRKLYRDVMLENFRNLLSVGHQPLHGDTFHFPREEKFWMVKTATRRKGNLGPA

SEQ ID NO: 8479 - protein, 81 aa, Aotus trivirgatus
KDVAVVFTEEELGLLDPAQRKLYRDVMLENFRNLLSVGHQPLHGDTFHFPREEKFWMVKTATRRKGNLGPAFQILIKTEGF

SEQ ID NO: 8480 - protein, 81 aa, Aotus trivirgatus
RNLLSVGHQPLHGDTFHFPREEKFWMVKTATRRKGNLGGKIQTEMETVPEQGTHEGLFSHQTWEQISGDLTRFQDSMVNSS

SEQ ID NO: 8481 - protein, 81 aa, Aotus trivirgatus
RTMFKEAVTFKDVAVVFTEEELGLLGPAQRKLYRDVMLENFRNLLSVGHQPFHRDTFHLQTEEKFWMMETATQREGNSGGK

SEQ ID NO: 8482 - protein, 81 aa, Aotus trivirgatus
QTEEKFWMMETATQREGNSGGKIQTELESVPETGPHEEWSCQQIWEQIASNLTRPQDSMISSSQFYTQGDVPSQVDAGLSI

SEQ ID NO: 8483 - protein, 81 aa, Aotus trivirgatus
MTSFQEAMTFKDVTVVFTEEELGLLDLAQRLYRDVMLENFRNLLSVGHQLFHQDVFHFLREEKFWVMETATQREGNSDTCG

SEQ ID NO: 8484 - protein, 81 aa, Aotus trivirgatus
IIQRTVLVFYNIMEEAMTFKDVTVVFTEEELGLLDLAQRLYRDVMLENFRNLLSVGHQLFHQDVFHFLREEKFWVMETATQ

SEQ ID NO: 8485 - protein, 81 aa, Aotus trivirgatus
NIMEEAMTFKDVTVVFTEEELGLLDLAQRLYRDVMLENFRNLLSVGHQLFHQDVFHFLREEKFWVMETATQREGNSDTCGK

SEQ ID NO: 8486 - protein, 81 aa, Aotus trivirgatus
EAMTFKDVTVVFTEEELGLLDLAQRLYRDVMLENFRNLLSVGHQLFHQDVFHFLREEKFWVMETATQREGNSGENASVHPY

SEQ ID NO: 8487 - protein, 81 aa, Aotus trivirgatus
AMTFKDVTVVFTEEELGLLDLAQRLYRDVMLENFRNLLSVGHQLFHQDVFHFLREEKFWVMETATQREGNSGENASVHPYT

SEQ ID NO: 8488 - protein, 81 aa, Aotus trivirgatus
HSELCKFTEVEGKMTTIKEAVTFKDVAVVFTEEELELLDPAQRKLYRDIMLENFRNLLSIGNQPFHQDTFHFLRKKKFWMM

SEQ ID NO: 8489 - protein, 81 aa, Aotus trivirgatus
HFLRKKKFWMMKTTSQREGNLGGKIQIETVPEAGPHEEWSCQQIWEQIVSDLTRSQDPIINSSQFFKEGDVPCQIEADLSI

SEQ ID NO: 8490 - protein, 81 aa, Aotus trivirgatus
DPAQRKLYRDIMLENFRNLLSIGNQPFHQDTFHFLRKKKFWMMKTTSQREGNLGGKIQIETVPEAGPHEEWSCQQIWEQIV

SEQ ID NO: 8491 - protein, 81 aa, Aotus trivirgatus
MTKSEEAVTFKDVAVVFSDEELRLLDLTQRKLYRDVMLENFRNVVSVGHQSIPGGLPQSEREEKLWMMKTATQRDNSSGGK

SEQ ID NO: 8492 - protein, 81 aa, Aotus trivirgatus
ATGENPYKYEECGRNVGKSSHCQSPLIVHTGEKPYKCEDCGVSFSQRSYLQVHLKVHTGKKPYKCEECEKSFSWRSRLQAH

SEQ ID NO: 8493 - protein, 81 aa, Aotus trivirgatus
MLENFRNVVSVGHQSIPGGLPQSEREEKLWMMKTATQRDNSSGGKHLKEMETLQEVGLRYLPHEELFCSQIWQQITRELTK

SEQ ID NO: 8494 - protein, 81 aa, Aotus trivirgatus
EESYGALINSCNSRTMTDGLVTFRDVAIDFSQEEWECLDPAQRDLYVDVMLENYSNLVSLDLESTTYDTKKIFSEKDIFEI

SEQ ID NO: 8495 - protein, 81 aa, Aotus trivirgatus
KSCSGFSGFCASPIEESYGALINSCNSRTMTDGLVTFRDVAIDFSQEEWECLDPAQRDLYVDVMLENYSNLVSLGKVICLK

SEQ ID NO: 8496 - protein, 81 aa, Aotus trivirgatus
MDSVGFEDVAVNFTQEEWALLSPSRKQLYRDVMLETCRNLASVGIQWKDQDIENLYQHLGIKLRSLVERLCGRKEGSDHRE

SEQ ID NO: 8497 - protein, 81 aa, Aotus trivirgatus
MNSVSFEDVAVNFTLEEWALLDSSQKKLYKDVMQETFKNLVCLGKRWEDQDVEDDHRNLGRNRRGHMVERLCESRKGSKCR

SEQ ID NO: 8498 - protein, 81 aa, Aotus trivirgatus
MELLTFRDVTIEFSLEEWEYLKPAQQNLYRNVMLENYRNLVSLGLTVSKPELISCLEQRQEPWSVKRHETVAKPPAMSCHY

SEQ ID NO: 8499 - protein, 81 aa, Aotus trivirgatus
MELLTFRDVTIEFSLEEWEYLKPAQQNLYRNVMLENYRNLVSLGLTVSKPELISCLEQRQEPWSVKRHETVAKPPDVLSLH

SEQ ID NO: 8500 - protein, 81 aa, Aotus trivirgatus
MLENYRNLVSLGLTVSKPELISCLEQRQEPWSVKRHETVAKPPAMSCHYTEDFLPEQGMKDSFQKVILRRYGSCGLENLHL

SEQ ID NO: 8501 - protein, 81 aa, Aotus trivirgatus
MFCFIFQELLTFRDVTIEFSLEEWEYLKPAQQNLYRNVMLENYRNLVSLGLTVSKPELISCLEQRQEPWSVKRHETVAKPP

SEQ ID NO: 8502 - protein, 81 aa, Aotus trivirgatus
SGCPGPERNFLVYSFFEKETLTFRDVAIEFSLEEWQCLNPAQQNLYRNVMLENYRNLVFLDIAVSKQNPITCLEQKKEPCN

SEQ ID NO: 8503 - protein, 81 aa, Aotus trivirgatus
GPLTFMDVAIEFCLEEWQCLDTAQQNLYRNVMLENYRNLVFLGIAVSKPDLITCLEQEKEPWNMKRHEMVAKSSGEAFSRS

SEQ ID NO: 8504 - protein, 81 aa, Aotus trivirgatus
MDVAIEFCLEEWQCLDTAQQNLYRNVMLENYRNLVFLGIAVSKPDLITCLEQEKEPWNMKRHEMVAKSSGEAFSRSSNLTK

SEQ ID NO: 8505 - protein, 81 aa, Aotus trivirgatus
MGPLTFMDVAIEFCLEEWQCLDTAQQNLYRNVMLENYRNLVFLGIAVSKPDLITCLEQEKEPWNMKRHEMVAKSSECGEAF

SEQ ID NO: 8506 - protein, 81 aa, Aotus trivirgatus
MGPLTFRDVTVEFSLEEWQFLDAAQQNLYKDVMLENYRNLVFLNIVVSKPDMICLEQGIEPWNIKRHEMVAKAPGSHSVNQ

SEQ ID NO: 8507 - protein, 81 aa, Aotus trivirgatus
ALFPEATAFEDITKDWNYLEASQKDYYRDTMLDSYENMVPQGSFLQFSMMPQRAGNDPPGASNASEMEMEISNMREKFLLS

SEQ ID NO: 8508 - protein, 81 aa, Aotus trivirgatus
LQGKYGNVTKEVIALYLTLCKQCHQKNPVPKKGPAPKPMTFKDIDSTCQVEILDMQSSADGEFKFILYYQDHLTKFIILRP

SEQ ID NO: 8509 - protein, 81 aa, Aotus trivirgatus
VLLKLLLSPGLQQPALFPEATAFEDITKDWNYLEASQKDYYRDTMLDSYENMVPQGSFLQFSMMPQRAGNDPPGASNASEM

SEQ ID NO: 8510 - protein, 81 aa, Aotus trivirgatus
QGKYGNVTKEVIALYLTLCKQCHQKNPVPKKGPAPKPMTFKDIDSTCQVEILDMQSSADGEFKFILYYQDHLTKFIILRPL

SEQ ID NO: 8511 - protein, 81 aa, Aotus trivirgatus
KGHTEGGGLVNELLTSWLQGLVTFEDVAVEFTQEEWALLDPAQRTLYRNVMLENFWNLSSSLDVETPLKASGLASKLHVFR

SEQ ID NO: 8512 - protein, 81 aa, Aotus trivirgatus
MTFDDVAVEFTQWEWGQLNPAQKDLYREVMLENFRNLTLLGLLVSKPYMICQLEEGGEPFMVNTEISVGAHSDWERRSKSK

SEQ ID NO: 8513 - protein, 81 aa, Aotus trivirgatus
MLENYKSVVSLGLPVPQPDMIFQLKRGDEPWMVDLHGSEEREWPESGSLDWETKPEIYDASEEKAERSLRESLGRQSPLCP

SEQ ID NO: 8514 - protein, 81 aa, Aotus trivirgatus
MAAVSPTTRCQESVTFEDVAVVFTDEEWSHLIPIQRDLYKEVMLENYKSVVSLDWETKPEIYDASEEKAERSLRESLGRQS

SEQ ID NO: 8515 - protein, 81 aa, Aotus trivirgatus
MAAVSPTTRCQESVTFEDVAVVFTDEEWSHLIPIQRDLYKEVMLENYKSVVSLGLPVPQPDMIFQLKRGDEPWMVDLHGSE

SEQ ID NO: 8516 - protein, 81 aa, Aotus trivirgatus
MEPRESGKAPVTFDDITVYLLQEEWVLLSKQQKELCGSDKLVPPLGPTVANPELFCKFGRGPEPWLGSMQGQRSLLEHQPG

SEQ ID NO: 8517 - protein, 81 aa, Aotus trivirgatus
QDPSAEQLSEEVPVVFEELPVVFEDVAVYFTREEWGMLDKRQKELYRDVMRMNYELLASLGPAAAKPDLISKLERRAAPWI

SEQ ID NO: 8518 - protein, 81 aa, Aotus trivirgatus
MARKVSITFKDLAVRFSEEEWRLLEEGQREFYRDVMRENYETLVSVGTAELLPLSAFLSPSEPGGAAGGGSRADEGQEPAG

SEQ ID NO: 8519 - protein, 81 aa, Aotus trivirgatus
MRENYETLVSVGTAELLPLSAFLSPSEPGGAAGGGSRADEGQEPAGCGGPQGGQPRHSLHLTALVQLVKEIPEFLFGEVKG

SEQ ID NO: 8520 - protein, 81 aa, Aotus trivirgatus
KKLANCEKTAVEFGNQLEGKWAVLGTLLQEYGLLRRRLENVENLLRNRNFWILRLPPGSKGEAPKVPVTFDDVAVYFSELE

SEQ ID NO: 8521 - protein, 81 aa, Aotus trivirgatus
KKLADYEKMAVEFGNQLEGKWAVLGTLLQEYGLLQRRLENVENLLRNRNFWILRLPPGSKGEAPKVSRSLENDGVCFTEQE

SEQ ID NO: 8522 - protein, 81 aa, Aotus trivirgatus
RNFWILRLPPGSKGEAPKVSRSLENDGVCFTEQEWENLEDWQKELYRNVMESNYETLVSLKVLGQPEGEAELGTEMLGDLE

SEQ ID NO: 8523 - protein, 81 aa, Aotus trivirgatus
PGGAHPAGGVMIKQELQYTQEGSADLPGEFSCIAEEQAFLSPEQTELWGGQGGSVLLETSPGASTLEEPVGSRDPSSGRTV

SEQ ID NO: 8524 - protein, 81 aa, Aotus trivirgatus
NFWILRLPPGSKGEAPKVSRSLENDGVCFTEQEWENLEDWQKELYRNVMESNYETLVSLSSSDSPGSASIVGVTEVLGQPE

SEQ ID NO: 8525 - protein, 81 aa, Aotus trivirgatus
LEEEGPGGAHPAGGVMIKQELQYTQEGSADLPGEFSCIAEEQAFLSPEQTELWGGQGGSVLLETSPGASTLEEPVGSRDPS

SEQ ID NO: 8526 - protein, 81 aa, Aotus trivirgatus
ALCVRGQRSLEERAIPTESITDSPISAQDLLSRIKQEEHQCVWDQQDLADRDIPTDPNSESLISAHDILSWIKQEEQPYPW

SEQ ID NO: 8527 - protein, 81 aa, Aotus trivirgatus
MAEPASVTVTFDDVALYFSEQEWEILEKWQKQMYKQEMKTNYETLDSLGYAFSKPDLITWMEQGRMLLISDQGCLHKTKRT

SEQ ID NO: 8528 - protein, 81 aa, Aotus trivirgatus
QGCLHKTKRTTGPPTDEQLDMKNTEKLPCFDDRGTLGTKEEDCHLNGPQKQDLCAALPGRERKILSAQRASFQSPSLQETE

SEQ ID NO: 8529 - protein, 81 aa, Aotus trivirgatus
GRGCRLCRNSGPCRGWSGVTVTFDDVALYFSEQEWEILEKWQKQMYKQEMKTNYETLDSLGYAFSKPDLITWMEQGRMLLI

SEQ ID NO: 8530 - protein, 81 aa, Aotus trivirgatus
SLGYAFSKPDLITWMEQGRMLLISDQGCLHKTKRTTGPPTDEQLDMKNTEKLPCFDDRGTLGTKEEDCHLNGPQKQDLCAA

SEQ ID NO: 8531 - protein, 81 aa, Aotus trivirgatus
MTEPPRLPLTFEDVAIYFSEQEWQDLQAWQKELYKRVMRSNYETLISLDDGLPKPELISWIEQGEEPFRNWRESQKSGNII

SEQ ID NO: 8532 - protein, 81 aa, Aotus trivirgatus
MAPRAQIQELLTFGDVAVAFTRIEWRHLDAAQRALYRDVMLENYGNLVSVGLLSSKPKLITQLEQGAEPWMEVREVPSGTC

SEQ ID NO: 8533 - protein, 81 aa, Aotus trivirgatus
RDVMLENYGNLVSVGLLSSKPKLITQLEQGAEPWMEVREVPSGTCAVPDYWFETKMSALKQSTSEGSVLGERMKSVMMEKG

SEQ ID NO: 8534 - protein, 81 aa, Aotus trivirgatus
LKTKTQAMAALFLSAPPQAEVTFEDVAVLLSREEWGRLGPAQRGLYRDVMLETYGNLVSLGVGPAGPKPGVISQLERGDEP

SEQ ID NO: 8535 - protein, 81 aa, Aotus trivirgatus
MAALFLSAPPQAEVTFEDVAVLLSREEWGRLGPAQRGLYRDVMLETYGNLVSLGVGPAGPKPGVISQLERGDEPWVLDVQG

SEQ ID NO: 8536 - protein, 81 aa, Aotus trivirgatus
MAALFLSAPPQAEVTFEDVAVLLSREEWGRLGPAQRGLYRDVMLETYGNLVSLALGTSTEYKELTSRETFDEEELGRLRGI

SEQ ID NO: 8537 - protein, 81 aa, Aotus trivirgatus
ALKTKTQAMAALFLSAPPQAEVTFEDVAVLLSREEWGRLGPAQRGLYRDVMLETYGNLVSLALGTSTEYKELTSRETFDEE

SEQ ID NO: 8538 - protein, 81 aa, Aotus trivirgatus
IVMALPMPGPQEAVVFEDVAVYFTRIEWSCLAPEQQVLYRDVMLENYRNLASLGFLVAKPALISLLEQGEEPGALILQVAE

SEQ ID NO: 8539 - protein, 81 aa, Aotus trivirgatus
IVMALPMPGPQEAVVFEDVAVYFTRIEWSCLAPEQQVLYRDVMLENYRNLASLALISLLEQGEEPGALILQVAEQRGAKTS

SEQ ID NO: 8540 - protein, 81 aa, Aotus trivirgatus
ENYRNLASLALISLLEQGEEPGALILQVAEQRGAKTSLCRDSRMEAGIMESPLQRKLSRQAGPSGTVWGCLPEEDPAPSHP

SEQ ID NO: 8541 - protein, 81 aa, Aotus trivirgatus
PALISLLEQGEEPGALILQVAEQRGAKTSLCRENHATLPCRGQEESPASSECGPREKGVARGRAGGAAFSWPHWEHLVTPN

SEQ ID NO: 8542 - protein, 81 aa, Aotus trivirgatus
MEVVTFGDVAVHFSREEWQCLDPGQRALYREVMLENHSSVAGLAGFLVFKPELISRLEQGQEPWVLDLQGAEGTEAPKTSK

SEQ ID NO: 8543 - protein, 81 aa, Aotus trivirgatus
MGFLGCWCVSFQEVVTFGDVAVHFSREEWQCLDPGQRALYREVMLENHSSVAGLAGFLVFKPELISRLEQGQEPWVLDLQG

SEQ ID NO: 8544 - protein, 81 aa, Aotus trivirgatus
MEVVTFGDVAVHFSREEWQCLDPGQRALYREVMLENHSSVAGLGFLVFKPELISRLEQGQEPWVLDLQGAEGTEAPKTSKT

SEQ ID NO: 8545 - protein, 81 aa, Aotus trivirgatus
MEVVTFGDVAVHFSREEWQCLDPGQRALYREVMLENHSSVAGLAFSRTLRFGYLCPCFPRDGSLWAWPSRGAAASGFLVFK

SEQ ID NO: 8546 - protein, 81 aa, Aotus trivirgatus
MYSVSFEDVAVTFTQEEWALLDLSQKSLYRDVMQEIFRNLAFVEKPYECKECGKAFSRSTYLGIHERTHTGEKPYECIKCG

SEQ ID NO: 8547 - protein, 81 aa, Aotus trivirgatus
QEENVRDTQQVVTTLQLPPNRVSPFKDMILCFSEEDWSLLDPAQTGFYGEFIIGEDCGVSMPPNDLAAQPDLSQGEENEPH

SEQ ID NO: 8548 - protein, 81 aa, Aotus trivirgatus
LGSGGKKAQVISVLSQIDGNRVSPFKDMILCFSEEDWSLLDPAQTGFYGEFIIGEDCGVSMPPNDLAAQPDLSQGEENEPH

SEQ ID NO: 8549 - protein, 81 aa, Aotus trivirgatus
MPSQDSMTLEDIVVDFTREEWALLDTSQRKLFRDVMLENISHLVSIGNQFCKSVVFSHLEQVEKVSTQGISLLQGKEGDIK

SEQ ID NO: 8550 - protein, 81 aa, Aotus trivirgatus
TQGISLLQGKEGDIKHQEMPFIQHIYQKDISTISTMRSHTQDDPFLCNDLGEDFTQHIPLTQNMITYMSKKHFVGKMFGKT

SEQ ID NO: 8551 - protein, 81 aa, Aotus trivirgatus
SVVFSHLEQVEKVSTQGISLLQGKEGDIKHQEMPFIQHIYQKDISTISTMRSHTQDDPFLCNDLGEDFTQHIPLTQNMITY

SEQ ID NO: 8552 - protein, 81 aa, Aotus trivirgatus
GSQGNLPQADITLMNQAQESVTFEDVAVNFTDREWQCLTYAQRHLYKDVMLENYGNMVSLGFPVPKPPLISHLERGVEPCV

SEQ ID NO: 8553 - protein, 81 aa, Aotus trivirgatus
GGYCRGDAVVASRVTPESQGLLKVEDVALTLPPEWTQQDSSQVNLCRDEKQENHGSLVFLGGEIQTKSRDLLPAKELPEKE

SEQ ID NO: 8554 - protein, 81 aa, Aotus trivirgatus
HGDKAAMPVFNPVRSQTLVKTEEETAQALATEKWPHLSLAQRNLCGNSAQETVRSLSLMTEEIVTKDRLFNAKQETSEEIE

SEQ ID NO: 8555 - protein, 81 aa, Aotus trivirgatus
GGHCREDAMVASRLTPGSQELLKMEDVALTLSPGWTQLDSSQVNLYRDEKQENHSSLVSLGGEIQTKSSDLPPAEELPEKK

SEQ ID NO: 8556 - protein, 81 aa, Aotus trivirgatus
GNSGNQEMTATLLTAGFQTLEKIEDMAVSLIREEWLLDPSQKNLSRDNRPENFRNMFSLGGETRSENRELASKQVIPTGIQ

SEQ ID NO: 8557 - protein, 81 aa, Aotus trivirgatus
MAQGLVTFADVAIDFSQEEWACLNSAQRDLYWDVMLENYSNVVSLDLESAYETKNLPTEKSLHEICVSRRNSDRRSKSLGH

SEQ ID NO: 8558 - protein, 81 aa, Aotus trivirgatus
SSPWSLALATEGRGSSCEISVSFEDVTVDFSKEEWQHLDPAQRRLYWDVTLENYSHLLSVGYQVPKSEATFKLEQGEGPWT

SEQ ID NO: 8559 - protein, 81 aa, Aotus trivirgatus
AAHVSADHAALNRIVSLQISVSFEDVTVDFSKEEWQHLDPAQRRLYWDVTLENYSHLLSVGYQVPKSEATFKLEQGEGPWT

SEQ ID NO: 8560 - protein, 81 aa, Aotus trivirgatus
QSYSGESIGKIQQQGIPGEIFFHCERFGLLERFDQPIGEASLCSILEELWQDNDQLEQCQENQNNLLSHVKVLIKERGYER

SEQ ID NO: 8561 - protein, 81 aa, Aotus trivirgatus
SPQGFPALIPGEPGRSFEGSVSFEDVAVDFTRQEWHRLDPAQRTMHKDVMLETYSNLASVGLCVAKPDMIFKLERGEELWI

SEQ ID NO: 8562 - protein, 81 aa, Aotus trivirgatus
MAAGERRSLLFFQKPVTFEDVAVNFTQEEWDCLDASQRVLYQDVMSETFKNLASVARMFVHKPELITKLEQQEKQWRMFLH

SEQ ID NO: 8563 - protein, 81 aa, Aotus trivirgatus
EQLKPIKPRDCWGKAWVKKKPVTFEDVAVNFTQEEWDCLDASQRVLYQDVMSETFKNLASVARMFVHKPELITKLEQQEKQ

SEQ ID NO: 8564 - protein, 81 aa, Aotus trivirgatus
MKRDCWGKAWVKKKPVTFEDVAVNFTQEEWDCLDASQRVLYQDVMSETFKNLASVARMFVHKPELITKLEQQEKQWRMFLH

SEQ ID NO: 8565 - protein, 81 aa, Aotus trivirgatus
MLVAAAAERNKEPILHVLRQYLDPAQRGVRVLEVASGSGQHAAHFARAFPLAEWQPSDVDQRCLDRNPEWGLRDTALLEDL

SEQ ID NO: 8566 - protein, 81 aa, Aotus trivirgatus
VLRQYLDPAQRGVRVLEVASGSGQHAAHFARAFPLAEWQPSDVDQRCLDRNPEWGLRDTALLEDLGQASGLFLERMVDMPA

SEQ ID NO: 8567 - protein, 81 aa, Aotus trivirgatus
GVRVLEVASGSGQHAAHFARAFPLAEWQPSDVDQRCLDRNPEWGLRDTALLEDLGQASGLFLERMVDMPANNKCLIFRKNE

SEQ ID NO: 8568 - protein, 81 aa, Aotus trivirgatus
MLVAAAAERNKEPILHVLRQYLDPAQRGVRVLEVASGSGQHAAHFARAFPLAEWQPSDVDQRCLDRGSSEQQDTCSNPRAC

SEQ ID NO: 8569 - protein, 81 aa, Aotus trivirgatus
LRQYLDPAQRGVRVLEVASGSGQHAAHFARAFPLAEWQPSDVDQRCLDRGSSEQQDTCSNPRACSSPMGEGVPISFSRPQP

SEQ ID NO: 8570 - protein, 81 aa, Aotus trivirgatus
SDVDQRCLDRGSSEQQDTCSNPRACSSPMGEGVPISFSRPQPLSVSRAHWEMAHLGPVGCVPIPTALCRQWEDLSPEQRGL

SEQ ID NO: 8571 - protein, 81 aa, Aotus trivirgatus
SQEESPEGDTGRTEQKPMVKDAFKDISIYFSKEEWAEMGDWEKTRYRNVKRNYNALITIGLRATRPAFMCHRRQTIKLQVD

SEQ ID NO: 8572 - protein, 81 aa, Aotus trivirgatus
MIQSQISFEDVAVDFTLEEWQLLSPTQKSLYRDVMLENYSNLVFLGYQIIKPDAISKWEQQDPWILDQEILSQNFSEVWLD

SEQ ID NO: 8573 - protein, 81 aa, Aotus trivirgatus
MIQSQISFEDVAVDFTLEEWQLLSPTQKSLYRDVMLENYSNLVFLEVWLDNPKMWLQDNQDNLKSMERGHKYGVFGKIFKS

SEQ ID NO: 8574 - protein, 81 aa, Aotus trivirgatus
MATSFRIASWWGLLSFKDISMEFTWDEWQLLDSTQKYLYREVTLENYHNLISVGYHGAKPDLIFKLEQGEDPWIINAKISR

SEQ ID NO: 8575 - protein, 80 aa, Aotus trivirgatus
MATSFRIASWWGLLSFKDISMEFTWDEWQLLDSTQKYLYREVTLENYHNLISVDGWEEWYQKNQDELESLERSYSCSVLG

SEQ ID NO: 8576 - protein, 81 aa, Aotus trivirgatus
KFRNLAGVPWPQGNSALPGLLSFKDISMEFTWDEWQLLDSTQKYLYREVTLENYHNLISVGYHGAKPDLIFKLEQGEDPWI

SEQ ID NO: 8577 - protein, 81 aa, Aotus trivirgatus
REVTLENYHNLISVGYHGAKPDLIFKLEQGEDPWIINAKISRESCPDGWEEWYQKNQDELESLERSYSCSVLGRLNLSKTH

SEQ ID NO: 8578 - protein, 81 aa, Aotus trivirgatus
MTMLQESFSFDDLSVDFTQKEWQLLDPSQKNLYKDVMLENYSSLVSLGYEAMKPDVIFKLEQGEEPWIGDEEIPSSYSPEV

SEQ ID NO: 8579 - protein, 81 aa, Aotus trivirgatus
MTMLQESFSFDDLSVDFTQKEWQLLDPSQKNLYKDVMLENYSSLVSLGYEAMKPDVIFKLEQGEEPWIGDEEIPSSYSPVW

SEQ ID NO: 8580 - protein, 81 aa, Aotus trivirgatus
MTMLQESFSFDDLSVDFTQKEWQLLDPSQKNLYKDVMLENYSSLVSLGYEAMKPDVIFKLEQGEEPWIGDEEIPSSYSPGT

SEQ ID NO: 8581 - protein, 81 aa, Aotus trivirgatus
MTMLQESFSFDDLSVDFTQKEWQLLDPSQKNLYKDVMLENYSSLVSLGYEAMKPDVIFKLEQGEEPWIGDEEIPSSYSPVS

SEQ ID NO: 8582 - protein, 81 aa, Aotus trivirgatus
MSQGSVTFRDVAIDFSQEEWKWLQPAQRDLYRCVMLENYGHLVSLGLSISKPDVVSLLEQGKEPWLGKRDVKTDLFSVSES

SEQ ID NO: 8583 - protein, 81 aa, Aotus trivirgatus
MLENYGHLVSLGLSISKPDVVSLLEQGKEPWLGKRDVKTDLFSVSESTGEIKDFSSKNVIYDDSSQYLIMERILSQGPIYS

SEQ ID NO: 8584 - protein, 81 aa, Aotus trivirgatus
MSQGSVTFRDVAIDFSQEEWKWLQPAQRDLYRCVMLENYGHLVSLAGLSISKPDVVSLLEQGKEPWLGKRDVKTDLFSVRV

SEQ ID NO: 8585 - protein, 81 aa, Aotus trivirgatus
MSQGSVTFRDVAIDFSQEEWKWLQPAQRDLYRCVMLENYGHLVSLGLSISKPDVVSLLEQGKEPWLGKRDVKTDLFSVLKE

SEQ ID NO: 8586 - protein, 81 aa, Aotus trivirgatus
IREFGGMGAGIANISFQGSVTFRDVAIDFSQEEWKWLQPAQRDLYRCVMLENYGHLVSLGLSISKPDVVSLLEQGKEPWLG

SEQ ID NO: 8587 - protein, 81 aa, Aotus trivirgatus
RNAEEERMIAVFLTTWLQEPMTFKDVAVEFTQEEWIMLDSAQRSLYKDVMLENYRNLTSVEYQLCRHTVISPLHQEEIRNM

SEQ ID NO: 8588 - protein, 81 aa, Aotus trivirgatus
NMKKRNPQGICPDQKIQPKTKESTMQNILGEEPFNAVKIKFTMDNWSSTLREDWESSHKIRKQYKIRKQHKIPGGHWRQVT

SEQ ID NO: 8589 - protein, 81 aa, Aotus trivirgatus
MDAESLTAWSQTLVTFKDIFVDFTREEWKLLDTAQQIVYRNVMLENYKNLVSLGYQLTKPDVILRLEKGEEPWVVERGIHQ

SEQ ID NO: 8590 - protein, 81 aa, Aotus trivirgatus
ILECLFISQEQPQITKSWGPLSFMDVFVDFTWEEWQLLDPAQKCLYRSVMLENYSNLVSLGYQHTKPDIIFKLEQGEELCM

SEQ ID NO: 8591 - protein, 81 aa, Aotus trivirgatus
KQKSHRTEKILECLFISQEQPQITKSWEWQLLDPAQKCLYRSVMLENYSNLVSLGYQHTKPDIIFKLEQGEELCMVQAPIP

SEQ ID NO: 8592 - protein, 81 aa, Aotus trivirgatus
MAARVRTASVWGPLSFMDVFVDFTWEEWQLLDPAQKCLYRSVMLENYSNLVSLGYQHTKPDIIFKLEQGEELCMVQAPIPN

SEQ ID NO: 8593 - protein, 81 aa, Aotus trivirgatus
SFMDVFVDFTWEEWQLLDPAQKCLYRSVMLENYSNLVSLGYQHTKPDIIFKLEQGEELCMVQAPIPNQCCPILEAGKSKAK

SEQ ID NO: 8594 - protein, 81 aa, Aotus trivirgatus
MAMSQESLTFKDVFVDFTLEEWQQLDSAQKNLYRDVMLENYSHLVSVGYLLAKPDMIFRLGPGDESWRADGGTPVRTCAGK

SEQ ID NO: 8595 - protein, 81 aa, Aotus trivirgatus
MAMSQESLTFKDVFVDFTLEEWQQLDSAQKNLYRDVMLENYSHLVSVGYLLAKPDMIFRLGPGDESWRADGGTPVRTCAGE

SEQ ID NO: 8596 - protein, 81 aa, Aotus trivirgatus
MAMSQESLTFKDVFVDFTLEEWQQLDSAQKNLYRDVMLENYSHLVSVGYLLAKPDMIFRLGPGDESWRADGGTPVRTCAEV

SEQ ID NO: 8597 - protein, 81 aa, Aotus trivirgatus
LAKPDMIFRLGPGDESWRADGGTPVRTCAGEDRPGESGRGKGTRLVGESLASGMRSGALLRARDLWTCLGSDERSCCHVHL

SEQ ID NO: 8598 - protein, 81 aa, Aotus trivirgatus
QKALYREVMRMNYETVLSLEFPFPKPDMITRLEGEEESQNSDEWQLQGGTSAENEESDVKPPDWPSPMNATSHFPQPQHFD

SEQ ID NO: 8599 - protein, 81 aa, Aotus trivirgatus
GHTEGGGLVNELLTSWLQGLVTFEDVAVEFTQEEWALLDPAQRTLYKDVMLENCRNLASLGCHVNKPRLISQLEQDKKVMT

SEQ ID NO: 8600 - protein, 81 aa, Aotus trivirgatus
DLFACSGLEPHTPSVGSQESVTFQDVAVDFTEKEWPLLDSSQRKLYKDVMLENYSNLTSLEMLASGWCHCTPAWVTRAKLH

SEQ ID NO: 8601 - protein, 81 aa, Aotus trivirgatus
KSTKDWKMASELILPASQSLLTFEDVAVYFSEEEWQLLDPPEKTLYNDVMQDIYETVISLGLKLKSDTGNDHPVSVSASEM

SEQ ID NO: 8602 - protein, 81 aa, Aotus trivirgatus
ALVLVEFLHREPDGTKNESLLTFEDVAVYFSEEEWQLLDPPEKTLYNDVMQDIYETVISLGLKLKSDTGNDHPVSVSASEM

SEQ ID NO: 8603 - protein, 81 aa, Aotus trivirgatus
MALTQVRLTFRDVAVEFSQEEWKCLEPTQRALYRDVMLENYWSLVSLGLCHFDMNIISMLEEGKEPWTVKSCMKIARKPRM

SEQ ID NO: 8604 - protein, 81 aa, Aotus trivirgatus
MLENYWSLVSLGLCHFDMNIISMLEEGKEPWTVKSCMKIARKPRMRQCVKDVVTDIPPKCTIKDLLPKEQSSTEAAFHTVM

SEQ ID NO: 8605 - protein, 81 aa, Aotus trivirgatus
KIARKPRMRQCVKDVVTDIPPKCTIKDLLPKEQSSTEAAFHTVMLERRGSPDIEDFSFKELQKNIHDFECQWGDDTENHKG

SEQ ID NO: 8606 - protein, 81 aa, Aotus trivirgatus
MALTQVRLTFRDVAVEFSQEEWKCLEPTQRALYRDVMLENYWSLVSLDIPPKCTIKDLLPKEQSSTEAAFHTVMLERRGSP

SEQ ID NO: 8607 - protein, 81 aa, Aotus trivirgatus
GHLTFRDVVIEFSLAEWKCLTPAQRALYREVMLENYRNLESVDSFLKSMLKFSAAGQGSTREGFHTGTLEKYTSHHIGDSC

SEQ ID NO: 8608 - protein, 81 aa, Aotus trivirgatus
MEEERTTAELQKNRIQDSVVFEDVAVDFTQEEWALLDLAQRNLYRDVMLENFQNLASLGYLLHTPHLISQWEQEEDLQTVK

SEQ ID NO: 8609 - protein, 81 aa, Aotus trivirgatus
MESQGAKTESFMAFGDVTVDFTPKEWRLLSPAQRALYREVTLENYSHLISLGILHSKPELIRRLEQGDAPWGEERRRQPGP

SEQ ID NO: 8610 - protein, 81 aa, Aotus trivirgatus
NAMIVMSVRREQDSSSGEGLLSFEDVAVDFTQEEWQFLDPSQKVLYKEVMSENYRNLVSVGYQGTKPDVLFKLERGESPWI

SEQ ID NO: 8611 - protein, 81 aa, Aotus trivirgatus
MALSQRLFTFKDVTIEFSQEEWECLDPAQRALYRDVMLENYRNLLLLDEDNIPPENNISAGFASKGLSPKENNKEEFYYLV

SEQ ID NO: 8612 - protein, 81 aa, Aotus trivirgatus
MIESQEPVTFEDVAVDFTREERQQLNPAQKTLHRDVMLETYSHLVSVGCSGIKPEVIFKVEHGKDPWIKDSELSRWIYPER

SEQ ID NO: 8613 - protein, 81 aa, Aotus trivirgatus
MIESQEPVTFEDVAVDFTREERQQLNPAQKTLHRDVMLETYSHLVSVGCSGIKPEVIFKVEHGKDPWIKDSELSRWIYPDR

SEQ ID NO: 8614 - protein, 81 aa, Aotus trivirgatus
MIESQEERQQLNPAQKTLHRDVMLETYSHLVSVGCSGIKPEVIFKVEHGKDPWIKDSELSRWIYPDREKGLKSSQRIISGE

SEQ ID NO: 8615 - protein, 81 aa, Aotus trivirgatus
MIESQEPVTFEDVAVDFTREERQQLNPAQKTLHRDVMLETYSHLVSVGCSGIKPEVIFKVEHGKDPWIKDSELSRWIYPGI

SEQ ID NO: 8616 - protein, 81 aa, Aotus trivirgatus
MAKGEEERQQLNPAQKTLHRDVMLETYSHLVSVGCSGIKPEVIFKVEHGKDPWIKDSELSRWIYPDREKGLKSSQRIISGE

SEQ ID NO: 8617 - protein, 81 aa, Aotus trivirgatus
MAKPQGLVTFEDVAVAFTQEEWQYLNPLQRTLYRDVMLETYSNLVFVGQQVTKPDLILKLEVEECPVEGKLPFWSFPEVCQ

SEQ ID NO: 8618 - protein, 81 aa, Aotus trivirgatus
SGEASGSFSSWKAKREQGLVTFEDVAVAFTQEEWQYLNPLQRTLYRDVMLETYSNLVFVGQQVTKPDLILKLEVEECPVEG

SEQ ID NO: 8619 - protein, 81 aa, Aotus trivirgatus
MLQTAWRQERVTFEDVAVYFTQNEWTSLDPVQRALYREVMLENYANVASLAFPFTTPVLVSQLEQGERPWGLDPWEPVGRE

SEQ ID NO: 8620 - protein, 81 aa, Aotus trivirgatus
VLQTLWFRGFSSNLFQEPVTFEDVAVYFTQIEWTSLHPTQRALYREVMLENYANVTSLSAFPFPKPDLIFQLEQGEAAWGP

SEQ ID NO: 8621 - protein, 81 aa, Aotus trivirgatus
VLQTLWFRGFSSNLFQEPVTFEDVAVYFTQIEWTSLHPTQRALYREVMLENYANVTSLYLIAGFPLGTERTEKVPGALPSF

SEQ ID NO: 8622 - protein, 81 aa, Aotus trivirgatus
KENPEDISGWGLPEARSKESVSFKDVAVDFTQEEWGQLDSPQRALYWDVMLENYQNLLALGPPLHKPDVISHLERGEEPWC

SEQ ID NO: 8623 - protein, 81 aa, Aotus trivirgatus
KENPEDISGWGLPEARSKESVSFKDVAVDFTQEEWGQLDSPQRALYWDVMLENYQNLLALEWEMKEVPSQQQGMCKEEPAQ

SEQ ID NO: 8624 - protein, 81 aa, Aotus trivirgatus
VSVSFEDVTVDFSREEWQQLDSTQRRLYQDVMLENYSHLLSVGFEIPKPEVIFKLEQGEGPWTLEGETPHHSCSDGKFGIK

SEQ ID NO: 8625 - protein, 81 aa, Aotus trivirgatus
DDNSSAKKPGDDEQILEDKCEDFDDIAQYFSKNEWEKLKYSEKSTYAYIKENYESLRRLGFHIPLPFFMHSKWTENFWEDD

SEQ ID NO: 8626 - protein, 81 aa, Aotus trivirgatus
EQTQAAGMLAGWLIDSYQDSVTFDDVAVDFTQEEWTLLDPSQRDLYRDVMLENYENLASVEWRLKSKGSALQQDRAWFRAS

SEQ ID NO: 8627 - protein, 81 aa, Aotus trivirgatus
EQTQAAGMLAGWLIDSYQDSVTFDDVAVDFTQEEWTLLDPSQRDLYRDVMLENYENLASVGHHLFKPRVICWLEEEGQLRA

SEQ ID NO: 8628 - protein, 81 aa, Aotus trivirgatus
MLENYENLASVGHHLFKPRVICWLEEEGQLRAGQRGVLQEWRLKSKGSALQQDRAWFRASDETQMARSHNGGQLCDRMQCG

SEQ ID NO: 8629 - protein, 81 aa, Aotus trivirgatus
MAAPDLAHRGHVSKDLICLREEQTQAAGMLAGWLIDSYQDSVTFDDVAVDFTQEEWTLLDPSQRDLYRDVMLENYENLASV

SEQ ID NO: 8630 - protein, 81 aa, Aotus trivirgatus
MDVAQEQVTFQDVAIYFSWEEWECLEPSQRALYRDVMLDNFSNVAALGFCSPRPDLVSRLEQWEEPWVEDRDRPELQAVQR

SEQ ID NO: 8631 - protein, 81 aa, Aotus trivirgatus
MDVAQEQVTFQDVAIYFSWEEWECLEPSQRALYRDVMLDNFSNVAALAPDQTSSPAWNSGRSHGLKTGTDLSCRQCRGAPA

SEQ ID NO: 8632 - protein, 81 aa, Aotus trivirgatus
GESLESRVTLGSPTAESQELLTFKDVSVDFTQEEWGQLAPAHRNLYREVMLENYGNLVSVGYQLSKPGVISQLEKGEEPWL

SEQ ID NO: 8633 - protein, 81 aa, Homo sapiens; identical to SEQ ID NO: 2428

SEQ ID NO: 8634 - protein, 81 aa, Homo sapiens; identical to SEQ ID NO: 2429

SEQ ID NO: 8635 - protein, 81 aa, Homo sapiens; identical to SEQ ID NO: 2430

SEQ ID NO: 8636 - protein, 81 aa, Homo sapiens; identical to SEQ ID NO: 2431

SEQ ID NO: 8637 - protein, 81 aa, Homo sapiens; identical to SEQ ID NO: 2432

SEQ ID NO: 8638 - protein, 81 aa, Mus musculus
PSKTVTFKDVAVDLTQEEWQQMKPAQRALYRDVMLETYSNLVTVGCQVTKPDVIFKLEQAEEPWVLEEEMFWRRSPEAARG

SEQ ID NO: 8639 - protein, 81 aa, Homo sapiens; identical to SEQ ID NO: 2433

SEQ ID NO: 8640 - protein, 81 aa, Homo sapiens; identical to SEQ ID NO: 2434

SEQ ID NO: 8641 - protein, 81 aa, Homo sapiens; identical to SEQ ID NO: 2435

SEQ ID NO: 8642 - protein, 81 aa, Homo sapiens; identical to SEQ ID NO: 2436

SEQ ID NO: 8643 - protein, 81 aa, Homo sapiens; identical to SEQ ID NO: 2437

SEQ ID NO: 8644 - protein, 81 aa, Mus musculus
VCGSVTFRDVAVDFSQEEWACLDATQKVLYRNIMLETYSNLVAVVGRCIPKPDLIVLLEPEKEPWMAVKKETGRPSQGLET

SEQ ID NO: 8645 - protein, 81 aa, Homo sapiens; identical to SEQ ID NO: 2438

SEQ ID NO: 8646 - protein, 81 aa, Pongo abelii
CQESVTFEDVAVVFTDEEWSHLVPTQRDLYKEVMLENYNSIVSLGLPVPQPDVIFQLKRGDKPWMVDLHGSEEREWPESVS

SEQ ID NO: 8647 - protein, 81 aa, Homo sapiens; identical to SEQ ID NO: 2439

SEQ ID NO: 8648 - protein, 81 aa, Homo sapiens; identical to SEQ ID NO: 2440

SEQ ID NO: 8649 - protein, 81 aa, Homo sapiens; identical to SEQ ID NO: 2441

SEQ ID NO: 8650 - protein, 81 aa, Bos taurus
QAQETLTFDDVAVDFTWEEWQLLAPAQKALYRDVMLENYSNLVSAGFQASTPEVLSKLDQGEPWMMDDEIHCRTHSEVWKV

SEQ ID NO: 8651 - protein, 81 aa, Homo sapiens; identical to SEQ ID NO: 2442

SEQ ID NO: 8652 - protein, 81 aa, Homo sapiens; identical to SEQ ID NO: 2443

SEQ ID NO: 8653 - protein, 81 aa, Homo sapiens; identical to SEQ ID NO: 2444

SEQ ID NO: 8654 - protein, 81 aa, Homo sapiens; identical to SEQ ID NO: 2445

SEQ ID NO: 8655 - protein, 81 aa, Pongo abelii
QGLLTFRDVAIEFSQEEWKCLDPAQRTLYRDVMLENYRNLVSLDISSKCMMKEFLSTAQGNREVFHTGTLERHESHHIGDF

SEQ ID NO: 8656 - protein, 81 aa, Homo sapiens; identical to SEQ ID NO: 2446

SEQ ID NO: 8657 - protein, 81 aa, Canis lupus
AHGLVTFSDVAIDFSQEEWACLDSRQRDLYWDVMLENYSNLVSLDLESPYGTKSLPTEKGIYEINLSKWNSNGKSKSLGLD

SEQ ID NO: 8658 - protein, 81 aa, Homo sapiens; identical to SEQ ID NO: 2447

SEQ ID NO: 8659 - protein, 81 aa, Homo sapiens; identical to SEQ ID NO: 2448

SEQ ID NO: 8660 - protein, 81 aa, Homo sapiens; identical to SEQ ID NO: 2449

SEQ ID NO: 8661 - protein, 81 aa, Homo sapiens; identical to SEQ ID NO: 2450

SEQ ID NO: 8662 - protein, 81 aa, Mus musculus
MLETYSNLVAVVGSCISKPNLIVLLEQEKEPWMAVNEETGRPSPDLEADYDAENISPQNRIYNRKFSKQSIKQLSRTFDPK

SEQ ID NO: 8663 - protein, 81 aa, Homo sapiens; identical to SEQ ID NO: 2451

SEQ ID NO: 8664 - protein, 81 aa, Mus musculus
VKGLVSFEDVSVDFTWDEWQDLDDSQRKLYRDVMLETYSSLESLGHCITKPEVIFKLEQGAEPWRAEDVPKQSRADVQKIT

SEQ ID NO: 8665 - protein, 81 aa, Mus musculus
RTPVSYEDVAVSFTQEEWEYLTSTQKTLYQKVMSETFKNLTFVGSKKKPQEPSSDLQDKNEEQEKSSSCTGVFKGGPFFFC

SEQ ID NO: 8666 - protein, 81 aa, Rattus norvegicus
PQESVTFKDVAVNFTQEEWRHVGPAQRSLYRDVMLENYSHLVSLGYQVSKPEVIFKLEQGEEPWISERELQRPFCPDWKTR

SEQ ID NO: 8667 - protein, 81 aa, Homo sapiens; identical to SEQ ID NO: 2452

SEQ ID NO: 8668 - protein, 81 aa, Homo sapiens; identical to SEQ ID NO: 2453

SEQ ID NO: 8669 - protein, 81 aa, Homo sapiens; identical to SEQ ID NO: 2454

SEQ ID NO: 8670 - protein, 81 aa, Homo sapiens; identical to SEQ ID NO: 2455

SEQ ID NO: 8671 - protein, 81 aa, Homo sapiens; identical to SEQ ID NO: 2456

SEQ ID NO: 8672 - protein, 81 aa, Bos taurus
FREPVTFEDVALGFTPDEWGKLDLEQKSLYREVMLENYRNLVSVEHQLSKPDVVSQLEEEEELWSVERGIPQDTFSECPEA

SEQ ID NO: 8673 - protein, 81 aa, Homo sapiens; identical to SEQ ID NO: 2457

SEQ ID NO: 8674 - protein, 81 aa, Mus musculus
MVDALTYDDVYVNFTQEEWALLNPSQKSLYKDVMLETYRNLNAVGYNWEDSNIEEHCESSRRHGRHERNHTGEKPYEGIQY

SEQ ID NO: 8675 - protein, 81 aa, Homo sapiens; identical to SEQ ID NO: 2458

SEQ ID NO: 8676 - protein, 81 aa, Mus musculus
RPRALKFVDVAVYFSSEEWGCLQPAQRTLYRDVMRETYGLLGALGCAGPKPALISWLERNTDDWEPAALDPQEYRRWVTFQ

SEQ ID NO: 8677 - protein, 81 aa, Mus musculus
SQVSLTFEDVAVLFTRDEWKKLVPSQRSLYREVMLENYSNLASLGFPFTKPKVISLLQQGEDPWKVEEEGPGGFSLGLKCS

SEQ ID NO: 8678 - protein, 81 aa, Mus musculus
RGTEPVTFRDVAVSFSQDEWLHLDPAQRSLYREVMLENYSNLASLGFQASIPPVIGKLQKGQDPCMEREAPEDTCLDFEIW

SEQ ID NO: 8679 - protein, 81 aa, Rattus norvegicus
SKAPVTFGDLAIYFSQEEWEWLSPNQKDLYEDVMLENYHNLVSVGLACRRPNIIALLEKGKAPWMVEPSRKRRGPELGSKD

SEQ ID NO: 8680 - protein, 81 aa, Homo sapiens; identical to SEQ ID NO: 2459

SEQ ID NO: 8681 - protein, 81 aa, Mus musculus
GSVSFTDVTVDFTQEEWEQLDPSQRILYMDVMLENYSNLLSVEVWKADGQVERDPRDLQRQVGSLTTIKNQPPTEERGSRF

SEQ ID NO: 8682 - protein, 81 aa, Bos taurus
FQESVTFKDVIVDFTQEEWKQLDPVQRGLFRDVTLENYTHLVSIGLQVSKPDVISQLEQGTEPWIVEPSIPVGTPGDWVTR

SEQ ID NO: 8683 - protein, 81 aa, Homo sapiens; identical to SEQ ID NO: 2460

SEQ ID NO: 8684 - protein, 81 aa, Mus musculus
MVTFRDVAVVFSEEELGLLDAAQRKLYHDVMLENFRNLLAVGCQSPNKMAPLDTTGIRCLPLGQLPCWQMTSHDVNKLARA

SEQ ID NO: 8685 - protein, 81 aa, Homo sapiens; identical to SEQ ID NO: 2461

SEQ ID NO: 8686 - protein, 81 aa, Pongo abelii
TQESLTLEDVAVEFSWEEWQLLDTAQKNLYRDVMVENYNHLVSLGYQTSKPDVLSKLAHGQEPWITDAKIQNKNCPGIRKV

SEQ ID NO: 8687 - protein, 81 aa, Homo sapiens; identical to SEQ ID NO: 2462

SEQ ID NO: 8688 - protein, 81 aa, Homo sapiens; identical to SEQ ID NO: 2463

SEQ ID NO: 8689 - protein, 81 aa, Homo sapiens; identical to SEQ ID NO: 2464

SEQ ID NO: 8690 - protein, 81 aa, Homo sapiens; identical to SEQ ID NO: 2465

SEQ ID NO: 8691 - protein, 81 aa, Homo sapiens; identical to SEQ ID NO: 2466

SEQ ID NO: 8692 - protein, 81 aa, Homo sapiens; identical to SEQ ID NO: 2467

SEQ ID NO: 8693 - protein, 81 aa, Homo sapiens; identical to SEQ ID NO: 2468

SEQ ID NO: 8694 - protein, 81 aa, Mus musculus
SQGLVTIKDVSLCFSQEEWRSLDPSQTDFYGEYVMQENCGIVVSLRFPIPKLDMLSQQEGGEDQWAPDPQDVEGRDILKVT

SEQ ID NO: 8695 - protein, 81 aa, Homo sapiens; identical to SEQ ID NO: 2469

SEQ ID NO: 8696 - protein, 81 aa, Homo sapiens; identical to SEQ ID NO: 2470

SEQ ID NO: 8697 - protein, 81 aa, Pongo abelii
SYEGSVSFRDVVINFSREEWQHLDLSQRNLYRDVMLETYSHLLSVGYQVPKPEVVMLEQGKEPWALQGERPRHSCPGEKLW

SEQ ID NO: 8698 - protein, 81 aa, Homo sapiens; identical to SEQ ID NO: 2471

SEQ ID NO: 8699 - protein, 81 aa, Rattus norvegicus
LQGPVSFKDVTVDFTQEEWQRLDPAQKALYRDVMLENYCHFISVGFHITKPDMIRKLEQGEELWTERMFPSQSYLEDEEVL

SEQ ID NO: 8700 - protein, 81 aa, Homo sapiens; identical to SEQ ID NO: 2472

SEQ ID NO: 8701 - protein, 81 aa, Rattus norvegicus
SQVSVTFEDVAVLFTRDEWKKLDLSQRSLYREVMLENYSNLASMAGFLFTKPKVISLLQQGEDPWQVEKEGPRYFSLGLKC

SEQ ID NO: 8702 - protein, 81 aa, Homo sapiens; identical to SEQ ID NO: 2473

SEQ ID NO: 8703 - protein, 81 aa, Homo sapiens; identical to SEQ ID NO: 2474

SEQ ID NO: 8704 - protein, 81 aa, Homo sapiens; identical to SEQ ID NO: 2475

SEQ ID NO: 8705 - protein, 81 aa, Homo sapiens; identical to SEQ ID NO: 2476

SEQ ID NO: 8706 - protein, 81 aa, Homo sapiens; identical to SEQ ID NO: 2477

SEQ ID NO: 8707 - protein, 81 aa, Mus musculus
FRESVTFKDVVVNFTQEEWKHLDPIQRDLFRDVTLENYTHLVSIGLQVSKPDMISQLEQGTEPWTEDSCIPVGPLEDWKKR

SEQ ID NO: 8708 - protein, 81 aa, Homo sapiens; identical to SEQ ID NO: 2478

SEQ ID NO: 8709 - protein, 81 aa, Homo sapiens; identical to SEQ ID NO: 2479

SEQ ID NO: 8710 - protein, 81 aa, Mus musculus
AQGLVTFGDVAVDFSQEEWEFLDPAQKNLYRDVMWETYSNFISLDLESRFKTDTSSSDKGICEVYSLQWELIEKIKNLSPQ

SEQ ID NO: 8711 - protein, 81 aa, Homo sapiens; identical to SEQ ID NO: 2480

SEQ ID NO: 8712 - protein, 81 aa, Homo sapiens; identical to SEQ ID NO: 2481

SEQ ID NO: 8713 - protein, 81 aa, Homo sapiens; identical to SEQ ID NO: 2482

SEQ ID NO: 8714 - protein, 81 aa, Homo sapiens; identical to SEQ ID NO: 2483

SEQ ID NO: 8715 - protein, 81 aa, Homo sapiens; identical to SEQ ID NO: 2484

SEQ ID NO: 8716 - protein, 81 aa, Homo sapiens; identical to SEQ ID NO: 2485

SEQ ID NO: 8717 - protein, 81 aa, Homo sapiens; identical to SEQ ID NO: 2486

SEQ ID NO: 8718 - protein, 81 aa, Homo sapiens; identical to SEQ ID NO: 2487

SEQ ID NO: 8719 - protein, 81 aa, Homo sapiens; identical to SEQ ID NO: 2488

SEQ ID NO: 8720 - protein, 81 aa, Homo sapiens; identical to SEQ ID NO: 2489

SEQ ID NO: 8721 - protein, 81 aa, Homo sapiens; identical to SEQ ID NO: 2490

SEQ ID NO: 8722 - protein, 81 aa, Bos taurus
WSQMPVTFEDMALYLSREEWGRLDHTQQSFYREVLQKRSGLSLGFPFSRPFWASQVQGKGEAPGSSRQLGHEEEEKRGVVE

SEQ ID NO: 8723 - protein, 81 aa, Pongo abelii
LVTFRDVAIDFTQEEWECLDPAQRDLYRDVMLENYSNLISLDLESSCATKKLSPEKEIYEMESLQWENIGNLINHHLQYGL

SEQ ID NO: 8724 - protein, 81 aa, Homo sapiens; identical to SEQ ID NO: 2491

SEQ ID NO: 8725 - protein, 81 aa, Homo sapiens; identical to SEQ ID NO: 2492

SEQ ID NO: 8726 - protein, 81 aa, Homo sapiens; identical to SEQ ID NO: 2493

SEQ ID NO: 8727 - protein, 81 aa, Mus musculus
TQGLVTFEDVAVYFSLEEWERLGVDQRDLYREVMQENYGILVSLGYPIPKPDLIFHLEQGEEPWVEDGPHPEEGDVVTGVY

SEQ ID NO: 8728 - protein, 81 aa, Pongo abelii
GSVSFTDVTVDFTQEEWEQLDPSQRILYMDVMLENYSNLLSVEVWKADDQMERDHRNPDEQARQFLILKNQTPIEERGDLF

SEQ ID NO: 8729 - protein, 81 aa, Homo sapiens; identical to SEQ ID NO: 2494

SEQ ID NO: 8730 - protein, 81 aa, Homo sapiens; identical to SEQ ID NO: 2495

SEQ ID NO: 8731 - protein, 81 aa, Homo sapiens; identical to SEQ ID NO: 2496

SEQ ID NO: 8732 - protein, 81 aa, Mus musculus
FETLKDLAMDFTVEDWKDLESEWDQRDLFWDVTLNHYQDMFSFTDTSQPSLTSQPDVREELEATSTEVPETKSSPLQSGFV

SEQ ID NO: 8733 - protein, 81 aa, Homo sapiens; identical to SEQ ID NO: 2497

SEQ ID NO: 8734 - protein, 81 aa, Homo sapiens; identical to SEQ ID NO: 2498

SEQ ID NO: 8735 - protein, 81 aa, Homo sapiens; identical to SEQ ID NO: 2499

SEQ ID NO: 8736 - protein, 81 aa, Homo sapiens; identical to SEQ ID NO: 2500

SEQ ID NO: 8737 - protein, 81 aa, Mus musculus
SKNLLTFEDVSVNFTQEEWQWLSDTQRDLYRKVTLENYKSLVSLGIPVYKPAVISLLEQGKDPWMVQKKGARDTCPDWQYV

SEQ ID NO: 8738 - protein, 81 aa, Homo sapiens; identical to SEQ ID NO: 2501

SEQ ID NO: 8739 - protein, 81 aa, Homo sapiens; identical to SEQ ID NO: 2502

SEQ ID NO: 8740 - protein, 81 aa, Homo sapiens; identical to SEQ ID NO: 2503

SEQ ID NO: 8741 - protein, 81 aa, Homo sapiens; identical to SEQ ID NO: 2504

SEQ ID NO: 8742 - protein, 81 aa, Homo sapiens; identical to SEQ ID NO: 2505

SEQ ID NO: 8743 - protein, 81 aa, Homo sapiens; identical to SEQ ID NO: 2506

SEQ ID NO: 8744 - protein, 81 aa, Rattus norvegicus
RGTEPVTFRDVAVSFSQDEWLHLDPAQRTLYREVMLENYSNLASLGFQASIPPVIGKLQKGQDPCMEREAPEDTCLDFQIQ

SEQ ID NO: 8745 - protein, 81 aa, Pongo abelii
MAAPTREEWRHLDPSQRNLYRDVMLETYSHLLSVGYQVPEAEVVMLEQGKEPWALQGERPRQSCPGKKLWDHNQCRKILSY

SEQ ID NO: 8746 - protein, 81 aa, Homo sapiens; identical to SEQ ID NO: 2507

SEQ ID NO: 8747 - protein, 81 aa, Mus musculus
ATGSHDEATPGTPAAGSHDGETPGIPAAGSHDGETPGTPTAGSHDGVTPGTTAAGSQESLTFKDIAVDLSQEEWGQLAPAY

SEQ ID NO: 8748 - protein, 81 aa, Mus musculus
MATSEPAESDAVRAKEWEQLEPVQRDVYKDTKLENCSNPASMGNQDPKQDIVSVLEEEEPSSGKGKKASPSSLKKIARPKT

SEQ ID NO: 8749 - protein, 81 aa, Homo sapiens; identical to SEQ ID NO: 2508

SEQ ID NO: 8750 - protein, 81 aa, Homo sapiens; identical to SEQ ID NO: 2509

SEQ ID NO: 8751 - protein, 81 aa, Homo sapiens; identical to SEQ ID NO: 2510

SEQ ID NO: 8752 - protein, 81 aa, Homo sapiens; identical to SEQ ID NO: 2511

SEQ ID NO: 8753 - protein, 81 aa, Mus musculus
GCVTFQDVAICFSHEEWRLLDETQRLLYLSVMLQNFALINSQGCGHKTEDEERRVSTRASKGLRSETTPKTNLCEKCVPIL

SEQ ID NO: 8754 - protein, 81 aa, Homo sapiens; identical to SEQ ID NO: 2512

SEQ ID NO: 8755 - protein, 81 aa, Bos taurus
FSQEEWQHLDPAQKTLYMDVMLENYCHLISVGCHMTKPDVILKLERGEEPWTSFKGHTCLEENWKAEDFLLKFKEQQDKYS

SEQ ID NO: 8756 - protein, 81 aa, Homo sapiens; identical to SEQ ID NO: 2513

SEQ ID NO: 8757 - protein, 81 aa, Homo sapiens; identical to SEQ ID NO: 2514

SEQ ID NO: 8758 - protein, 81 aa, Homo sapiens; identical to SEQ ID NO: 2515

SEQ ID NO: 8759 - protein, 81 aa, Homo sapiens; identical to SEQ ID NO: 2516

SEQ ID NO: 8760 - protein, 81 aa, Homo sapiens; identical to SEQ ID NO: 2517

SEQ ID NO: 8761 - protein, 81 aa, Homo sapiens; identical to SEQ ID NO: 2518

SEQ ID NO: 8762 - protein, 81 aa, Homo sapiens; identical to SEQ ID NO: 2519

SEQ ID NO: 8763 - protein, 81 aa, Homo sapiens; identical to SEQ ID NO: 2520

SEQ ID NO: 8764 - protein, 81 aa, Homo sapiens; identical to SEQ ID NO: 2521

SEQ ID NO: 8765 - protein, 81 aa, Homo sapiens; identical to SEQ ID NO: 2522

SEQ ID NO: 8766 - protein, 81 aa, Homo sapiens; identical to SEQ ID NO: 2523

SEQ ID NO: 8767 - protein, 81 aa, Homo sapiens; identical to SEQ ID NO: 2524

SEQ ID NO: 8768 - protein, 81 aa, Homo sapiens; identical to SEQ ID NO: 2525

SEQ ID NO: 8769 - protein, 81 aa, Homo sapiens; identical to SEQ ID NO: 2526

SEQ ID NO: 8770 - protein, 81 aa, Homo sapiens; identical to SEQ ID NO: 2527

SEQ ID NO: 8771 - protein, 81 aa, Homo sapiens; identical to SEQ ID NO: 2528

SEQ ID NO: 8772 - protein, 81 aa, Mus musculus
SEGLVTFKDVAIDFTQEEWKQLDPTQRNLYRNVMLENYNNLITVGPPLTKPEVIFKLEQEEEPCVVEREVLWRPCPGEILG

SEQ ID NO: 8773 - protein, 81 aa, Homo sapiens; identical to SEQ ID NO: 2529

SEQ ID NO: 8774 - protein, 81 aa, Homo sapiens; identical to SEQ ID NO: 2530

SEQ ID NO: 8775 - protein, 81 aa, Homo sapiens; identical to SEQ ID NO: 2531

SEQ ID NO: 8776 - protein, 81 aa, Homo sapiens; identical to SEQ ID NO: 2532

SEQ ID NO: 8777 - protein, 81 aa, Mus musculus
SQMPVTFEDVALYLSQEEWGRLDHTQQNFYRDVLQGKNGLALGAVEMGKVVPALAVATLEDTKSIRTRARWAPGEDPKCGQ

SEQ ID NO: 8778 - protein, 81 aa, Homo sapiens; identical to SEQ ID NO: 2533

SEQ ID NO: 8779 - protein, 81 aa, Bos taurus
MFQVTFSDVAIDFSHEEWRWLNSTQRNLYKDVMVQNYENLVSLGLSIPKPYVIALLEDGKEPCMVEEKLSKDTFPDCKTRW

SEQ ID NO: 8780 - protein, 81 aa, Homo sapiens; identical to SEQ ID NO: 2534

SEQ ID NO: 8781 - protein, 81 aa, Bos taurus
FQEAVTFKDVAVVFTEEELGLLDSAQRKLYQDVMVENFRNLVSVGHVPFKADMVSQLETEEKLWTMERETQRNGHSSEIHS

SEQ ID NO: 8782 - protein, 81 aa, Homo sapiens; identical to SEQ ID NO: 2535

SEQ ID NO: 8783 - protein, 81 aa, Homo sapiens; identical to SEQ ID NO: 2536

SEQ ID NO: 8784 - protein, 81 aa, Homo sapiens; identical to SEQ ID NO: 2537

SEQ ID NO: 8785 - protein, 81 aa, Homo sapiens; identical to SEQ ID NO: 2538

SEQ ID NO: 8786 - protein, 81 aa, Homo sapiens; identical to SEQ ID NO: 2539

SEQ ID NO: 8787 - protein, 81 aa, Homo sapiens; identical to SEQ ID NO: 2540

SEQ ID NO: 8788 - protein, 81 aa, Homo sapiens; identical to SEQ ID NO: 2541

SEQ ID NO: 8789 - protein, 81 aa, Homo sapiens; identical to SEQ ID NO: 2542

SEQ ID NO: 8790 - protein, 81 aa, Homo sapiens; identical to SEQ ID NO: 2543

SEQ ID NO: 8791 - protein, 81 aa, Homo sapiens; identical to SEQ ID NO: 2544

SEQ ID NO: 8792 - protein, 81 aa, Rattus norvegicus
PHESVKFEDVSLTFTKEEWAQLDLQQKCLYREIMMENYNNMISVEHHFSKPNVISQLEEAEDCWPMEREIRQDILPECSGP

SEQ ID NO: 8793 - protein, 81 aa, Mus musculus
PHESVKFEDVSLRFTEEEWALLDRQQKCLYREIMMENLNNMISVEHHFSKANVMPQLEEVEDCWPMQREIPQDTLPECSGH

SEQ ID NO: 8794 - protein, 81 aa, Mus musculus
AWVPALFDEVAIYFSDEEWEVLTEQQKALYREVMRMNYETVLSLEFPFPKPDMINRLERDEECPNSDEWRLQGVTFAENEE

SEQ ID NO: 8795 - protein, 81 aa, Homo sapiens; identical to SEQ ID NO: 2545

SEQ ID NO: 8796 - protein, 81 aa, Rattus norvegicus
RPRALKFADVAVYFSSEEWGRLRPAQRTLYRDVMRETYGLLGALGCAGPKPALITWLERNTDDWEPAALDPQEYRRWVTFQ

SEQ ID NO: 8797 - protein, 81 aa, Homo sapiens; identical to SEQ ID NO: 2546

SEQ ID NO: 8798 - protein, 81 aa, Homo sapiens; identical to SEQ ID NO: 2547

SEQ ID NO: 8799 - protein, 81 aa, Mus musculus
MGLVSFEDVAVDFTLEEWQDLDAAQRTLYRDVMLETYSSLVFLDPCIAKPKLIFNLERGFGPWSLAEASSRSLPGVHNVST

SEQ ID NO: 8800 - protein, 81 aa, Homo sapiens; identical to SEQ ID NO: 2548

SEQ ID NO: 8801 - protein, 81 aa, Homo sapiens; identical to SEQ ID NO: 2549

SEQ ID NO: 8802 - protein, 81 aa, Homo sapiens; identical to SEQ ID NO: 2550

SEQ ID NO: 8803 - protein, 81 aa, Homo sapiens; identical to SEQ ID NO: 2551

SEQ ID NO: 8804 - protein, 81 aa, Homo sapiens; identical to SEQ ID NO: 2552

SEQ ID NO: 8805 - protein, 81 aa, Pan troglodytes
AQESVMFSDVSVDFSQEEWECLNDDQRDLYRDVMLENYSNLVSMGHSISKPNVISYLEQGKEPWLVDRELTRGQWPVLESR

SEQ ID NO: 8806 - protein, 81 aa, Mus musculus
LGLDVSFEDVAIHFSQEEWVLLDKAQRLLYCSVMLENLALVASLGSCTGMGDEDVTCEPAEEVVCNTSPSPQETHLLEIPV

SEQ ID NO: 8807 - protein, 81 aa, Homo sapiens; identical to SEQ ID NO: 2553

SEQ ID NO: 8808 - protein, 81 aa, Homo sapiens; identical to SEQ ID NO: 2554

SEQ ID NO: 8809 - protein, 81 aa, Homo sapiens; identical to SEQ ID NO: 2555

SEQ ID NO: 8810 - protein, 81 aa, Bos taurus
HQEVVTFEDVAVYFTRTEWAGLSPAQRALYRSVMLEIYRSLTSLGYPVPKPALISLLERGDLPVGLETQDNPPAQGTRDIY

SEQ ID NO: 8811 - protein, 81 aa, Mus musculus
AHSTVMFRDVAVGFSQEEWECLSAYERDLYRDVMLENYSHLVSLAGCSISKPDVITLLEQGKEPWMIVRAEKRRWSRDLES

SEQ ID NO: 8812 - protein, 81 aa, Homo sapiens; identical to SEQ ID NO: 2556

SEQ ID NO: 8813 - protein, 81 aa, Homo sapiens; identical to SEQ ID NO: 2557

SEQ ID NO: 8814 - protein, 81 aa, Homo sapiens; identical to SEQ ID NO: 2558

SEQ ID NO: 8815 - protein, 81 aa, Homo sapiens; identical to SEQ ID NO: 2559

SEQ ID NO: 8816 - protein, 81 aa, Homo sapiens; identical to SEQ ID NO: 2560

SEQ ID NO: 8817 - protein, 81 aa, Homo sapiens; identical to SEQ ID NO: 2561

SEQ ID NO: 8818 - protein, 81 aa, Macaca fascicularis
ARDLVMFRDVAIDFSQEEWECLNSYQRNLYRDVILENYSNLVSLAGCSISKPDVITLLEQGKEPWMVMRDEKRRWTLDLES

SEQ ID NO: 8819 - protein, 81 aa, Homo sapiens; identical to SEQ ID NO: 2562

SEQ ID NO: 8820 - protein, 81 aa, Homo sapiens; identical to SEQ ID NO: 2563

SEQ ID NO: 8821 - protein, 81 aa, Homo sapiens; identical to SEQ ID NO: 2564

SEQ ID NO: 8822 - protein, 81 aa, Homo sapiens; identical to SEQ ID NO: 2565

SEQ ID NO: 8823 - protein, 81 aa, Homo sapiens; identical to SEQ ID NO: 2566

SEQ ID NO: 8824 - protein, 81 aa, Pongo abelii
FQRPVSFQDLTVNFTQEEWQQLDPTQRLLYRDVMLENYSNLVSVGYHVSKPDVIFKLEQGEAPWIVEEFSNQNYPEVDDAL

SEQ ID NO: 8825 - protein, 81 aa, Homo sapiens; identical to SEQ ID NO: 2567

SEQ ID NO: 8826 - protein, 81 aa, Homo sapiens; identical to SEQ ID NO: 2568

SEQ ID NO: 8827 - protein, 81 aa, Homo sapiens; identical to SEQ ID NO: 2569

SEQ ID NO: 8828 - protein, 81 aa, Homo sapiens; identical to SEQ ID NO: 2570

SEQ ID NO: 8829 - protein, 81 aa, Homo sapiens; identical to SEQ ID NO: 2571

SEQ ID NO: 8830 - protein, 81 aa, Homo sapiens; identical to SEQ ID NO: 2572

SEQ ID NO: 8831 - protein, 81 aa, Homo sapiens; identical to SEQ ID NO: 2573

SEQ ID NO: 8832 - protein, 81 aa, Mus musculus
VQEPVTFRDVAVSFSQDEWLHLDPAQRTLYREVMLENYSNLVSLGILFSKPKVIAQLEQAEDFPMVESGMFQGVYLGWKSL

SEQ ID NO: 8833 - protein, 81 aa, Homo sapiens; identical to SEQ ID NO: 2574

SEQ ID NO: 8834 - protein, 81 aa, Homo sapiens; identical to SEQ ID NO: 2575

SEQ ID NO: 8835 - protein, 81 aa, Homo sapiens; identical to SEQ ID NO: 2576

SEQ ID NO: 8836 - protein, 81 aa, Pongo abelii
AQGLVTFADVAIDFSQEEWACLNSAQRDLYWDVMLENYSNLVSLDLESAYENKSLPTEKNIHEIRASKRNSDRRSKSLGRN

SEQ ID NO: 8837 - protein, 81 aa, Homo sapiens; identical to SEQ ID NO: 2577

SEQ ID NO: 8838 - protein, 81 aa, Bos taurus
DPDQVTFEDVVVDFTQEEWGHLEPAQRTLYRDVMLETFGLLVSVGHWLPKPDVISLLEQEAELWAADKGGPRGVCPDLETR

SEQ ID NO: 8839 - protein, 81 aa, Mus musculus
ARVSVVFSDVSIAFSQEEWESLDLEQRNLYKDVMMENYHNVASLGCFISKPDVISLLEQGKEPWKVVRQRKPCPDSETKDE

SEQ ID NO: 8840 - protein, 81 aa, Bos taurus
QDPVTFEDVAVVFTDEEWRRLVPTQRDLYKEVMLENYKSIVSLGLPVPGPDVIFQLKRGDEPWLVEFHGFEGKEGAENVSL

SEQ ID NO: 8841 - protein, 81 aa, Mus musculus
NFWILRLPPGSKGEVPKEWGKLEDWQKELYKHVMRGNYETLVSLDYAISKPEVLSQIEQGKEPCTWRRTGPKVPEVPVDPS

SEQ ID NO: 8842 - protein, 81 aa, Homo sapiens; identical to SEQ ID NO: 2578

SEQ ID NO: 8843 - protein, 81 aa, Homo sapiens; identical to SEQ ID NO: 2579

SEQ ID NO: 8844 - protein, 81 aa, Xenopus laevis
MEEPKCLQREMYKSVMTENYQCVLSLGYPIRKPEIVSMMEVGEELWSKNDSARPGQKEVEGETPKESDWAAENCKRAQMHK

SEQ ID NO: 8845 - protein, 81 aa, Homo sapiens; identical to SEQ ID NO: 2580

SEQ ID NO: 8846 - protein, 81 aa, Homo sapiens; identical to SEQ ID NO: 2581

SEQ ID NO: 8847 - protein, 81 aa, Homo sapiens; identical to SEQ ID NO: 2582

SEQ ID NO: 8848 - protein, 81 aa, Homo sapiens; identical to SEQ ID NO: 2583

SEQ ID NO: 8849 - protein, 81 aa, Homo sapiens; identical to SEQ ID NO: 2584

SEQ ID NO: 8850 - protein, 81 aa, Homo sapiens; identical to SEQ ID NO: 2585

SEQ ID NO: 8851 - protein, 81 aa, Homo sapiens; identical to SEQ ID NO: 2586

SEQ ID NO: 8852 - protein, 81 aa, Homo sapiens; identical to SEQ ID NO: 2587

SEQ ID NO: 8853 - protein, 81 aa, Homo sapiens; identical to SEQ ID NO: 2588

SEQ ID NO: 8854 - protein, 81 aa, Homo sapiens; identical to SEQ ID NO: 2589

SEQ ID NO: 8855 - protein, 81 aa, Mus musculus
MLSFWDVAIDFSPEERECLEPDQWDLYRDVMLENYSHLDFLGLALSKPFLVTFLEQRQGPWDVKRQAAAAVHPGKTVNKCK

SEQ ID NO: 8856 - protein, 81 aa, Mus musculus
QVDAVTFEDVAVDFTQEEWTSLDPVQRNLYRDVMLENYQNLATVGGQMFKPSLISWLEKKVELTVIEQGILQEWEMHLKTK

SEQ ID NO: 8857 - protein, 81 aa, Mus musculus
SLGPLSFKDVAVAFSQEEWQQLDPEERTTYRDVMLETYSNLVSVGYDIIKPDVIIKLEQGEEPWIVEGAFSPQSYPDEIRH

SEQ ID NO: 8858 - protein, 81 aa, Homo sapiens; identical to SEQ ID NO: 2590

SEQ ID NO: 8859 - protein, 81 aa, Homo sapiens; identical to SEQ ID NO: 2591

SEQ ID NO: 8860 - protein, 81 aa, Homo sapiens; identical to SEQ ID NO: 2592

SEQ ID NO: 8861 - protein, 81 aa, Homo sapiens; identical to SEQ ID NO: 2593

SEQ ID NO: 8862 - protein, 81 aa, Macaca fascicularis
FQESVTFQDVAVDFTAEEWQLLDCTERTLYWDVMLENYRNLISVGCPINKTKVILKVEQGQEPWMVEGVNLHQSSPESDCP

SEQ ID NO: 8863 - protein, 81 aa, Homo sapiens; identical to SEQ ID NO: 2594

SEQ ID NO: 8864 - protein, 81 aa, Homo sapiens; identical to SEQ ID NO: 2595

SEQ ID NO: 8865 - protein, 81 aa, Homo sapiens; identical to SEQ ID NO: 2596

SEQ ID NO: 8866 - protein, 81 aa, Homo sapiens; identical to SEQ ID NO: 2597

SEQ ID NO: 8867 - protein, 81 aa, Homo sapiens; identical to SEQ ID NO: 2598

SEQ ID NO: 8868 - protein, 81 aa, Homo sapiens; identical to SEQ ID NO: 2599

SEQ ID NO: 8869 - protein, 81 aa, Homo sapiens; identical to SEQ ID NO: 2600

SEQ ID NO: 8870 - protein, 81 aa, Homo sapiens; identical to SEQ ID NO: 2601

SEQ ID NO: 8871 - protein, 81 aa, Homo sapiens; identical to SEQ ID NO: 2602

SEQ ID NO: 8872 - protein, 81 aa, Homo sapiens; identical to SEQ ID NO: 2603

SEQ ID NO: 8873 - protein, 81 aa, Homo sapiens; identical to SEQ ID NO: 2604

SEQ ID NO: 8874 - protein, 81 aa, Homo sapiens; identical to SEQ ID NO: 2605

SEQ ID NO: 8875 - protein, 81 aa, Chlorocebus aethiops
TFKEAMTFKDVAVVFTEEELGLLDLAQRKLYRDVMLENFRNLLSVGHQAFHRDTFHFLREEKIWMMKTAIQREGNSGDKIQ

SEQ ID NO: 8876 - protein, 81 aa, Homo sapiens; identical to SEQ ID NO: 2606

SEQ ID NO: 8877 - protein, 81 aa, Homo sapiens; identical to SEQ ID NO: 2607

SEQ ID NO: 8878 - protein, 81 aa, Homo sapiens; identical to SEQ ID NO: 2608

SEQ ID NO: 8879 - protein, 81 aa, Homo sapiens; identical to SEQ ID NO: 2609

SEQ ID NO: 8880 - protein, 81 aa, Bos taurus
NFWILRLPPGSKGEAPKEWGKLDEWQKELYKHVMRGNYETLVSLDYAISKPEVLSQIEQGKEPCSWRRAGPKVPDVPVDPS

SEQ ID NO: 8881 - protein, 81 aa, Homo sapiens; identical to SEQ ID NO: 2610

SEQ ID NO: 8882 - protein, 81 aa, Bos taurus
QAEVTFEDVAVFLSQEEWGLLGPAQKGLYREVMLETYRNLVSLGAGLAGPKPEVIAQLEQGDELWVLDMHGAEQPSVDGSA

SEQ ID NO: 8883 - protein, 81 aa, Homo sapiens; identical to SEQ ID NO: 2611

SEQ ID NO: 8884 - protein, 81 aa, Pongo abelii
TGEDVTFSDVAIDFSHEEWGWLNSAQRDLYKDVMVQNYENLVSVAGLSVTKPHVITLLEDGKEPWMMEKKLSKGLIPDWES

SEQ ID NO: 8885 - protein, 81 aa, Homo sapiens; identical to SEQ ID NO: 2612

SEQ ID NO: 8886 - protein, 81 aa, Homo sapiens; identical to SEQ ID NO: 2613

SEQ ID NO: 8887 - protein, 81 aa, Homo sapiens; identical to SEQ ID NO: 2614

SEQ ID NO: 8888 - protein, 81 aa, Pongo abelii
AHALVTFRDVTIDFSQKEWECLDTTQRKLYRDVMLENYNNLVSLGYSGSKPDVITLLEQGKEPCVAARDVTGRQYPGLLSR

SEQ ID NO: 8889 - protein, 81 aa, Mus musculus
DQELVSFEDVIVDFTQEEWSSLNPDQRNLYRDVMLENYQNLATVGYQLIKPSLISWLEQEEFSKGQKIVFPEWKLQLETKC

SEQ ID NO: 8890 - protein, 81 aa, Homo sapiens; identical to SEQ ID NO: 2615

SEQ ID NO: 8891 - protein, 81 aa, Mus musculus
SQGLVTFGDVAVVFSQEEWEWLNSEQRSLYWKVMLDNYRNLASLGLCASQPDMITSLEQGRDPWMMKRKMRKGQHLDLKAM

SEQ ID NO: 8892 - protein, 81 aa, Homo sapiens; identical to SEQ ID NO: 2616

SEQ ID NO: 8893 - protein, 81 aa, Homo sapiens; identical to SEQ ID NO: 2617

SEQ ID NO: 8894 - protein, 81 aa, Homo sapiens; identical to SEQ ID NO: 2618

SEQ ID NO: 8895 - protein, 81 aa, Mus musculus
LQEPVTFRDVAVDFTQEEWGQLDPTQRTLYRDVMLETFGHLLSVGPDLPKPAVISQLEQGAELWVADRGGTGACHPGWILE

SEQ ID NO: 8896 - protein, 81 aa, Homo sapiens; identical to SEQ ID NO: 2619

SEQ ID NO: 8897 - protein, 81 aa, Homo sapiens; identical to SEQ ID NO: 2620

SEQ ID NO: 8898 - protein, 81 aa, Homo sapiens; identical to SEQ ID NO: 2621

SEQ ID NO: 8899 - protein, 81 aa, Mus musculus
PQAKVTFEDVAVLLSQEEWARLGPAQRGLYRHVMMETYGNVVSLGLPGSKPVVISQLERGEDPWVLDGQGTELSQSLGSDH

SEQ ID NO: 8900 - protein, 81 aa, Pongo abelii
KSQEQVSFKDVCVDFTQEEWYLLDPAQKILYRDVILENYSNLVSVGYCITKPEVIFKIEQGEEPWILEKGFPSQDPERKWK

SEQ ID NO: 8901 - protein, 81 aa, Homo sapiens; identical to SEQ ID NO: 2622

SEQ ID NO: 8902 - protein, 81 aa, Homo sapiens; identical to SEQ ID NO: 2623

SEQ ID NO: 8903 - protein, 81 aa, Mus musculus
SKAPVTFGDLAIYFSQEEWEWLSPMQKDLYEDVMLENYHNLVSVGLACRRPNIIALLEKGKAPWVIEPSRRRWGPESGSKY

SEQ ID NO: 8904 - protein, 81 aa, Homo sapiens; identical to SEQ ID NO: 2624

SEQ ID NO: 8905 - protein, 81 aa, Homo sapiens; identical to SEQ ID NO: 2625

SEQ ID NO: 8906 - protein, 81 aa, Homo sapiens; identical to SEQ ID NO: 2626

SEQ ID NO: 8907 - protein, 81 aa, Homo sapiens; identical to SEQ ID NO: 2627

SEQ ID NO: 8908 - protein, 81 aa, Pongo abelii
RQEPVTFEDVAVYFTQNEWASLDSVQRALYREVMLENYANVASLAFPFTTPVLVSQLEQGELPWGLDPWEPMGREALRGIC

SEQ ID NO: 8909 - protein, 81 aa, Mus musculus
SKGPLSFKDVAVAFSQEEWQQLDPEERTTYRDVMLETYSNLVSVGYDVTKPNMIIKLEQGEEPWTVEGDRHAQRHLEISKV

SEQ ID NO: 8910 - protein, 81 aa, Homo sapiens; identical to SEQ ID NO: 2628

SEQ ID NO: 8911 - protein, 81 aa, Homo sapiens; identical to SEQ ID NO: 2629

SEQ ID NO: 8912 - protein, 81 aa, Homo sapiens; identical to SEQ ID NO: 2630

SEQ ID NO: 8913 - protein, 81 aa, Mus musculus
LQEMVTFRDVAVVFSEEELGLLDAAQWKLYREVMLENFRMLLSVAHQPFKPGLIAQLENGEQLWMVEAEAHAGGLSGRRNG

SEQ ID NO: 8914 - protein, 81 aa, Homo sapiens; identical to SEQ ID NO: 2631

SEQ ID NO: 8915 - protein, 81 aa, Homo sapiens; identical to SEQ ID NO: 2632

SEQ ID NO: 8916 - protein, 81 aa, Homo sapiens; identical to SEQ ID NO: 2633

SEQ ID NO: 8917 - protein, 81 aa, Homo sapiens; identical to SEQ ID NO: 2634

SEQ ID NO: 8918 - protein, 81 aa, Homo sapiens; identical to SEQ ID NO: 2635

SEQ ID NO: 8919 - protein, 81 aa, Homo sapiens; identical to SEQ ID NO: 2636

SEQ ID NO: 8920 - protein, 81 aa, Homo sapiens; identical to SEQ ID NO: 2637

SEQ ID NO: 8921 - protein, 81 aa, Homo sapiens; identical to SEQ ID NO: 2638

SEQ ID NO: 8922 - protein, 81 aa, Homo sapiens; identical to SEQ ID NO: 2639

SEQ ID NO: 8923 - protein, 81 aa, Homo sapiens; identical to SEQ ID NO: 2640

SEQ ID NO: 8924 - protein, 81 aa, Homo sapiens; identical to SEQ ID NO: 2641

SEQ ID NO: 8925 - protein, 81 aa, Homo sapiens; identical to SEQ ID NO: 2642

SEQ ID NO: 8926 - protein, 81 aa, Homo sapiens; identical to SEQ ID NO: 2643

SEQ ID NO: 8927 - protein, 81 aa, Mus musculus
CQALVTFEDVAVTFTDDEWKRLVPVQRALYKAVMLENYESIISLGLPVPRPDVILQFKRRGEPWIRGFHGSEEKTWPESVS

SEQ ID NO: 8928 - protein, 81 aa, Homo sapiens; identical to SEQ ID NO: 2644

SEQ ID NO: 8929 - protein, 81 aa, Homo sapiens; identical to SEQ ID NO: 2645

SEQ ID NO: 8930 - protein, 81 aa, Homo sapiens; identical to SEQ ID NO: 2646

SEQ ID NO: 8931 - protein, 81 aa, Canis lupus
SQVLVSFEDVAVLLSREEWGRLGPAQRGLYSDVMLETYRNLISLGLQGSKPDVISRLEKGEEPWAPYSAKIEESWIRSHES

SEQ ID NO: 8932 - protein, 81 aa, Homo sapiens; identical to SEQ ID NO: 2647

SEQ ID NO: 8933 - protein, 81 aa, Homo sapiens; identical to SEQ ID NO: 2648

SEQ ID NO: 8934 - protein, 81 aa, Homo sapiens; identical to SEQ ID NO: 2649

SEQ ID NO: 8935 - protein, 81 aa, Homo sapiens; identical to SEQ ID NO: 2650

SEQ ID NO: 8936 - protein, 81 aa, Homo sapiens; identical to SEQ ID NO: 2651

SEQ ID NO: 8937 - protein, 81 aa, Homo sapiens; identical to SEQ ID NO: 2652

SEQ ID NO: 8938 - protein, 81 aa, Macaca fascicularis
DDVALYFSGQEWEILEKWQKQMYKQEMKTNYQTLDSLGYAFSKPDLITWMEQGRMLFISEQGCLDKTRRTTSPPTDEQLDM

SEQ ID NO: 8939 - protein, 81 aa, Homo sapiens; identical to SEQ ID NO: 2653

SEQ ID NO: 8940 - protein, 81 aa, Homo sapiens; identical to SEQ ID NO: 2654

SEQ ID NO: 8941 - protein, 81 aa, Mus musculus
MEDMLSFWDVAIYFSAEEWECLGPAQWKLYRDVMLENYSNLVFLGLASSKPYLVTFLEQIQEPSDVKRQAAITVHPGGKCY

SEQ ID NO: 8942 - protein, 81 aa, Homo sapiens; identical to SEQ ID NO: 2655

SEQ ID NO: 8943 - protein, 81 aa, Homo sapiens; identical to SEQ ID NO: 2656

SEQ ID NO: 8944 - protein, 81 aa, Mus musculus
ARFPLTFEDVAIYFSEQEWQHLEAWQKELYKQVMRTNYETLISLDNGLPKPELISWIELGRELFGSWGEKKKPDKETHCSI

SEQ ID NO: 8945 - protein, 81 aa, Macaca fascicularis
SCEPVNFEDVTLGFTPEEWGLLDLKQKSLYREVMLENYRNLVSVEHQLSKPDVVSQLEEAEDFWPVERGIPQDTIPEYSEL

SEQ ID NO: 8946 - protein, 81 aa, Homo sapiens; identical to SEQ ID NO: 2657

SEQ ID NO: 8947 - protein, 81 aa, Homo sapiens; identical to SEQ ID NO: 2658

SEQ ID NO: 8948 - protein, 81 aa, Rattus norvegicus
MATPEPAESDAEWEQLEPGQRNLYKDTKLETCSNPASMGNQDPKQGLVSKLDGEEERWSSVRANKNSSSSLHRLKKTGTSA

SEQ ID NO: 8949 - protein, 81 aa, Mus musculus
PKVTVSFEDVSVYFTKTEWRLLDLKQRTLYKQVMLENYSHLVSVGFAFSKPNLVSQLERGEKPWIRDDGMESAARSCAGNR

SEQ ID NO: 8950 - protein, 81 aa, Homo sapiens; identical to SEQ ID NO: 2659

SEQ ID NO: 8951 - protein, 81 aa, Homo sapiens; identical to SEQ ID NO: 2660

SEQ ID NO: 8952 - protein, 81 aa, Homo sapiens; identical to SEQ ID NO: 2661

SEQ ID NO: 8953 - protein, 81 aa, Homo sapiens; identical to SEQ ID NO: 2662

SEQ ID NO: 8954 - protein, 81 aa, Homo sapiens; identical to SEQ ID NO: 2663

SEQ ID NO: 8955 - protein, 81 aa, Homo sapiens; identical to SEQ ID NO: 2664

SEQ ID NO: 8956 - protein, 81 aa, Homo sapiens; identical to SEQ ID NO: 2665

SEQ ID NO: 8957 - protein, 81 aa, Homo sapiens; identical to SEQ ID NO: 2666

SEQ ID NO: 8958 - protein, 81 aa, Homo sapiens; identical to SEQ ID NO: 2667

SEQ ID NO: 8959 - protein, 81 aa, Homo sapiens; identical to SEQ ID NO: 2668

SEQ ID NO: 8960 - protein, 81 aa, Homo sapiens; identical to SEQ ID NO: 2669

SEQ ID NO: 8961 - protein, 81 aa, Homo sapiens; identical to SEQ ID NO: 2670

SEQ ID NO: 8962 - protein, 81 aa, Homo sapiens; identical to SEQ ID NO: 2671

SEQ ID NO: 8963 - protein, 81 aa, Macaca fascicularis
AEGSVMFSDVSIDFSQEEWDCLDPVQRDLYRDVMLENYSNLVSMGLYTPKPQVISLLEQGKEPWMVGRELTRGLCSDLESM

SEQ ID NO: 8964 - protein, 81 aa, Mus musculus
SQVSVTFEDVAVLFTRDEWKKLVPSQRSLYREVMLENYSNLASLGFPFTKPKMISVLQQGEEPWKSEKESHGCSPLGCHGS

SEQ ID NO: 8965 - protein, 81 aa, Homo sapiens; identical to SEQ ID NO: 2672

SEQ ID NO: 8966 - protein, 81 aa, Homo sapiens; identical to SEQ ID NO: 2673

SEQ ID NO: 8967 - protein, 81 aa, Pongo abelii
MVTFEDVAVHFTKTEWTGLSPAQRALYRSVMLENFGNLTALGYPVPKPALISLLEGGDMAWGLEAQDDPPAETTKNVRKDV

SEQ ID NO: 8968 - protein, 81 aa, Mus musculus
SKGPVSFKDVTVDFTQEEWQRLDPAQKALYRDVMLENYCHFISVGFHITKPDMIRKLEQGEELWTERIFPSQSYLEEEEVL

SEQ ID NO: 8969 - protein, 81 aa, Homo sapiens; identical to SEQ ID NO: 2674

SEQ ID NO: 8970 - protein, 81 aa, Homo sapiens; identical to SEQ ID NO: 2675

SEQ ID NO: 8971 - protein, 81 aa, Homo sapiens; identical to SEQ ID NO: 2676

SEQ ID NO: 8972 - protein, 81 aa, Homo sapiens; identical to SEQ ID NO: 2677

SEQ ID NO: 8973 - protein, 81 aa, Macaca fascicularis
TQESLTLEDVAVEFSWEEWQLLDTAQKNLYRDVMVENYNHLVSLGYQTSKPDVLSKLAHGQEPWITVAKIQNKNCPGIGKA

SEQ ID NO: 8974 - protein, 81 aa, Homo sapiens; identical to SEQ ID NO: 2678

SEQ ID NO: 8975 - protein, 81 aa, Homo sapiens; identical to SEQ ID NO: 2679

SEQ ID NO: 8976 - protein, 81 aa, Homo sapiens; identical to SEQ ID NO: 2680

SEQ ID NO: 8977 - protein, 81 aa, Homo sapiens; identical to SEQ ID NO: 2681

SEQ ID NO: 8978 - protein, 81 aa, Homo sapiens; identical to SEQ ID NO: 2682

SEQ ID NO: 8979 - protein, 81 aa, Homo sapiens; identical to SEQ ID NO: 2683

SEQ ID NO: 8980 - protein, 81 aa, Rattus norvegicus
LRTTVRYEDVAVSFTQEEWEYLTSTQKTLYQKVMSETFKNLTFVESKKKPQEPNPNLKDKDDDKSSTCTGVFKGGPFFFCL

SEQ ID NO: 8981 - protein, 81 aa, Homo sapiens; identical to SEQ ID NO: 2684

SEQ ID NO: 8982 - protein, 81 aa, Homo sapiens; identical to SEQ ID NO: 2685

SEQ ID NO: 8983 - protein, 81 aa, Pongo abelii
AQESLTLEDVAVDFTWEEWQFLSPAQKDLYRDVMLENYSNLVAVGFQASKQDALSKLERGEETCTTEDEIYSRICFEIRKI

SEQ ID NO: 8984 - protein, 81 aa, Rattus norvegicus
YQELVSFDDVIVDFTQEEWTSLNPDQRTLYREVMLENYKNLATVGYQLIKPSVISWLEQEEFSTGQKIVFPEWKIQLETQC

SEQ ID NO: 8985 - protein, 81 aa, Homo sapiens; identical to SEQ ID NO: 2686

SEQ ID NO: 8986 - protein, 81 aa, Homo sapiens; identical to SEQ ID NO: 2687

SEQ ID NO: 8987 - protein, 81 aa, Homo sapiens; identical to SEQ ID NO: 2688

SEQ ID NO: 8988 - protein, 81 aa, Homo sapiens; identical to SEQ ID NO: 2689

SEQ ID NO: 8989 - protein, 81 aa, Mus musculus
MDVTIDFSREEWQHLDPAQRSLYRDVVQETYSHLRSVEELQQIGDQKKTYQQIGHKSASDMVFITKTLGAESCHDYSGVRK

SEQ ID NO: 8990 - protein, 81 aa, Homo sapiens; identical to SEQ ID NO: 2690

SEQ ID NO: 8991 - protein, 81 aa, Mus musculus
PQESVTFKDVAVNFTQEEWHHVGPAQRSLYRDVMLENYNHLVSLGYQVSKPEVIFKLEQGEEPWISEKEIQRPFCPDWKTR

SEQ ID NO: 8992 - protein, 81 aa, Homo sapiens; identical to SEQ ID NO: 2691

SEQ ID NO: 8993 - protein, 81 aa, Homo sapiens; identical to SEQ ID NO: 2692

SEQ ID NO: 8994 - protein, 81 aa, Homo sapiens; identical to SEQ ID NO: 2693

SEQ ID NO: 8995 - protein, 81 aa, Homo sapiens; identical to SEQ ID NO: 2694

SEQ ID NO: 8996 - protein, 81 aa, Homo sapiens; identical to SEQ ID NO: 2695

SEQ ID NO: 8997 - protein, 81 aa, Homo sapiens; identical to SEQ ID NO: 2696

SEQ ID NO: 8998 - protein, 81 aa, Homo sapiens; identical to SEQ ID NO: 2697

SEQ ID NO: 8999 - protein, 81 aa, Macaca fascicularis
DGLVTFRDVAIDFSQEEWECLDPAQRDLYVDVMLENYSNLVSLDLESTTYETKKIFSEKDIFEINFSQWEMKEKSKTLGLE

SEQ ID NO: 9000 - protein, 81 aa, Homo sapiens; identical to SEQ ID NO: 2698

SEQ ID NO: 9001 - protein, 81 aa, Homo sapiens; identical to SEQ ID NO: 2699

SEQ ID NO: 9002 - protein, 81 aa, Homo sapiens; identical to SEQ ID NO: 2700

SEQ ID NO: 9003 - protein, 81 aa, Homo sapiens; identical to SEQ ID NO: 2701

SEQ ID NO: 9004 - protein, 81 aa, Homo sapiens; identical to SEQ ID NO: 2702

SEQ ID NO: 9005 - protein, 81 aa, Gallus gallus
MEPYVLLDPRQKALYRDVMQESYETLMSIAQGLVNHKAAEEDAVGLKEDAVGSEEPQTHPPHNPAQNRTAGSHRRKAKRPD

SEQ ID NO: 9006 - protein, 81 aa, Mus musculus
PHESVKFEDVSLTFTEEEWAQLDFQQKCLYREIMMENYSNMISVEHHFSKPNVISQLEKAEDCWPMQREIPQDTLPECSWP

SEQ ID NO: 9007 - protein, 81 aa, Homo sapiens; identical to SEQ ID NO: 2703

SEQ ID NO: 9008 - protein, 81 aa, Homo sapiens; identical to SEQ ID NO: 2704

SEQ ID NO: 9009 - protein, 81 aa, Homo sapiens; identical to SEQ ID NO: 2705

SEQ ID NO: 9010 - protein, 81 aa, Homo sapiens; identical to SEQ ID NO: 2706

SEQ ID NO: 9011 - protein, 81 aa, Homo sapiens; identical to SEQ ID NO: 2707

SEQ ID NO: 9012 - protein, 81 aa, Homo sapiens; identical to SEQ ID NO: 2708

SEQ ID NO: 9013 - protein, 81 aa, Homo sapiens; identical to SEQ ID NO: 2709

SEQ ID NO: 9014 - protein, 81 aa, Homo sapiens; identical to SEQ ID NO: 2710

SEQ ID NO: 9015 - protein, 81 aa, Homo sapiens; identical to SEQ ID NO: 2711

SEQ ID NO: 9016 - protein, 81 aa, Homo sapiens; identical to SEQ ID NO: 2712

SEQ ID NO: 9017 - protein, 81 aa, Homo sapiens; identical to SEQ ID NO: 2713

SEQ ID NO: 9018 - protein, 81 aa, Homo sapiens; identical to SEQ ID NO: 2714

SEQ ID NO: 9019 - protein, 81 aa, Homo sapiens; identical to SEQ ID NO: 2715

SEQ ID NO: 9020 - protein, 81 aa, Homo sapiens; identical to SEQ ID NO: 2716

SEQ ID NO: 9021 - protein, 81 aa, Homo sapiens; identical to SEQ ID NO: 2717

SEQ ID NO: 9022 - protein, 81 aa, Homo sapiens; identical to SEQ ID NO: 2718

SEQ ID NO: 9023 - protein, 81 aa, Homo sapiens; identical to SEQ ID NO: 2719

SEQ ID NO: 9024 - protein, 81 aa, Homo sapiens; identical to SEQ ID NO: 2720

SEQ ID NO: 9025 - protein, 81 aa, Homo sapiens; identical to SEQ ID NO: 2721

SEQ ID NO: 9026 - protein, 81 aa, Homo sapiens; identical to SEQ ID NO: 2722

SEQ ID NO: 9027 - protein, 81 aa, Homo sapiens; identical to SEQ ID NO: 2723

SEQ ID NO: 9028 - protein, 81 aa, Homo sapiens; identical to SEQ ID NO: 2724

SEQ ID NO: 9029 - protein, 81 aa, Homo sapiens; identical to SEQ ID NO: 2725

SEQ ID NO: 9030 - protein, 81 aa, Homo sapiens; identical to SEQ ID NO: 2726

SEQ ID NO: 9031 - protein, 81 aa, Homo sapiens; identical to SEQ ID NO: 2727

SEQ ID NO: 9032 - protein, 81 aa, Homo sapiens; identical to SEQ ID NO: 2728

SEQ ID NO: 9033 - protein, 81 aa, Homo sapiens; identical to SEQ ID NO: 2729

SEQ ID NO: 9034 - protein, 81 aa, Homo sapiens; identical to SEQ ID NO: 2730

SEQ ID NO: 9035 - protein, 81 aa, Homo sapiens; identical to SEQ ID NO: 2731

SEQ ID NO: 9036 - protein, 81 aa, Homo sapiens; identical to SEQ ID NO: 2732

SEQ ID NO: 9037 - protein, 81 aa, Homo sapiens; identical to SEQ ID NO: 2733

SEQ ID NO: 9038 - protein, 81 aa, Homo sapiens; identical to SEQ ID NO: 2734

SEQ ID NO: 9039 - protein, 81 aa, Homo sapiens; identical to SEQ ID NO: 2735

SEQ ID NO: 9040 - protein, 81 aa, Homo sapiens; identical to SEQ ID NO: 2736

SEQ ID NO: 9041 - protein, 81 aa, Homo sapiens
ASFMDVFVDFTWEEWQLLDPAQKCLYRSVMLENYSNLVSLGYQHTKPDIIFKLEQGEELCMVQAQVPNQTCPILKAGKSKA

SEQ ID NO: 9042 - protein, 81 aa, Homo sapiens; identical to SEQ ID NO: 2737

SEQ ID NO: 9043 - protein, 81 aa, Homo sapiens; identical to SEQ ID NO: 2738

SEQ ID NO: 9044 - protein, 81 aa, Homo sapiens; identical to SEQ ID NO: 2739

SEQ ID NO: 9045 - protein, 81 aa, Homo sapiens; identical to SEQ ID NO: 2740

SEQ ID NO: 9046 - protein, 81 aa, Homo sapiens; identical to SEQ ID NO: 2741

SEQ ID NO: 9047 - protein, 81 aa, Homo sapiens; identical to SEQ ID NO: 2742

SEQ ID NO: 9048 - protein, 81 aa, Homo sapiens; identical to SEQ ID NO: 2743

SEQ ID NO: 9049 - protein, 81 aa, Homo sapiens; identical to SEQ ID NO: 2744

SEQ ID NO: 9050 - protein, 81 aa, Homo sapiens; identical to SEQ ID NO: 2745

SEQ ID NO: 9051 - protein, 81 aa, Homo sapiens; identical to SEQ ID NO: 2746

SEQ ID NO: 9052 - protein, 81 aa, Homo sapiens; identical to SEQ ID NO: 2747

SEQ ID NO: 9053 - protein, 80 aa, Homo sapiens; identical to SEQ ID NO: 2748

SEQ ID NO: 9054 - protein, 81 aa, Homo sapiens; identical to SEQ ID NO: 2749

SEQ ID NO: 9055 - protein, 81 aa, Homo sapiens; identical to SEQ ID NO: 2750

SEQ ID NO: 9056 - protein, 81 aa, Homo sapiens; identical to SEQ ID NO: 2751

SEQ ID NO: 9057 - protein, 81 aa, Homo sapiens; identical to SEQ ID NO: 2752

SEQ ID NO: 9058 - protein, 81 aa, Homo sapiens; identical to SEQ ID NO: 2753

SEQ ID NO: 9059 - protein, 81 aa, Homo sapiens; identical to SEQ ID NO: 2754

SEQ ID NO: 9060 - protein, 81 aa, Homo sapiens; identical to SEQ ID NO: 2755

SEQ ID NO: 9061 - protein, 81 aa, Homo sapiens; identical to SEQ ID NO: 2756

SEQ ID NO: 9062 - protein, 81 aa, Homo sapiens; identical to SEQ ID NO: 2757

SEQ ID NO: 9063 - protein, 81 aa, Homo sapiens; identical to SEQ ID NO: 2758

SEQ ID NO: 9064 - protein, 81 aa, Homo sapiens; identical to SEQ ID NO: 2759

SEQ ID NO: 9065 - protein, 81 aa, Homo sapiens; identical to SEQ ID NO: 2760

SEQ ID NO: 9066 - protein, 81 aa, Homo sapiens; identical to SEQ ID NO: 2761

SEQ ID NO: 9067 - protein, 81 aa, Homo sapiens; identical to SEQ ID NO: 2762

SEQ ID NO: 9068 - protein, 81 aa, Homo sapiens; identical to SEQ ID NO: 2763

SEQ ID NO: 9069 - protein, 81 aa, Homo sapiens; identical to SEQ ID NO: 2764

SEQ ID NO: 9070 - protein, 81 aa, Homo sapiens; identical to SEQ ID NO: 2765

SEQ ID NO: 9071 - protein, 81 aa, Homo sapiens; identical to SEQ ID NO: 2766

SEQ ID NO: 9072 - protein, 81 aa, Homo sapiens; identical to SEQ ID NO: 2767

SEQ ID NO: 9073 - protein, 81 aa, Homo sapiens; identical to SEQ ID NO: 2768

SEQ ID NO: 9074 - protein, 81 aa, Homo sapiens; identical to SEQ ID NO: 2769

SEQ ID NO: 9075 - protein, 81 aa, Homo sapiens; identical to SEQ ID NO: 2770

SEQ ID NO: 9076 - protein, 81 aa, Homo sapiens; identical to SEQ ID NO: 2771

SEQ ID NO: 9077 - protein, 81 aa, Homo sapiens; identical to SEQ ID NO: 2772

SEQ ID NO: 9078 - protein, 81 aa, Schistosoma margrebowiei
VDSSIIPILTYGLESIVLRKQDWTRLETVLNTIWRMILGTNDRKQLDVQQLKLKVNLPNLANKIMQTDQAYHIRRIKDQIT

SEQ ID NO: 9079 - protein, 81 aa, Homo sapiens; identical to SEQ ID NO: 2773

SEQ ID NO: 9080 - protein, 81 aa, Homo sapiens; identical to SEQ ID NO: 2774

SEQ ID NO: 9081 - protein, 81 aa, Homo sapiens; identical to SEQ ID NO: 2775

SEQ ID NO: 9082 - protein, 81 aa, Homo sapiens; identical to SEQ ID NO: 2776

SEQ ID NO: 9083 - protein, 81 aa, Homo sapiens; identical to SEQ ID NO: 2777

SEQ ID NO: 9084 - protein, 81 aa, Homo sapiens; identical to SEQ ID NO: 2778

SEQ ID NO: 9085 - protein, 81 aa, Homo sapiens; identical to SEQ ID NO: 2779

SEQ ID NO: 9086 - protein, 81 aa, Homo sapiens; identical to SEQ ID NO: 2780

SEQ ID NO: 9087 - protein, 81 aa, Homo sapiens; identical to SEQ ID NO: 2781

SEQ ID NO: 9088 - protein, 81 aa, Homo sapiens; identical to SEQ ID NO: 2782

SEQ ID NO: 9089 - protein, 81 aa, Homo sapiens; identical to SEQ ID NO: 2783

SEQ ID NO: 9090 - protein, 81 aa, Homo sapiens; identical to SEQ ID NO: 2784

SEQ ID NO: 9091 - protein, 81 aa, Homo sapiens; identical to SEQ ID NO: 2785

SEQ ID NO: 9092 - protein, 81 aa, Homo sapiens; identical to SEQ ID NO: 2786

SEQ ID NO: 9093 - protein, 81 aa, Homo sapiens; identical to SEQ ID NO: 2787

SEQ ID NO: 9094 - protein, 81 aa, Homo sapiens; identical to SEQ ID NO: 2788

SEQ ID NO: 9095 - protein, 81 aa, Homo sapiens; identical to SEQ ID NO: 2789

SEQ ID NO: 9096 - protein, 81 aa, Homo sapiens; identical to SEQ ID NO: 2790

SEQ ID NO: 9097 - protein, 81 aa, Homo sapiens; identical to SEQ ID NO: 2791

SEQ ID NO: 9098 - protein, 81 aa, Homo sapiens; identical to SEQ ID NO: 2792

SEQ ID NO: 9099 - protein, 81 aa, Homo sapiens; identical to SEQ ID NO: 2793

SEQ ID NO: 9100 - protein, 81 aa, Homo sapiens; identical to SEQ ID NO: 2794

SEQ ID NO: 9101 - protein, 81 aa, Homo sapiens; identical to SEQ ID NO: 2795

SEQ ID NO: 9102 - protein, 81 aa, Homo sapiens; identical to SEQ ID NO: 2796

SEQ ID NO: 9103 - protein, 81 aa, Homo sapiens; identical to SEQ ID NO: 2797

SEQ ID NO: 9104 - protein, 81 aa, Homo sapiens; identical to SEQ ID NO: 2798

SEQ ID NO: 9105 - protein, 81 aa, Homo sapiens; identical to SEQ ID NO: 2799

SEQ ID NO: 9106 - protein, 81 aa, Homo sapiens; identical to SEQ ID NO: 2800

SEQ ID NO: 9107 - protein, 81 aa, Homo sapiens; identical to SEQ ID NO: 2801

SEQ ID NO: 9108 - protein, 81 aa, Homo sapiens; identical to SEQ ID NO: 2802

SEQ ID NO: 9109 - protein, 81 aa, Homo sapiens; identical to SEQ ID NO: 2803

SEQ ID NO: 9110 - protein, 81 aa, Homo sapiens; identical to SEQ ID NO: 2804

SEQ ID NO: 9111 - protein, 80 aa, Homo sapiens; identical to SEQ ID NO: 2805

SEQ ID NO: 9112 - protein, 81 aa, Homo sapiens; identical to SEQ ID NO: 2806

SEQ ID NO: 9113 - protein, 81 aa, Homo sapiens; identical to SEQ ID NO: 2807

SEQ ID NO: 9114 - protein, 81 aa, Homo sapiens; identical to SEQ ID NO: 2808

SEQ ID NO: 9115 - protein, 81 aa, Homo sapiens; identical to SEQ ID NO: 2809

SEQ ID NO: 9116 - protein, 81 aa, Homo sapiens; identical to SEQ ID NO: 2810

SEQ ID NO: 9117 - protein, 81 aa, Homo sapiens; identical to SEQ ID NO: 2811

SEQ ID NO: 9118 - protein, 81 aa, Homo sapiens; identical to SEQ ID NO: 2812

SEQ ID NO: 9119 - protein, 81 aa, Homo sapiens; identical to SEQ ID NO: 2813

SEQ ID NO: 9120 - protein, 81 aa, Homo sapiens; identical to SEQ ID NO: 2814

SEQ ID NO: 9121 - protein, 81 aa, Homo sapiens; identical to SEQ ID NO: 2815

SEQ ID NO: 9122 - protein, 81 aa, Homo sapiens; identical to SEQ ID NO: 2816

SEQ ID NO: 9123 - protein, 81 aa, Homo sapiens; identical to SEQ ID NO: 2817

SEQ ID NO: 9124 - protein, 81 aa, Homo sapiens; identical to SEQ ID NO: 2818

SEQ ID NO: 9125 - protein, 81 aa, Homo sapiens; identical to SEQ ID NO: 2819

SEQ ID NO: 9126 - protein, 81 aa, Homo sapiens; identical to SEQ ID NO: 2820

SEQ ID NO: 9127 - protein, 81 aa, Homo sapiens
ALYRDVMLENYRNLVSLGICLPDLSVTSMLEQKRDPWTLQSEEKIANDPDGRECIKGVNTDSPLLQCITSVPCVFCTASMI

SEQ ID NO: 9128 - protein, 81 aa, Homo sapiens; identical to SEQ ID NO: 2821

SEQ ID NO: 9129 - protein, 81 aa, Homo sapiens; identical to SEQ ID NO: 2822

SEQ ID NO: 9130 - protein, 81 aa, Homo sapiens; identical to SEQ ID NO: 2823

SEQ ID NO: 9131 - protein, 81 aa, Homo sapiens; identical to SEQ ID NO: 2824

SEQ ID NO: 9132 - protein, 81 aa, Homo sapiens; identical to SEQ ID NO: 2825

SEQ ID NO: 9133 - protein, 81 aa, Homo sapiens; identical to SEQ ID NO: 2826

SEQ ID NO: 9134 - protein, 81 aa, Homo sapiens; identical to SEQ ID NO: 2827

SEQ ID NO: 9135 - protein, 81 aa, Homo sapiens; identical to SEQ ID NO: 2828

SEQ ID NO: 9136 - protein, 81 aa, Homo sapiens; identical to SEQ ID NO: 2829

SEQ ID NO: 9137 - protein, 81 aa, Homo sapiens; identical to SEQ ID NO: 2830

SEQ ID NO: 9138 - protein, 81 aa, Homo sapiens; identical to SEQ ID NO: 2831

SEQ ID NO: 9139 - protein, 81 aa, Homo sapiens; identical to SEQ ID NO: 2832

SEQ ID NO: 9140 - protein, 81 aa, Homo sapiens; identical to SEQ ID NO: 2833

SEQ ID NO: 9141 - protein, 81 aa, Homo sapiens; identical to SEQ ID NO: 2834

SEQ ID NO: 9142 - protein, 81 aa, Homo sapiens; identical to SEQ ID NO: 2835

SEQ ID NO: 9143 - protein, 81 aa, Homo sapiens; identical to SEQ ID NO: 2836

SEQ ID NO: 9144 - protein, 81 aa, Myotis brandtii
KPRAVKFADVAVYFSPEEWGCLRPAQRALYRDVMRENYGHLGALETRTRKKNGEEEVFPPKEAPRKGKRGRKPSKPRLIPR

SEQ ID NO: 9145 - protein, 81 aa, Myotis brandtii
SQGILSFSDVAVYFTWEEWRLLDTAQKNLYRDVMLENHSNLMSLGYQATKPEAMIYLEKGEERGIVERKFPNHFNPEIMWQ

SEQ ID NO: 9146 - protein, 81 aa, Propithecus coquereli
VSFEDVAVDFTWEEWQLLNPTQKNLYRDVMLENYSHLVFLEVWLDNKSKMLHQDNQDKLKSMESSHEYDVFGRIFNSSMNF

SEQ ID NO: 9147 - protein, 81 aa, Vombatus ursinus
MLENYKNFVSLGFPVFKPDVISQLERGEGPWTSETEISQVVCPDPIIQKTRCENLDWIQKQDISLGESSKEIIRKNYPWSC

SEQ ID NO: 9148 - protein, 81 aa, Propithecus coquereli
IQGQVNFEDVFVYFSQDEWQLLDEAQRLLYRDVMLENFVLMASLGQASSMSHVIASLEQGSEPWVPDWVDVTPAIARGTLG

SEQ ID NO: 9149 - protein, 81 aa, Propithecus coquereli
MLENYKNLATVGCQLFKPSLISWLEQAESRTGQRGVLHASEWKVQLKTKESALQQDFLWEPTSSGIHMTGSHNGAELNESK

SEQ ID NO: 9150 - protein, 81 aa, Saimiri boliviensis
VLGPLTFKDVAIEFSQEEWRCLDPAQRTLYRDVMLENYRNLVSLGVGLPDLSVVSMLEQKREPWTLQSEEKIAWNPDGREC

SEQ ID NO: 9151 - protein, 81 aa, Propithecus coquereli
MLTFRDVTIEFSLEEWECLNPAQQNLYRDVMLEYYGNLISLCLAVSKQDLITCLEKRKEPWNVKKPETVVEHPAISSDSTQ

SEQ ID NO: 9152 - protein, 81 aa, Propithecus coquereli
PVPPQASVCLEDVAVTFTQEEWRQLDLAQRMLYCDVTLETCGHLVSLGLLLSKPEVISQLERDDLCRVGQPPPRGCRGYRA

SEQ ID NO: 9153 - protein, 81 aa, Vombatus ursinus
MLENYWHLVFLGLPVSKPELISQLECGGGPWMPLEEEPRNPHADQNSSPKTKKTVLKQGILVGKSSQERLSRDHRKDFKFG

SEQ ID NO: 9154 - protein, 81 aa, Lynx pardinus
LPEVLLTFRDVTIDFSQEEWECLDPAQRALYREVMLENYRNLVSLGVDKVRPDVGICPRTEPRGLEGKMKIVRKPNISVRS

SEQ ID NO: 9155 - protein, 81 aa, Balaenoptera acutorostrata
CWGLSSFKDISMEFTWEEWQLLDSAQKHLYRDVTLENYSNLVSLGYHGTKPDLIFKLEQGEEPWIINAEVSRQSGPGGLSC

SEQ ID NO: 9156 - protein, 81 aa, Balaenoptera acutorostrata
QGHVIFEDVAVSFSQEEWGLLNDAQRLLYCDVMLENLSLIASLGCWHGVEVEEAVSEQCVSVEHVTEDRNPKLEPSILKPL

SEQ ID NO: 9157 - protein, 81 aa, Vombatus ursinus
GARGSVRFADVAVYFSPEEWGRLRPAQRALYRDVVQVTYRCLGDFQSPKPVLISWMQQETEMWGLEAQDSEEKRNCSRTCR

SEQ ID NO: 9158 - protein, 81 aa, Balaenoptera acutorostrata
GLLTFKDVAITFSQEEWECLDPAQRALYRDVMLETYRNLLSLGSLSAGFAIKELSPREDINKGELYHLVILDRNENHGIKD

SEQ ID NO: 9159 - protein, 81 aa, Saimiri boliviensis
YQTPVSFQDVVVGFTQEEWHWLNPTQRALYRDVMLETYSNLVSVGYEGTKPDVILRLEQEEAPWIGEAACLGCHCWGISKL

SEQ ID NO: 9160 - protein, 81 aa, Balaenoptera acutorostrata
AQGKVNFEDVFVYFSQEEWGLLDEAQRLLYREVMLENFALMASLGCSHGMEEEEIHFEQSVSVKGVSQVTIPKTILSSQKA

SEQ ID NO: 9161 - protein, 81 aa, Vombatus ursinus
MLENYRDVVSLGFPFSKPTGISRREEEPWGLNHQGPLDLEGGKSTCTEGDNVTENEESTLKQEIFVESEAHSSSSEGLQKD

SEQ ID NO: 9162 - protein, 81 aa, Saimiri boliviensis
SVTFEDVAVNFSLEEWNLLNEAQRCLYRDVMLETLTLISSLGAPPHTLFPARACGPEAPPSRHCPRPSLCLSLSPLHPTGV

SEQ ID NO: 9163 - protein, 81 aa, Saimiri boliviensis
VQEPVTFKDVAVDFTQEEWGQLDLVQRTLYRDVMLETYGHLLSVGNQIAKPEVISLLEQGEEPWSLEQTCPQRACPEWMRN

SEQ ID NO: 9164 - protein, 81 aa, Saimiri boliviensis
FQGSISFKDVTVGFTQEEWQRLDRGQRALYRDVMLENYSNLVSVGYCVHKPEVIFRLEQGEEPWRLEEEFPSQSFPEVWTA

SEQ ID NO: 9165 - protein, 81 aa, Vombatus ursinus
SQKLLTFQDVAVDFTREEWGLLEPAQKDLFRDVMLESYENFVSLGLPDSKEDVISQLEKTEEPGPPEGEVVPGNTYTDFLH

SEQ ID NO: 9166 - protein, 81 aa, Vombatus ursinus
DHESLTFRDVAVDFTHEEWRQLDPGQRYLYKDVMLENYRNLVSVGKCVCKPDLISQLEQGKEPWIVEREIPRGTFPGEDCK

SEQ ID NO: 9167 - protein, 81 aa, Saimiri boliviensis
NDVAIEFSLEEWQCLDKTQQNLYRDVMLENYRNLIFLGIAVSKPDLVTCLKQGKEPWNMRRHEMVTKPPAMCSHFTQDVRP

SEQ ID NO: 9168 - protein, 81 aa, Vombatus ursinus
PGELVMTAELLPSRPQADMIFEDVAVYLSQEEWSCLGPAQRGLYRDVMLENYGNIVSLGKTLLSVPISELFGFVNSHGGLK

SEQ ID NO: 9169 - protein, 81 aa, Balaenoptera acutorostrata
SLDSVSFTDIAIDFSQDEWEWLNLAQRTLYKKVMLENYRNLASLGLCISKPDVISFLEQDKEPWMMKGEITRGLHPDLEFV

SEQ ID NO: 9170 - protein, 81 aa, Balaenoptera acutorostrata
GQLTLNDVVITFSQEEWKCLDPAQRALYRDVMLETYRNLIFVAISHIHVIKKLQLKSNTDRGGVFQTLMLGRHENQGIKHF

SEQ ID NO: 9171 - protein, 81 aa, Saimiri boliviensis
EQVTFEDVVVDFTKEEWGQLAPAQKTLYCDVMLDTFRLLVAVGHWLPKPNIISLLEQEAELAVDPGVPQGVYQDLESRPKV

SEQ ID NO: 9172 - protein, 81 aa, Cervus elaphus
DPEQVTFEDVVVDFTQEEWGHLEPAQRTLYRDVMLETFGLLVSVGHWLPKPDVISLLEQEAELWAADEGGPQGVCPDLETR

SEQ ID NO: 9173 - protein, 81 aa, Colobus angolensis
HQEVVTFEDVAVHFTKTEWTGLSPAQRALYRSVMLENFGNLTALGYPVPKPALISLLEGGDMAWGLEAQDDPPAERTKNIC

SEQ ID NO: 9174 - protein, 81 aa, Colobus angolensis
DSLVFEEVAVNFTPEEWALLDHAQRSLYRDVMLETCRNLASLDCCIYVRTSGSSSQRDVLGNGISNDEEIVKFTSDYWSIF

SEQ ID NO: 9175 - protein, 81 aa, Colobus angolensis
RRGHLTFRDVAIEFSQEEWKCLNLAQRTLYREVMLENYRNLVFLGICLPDLSIISMLEQRRDPRNLQSEVKIANNPDGREC

SEQ ID NO: 9176 - protein, 81 aa, Colobus angolensis
QEMPLTFQDVAVYFSQAEGQQLGPQQRALYRDVMLENYGNVASLGFPVPKPELISQLEQGKELWVLNLLGAEEPEILKSCQ

SEQ ID NO: 9177 - protein, 81 aa, Colobus angolensis
GTVAFEDVAVNFSQEEWSLLSEVQRCLYHDVMLENWVLISSLGYWCGSEDEEAPSKRNISIQRVWSLHLSVQAGVSRSQLT

SEQ ID NO: 9178 - protein, 81 aa, Tupaia chinensis
LQTLVTFQDVLVDFSREEWKLLDTAQQLMYRDVMLENYRNLLSLGHRLPKPDMILQLEKADLETASEFEPSVSSKHITKDQ

SEQ ID NO: 9179 - protein, 81 aa, Odobenus rosmarus
SQHLVTFEDVAVNFTQEEWTLLDQTQRDLYRDVMLENYQNLIILGYESCKPDLTSSMGGAEELRTGGRGILQELDLQLKTK

SEQ ID NO: 9180 - protein, 81 aa, Odobenus rosmarus
TARSQASVTFKDVAMDFTPEEWGKLDPAQREVMLENYRNLVSLWLPVSKPENYSLENGKEPLMLERKAPKSSYSDLETKPE

SEQ ID NO: 9181 - protein, 81 aa, Cucumis melo var. makuwa
ETTNLPVGGSFIDLPRELFQMLATAGPYLYRDTILLQKVCRVLRGYYTSAIEFVNSVESGQNPELVMPAGNRVPHLHLKEA

SEQ ID NO: 9182 - protein, 81 aa, Firmicutes bacterium
AKVSLLTHKKTISRKVKEWLYAINLERNLSKNEILERYLNYIFFGHGVYGVEAAAQLYFGKHIWELELHQFALLAGLIRSP

SEQ ID NO: 9183 - protein, 81 aa, Homo sapiens; identical to SEQ ID NO: 2837

SEQ ID NO: 9184 - protein, 81 aa, Homo sapiens; identical to SEQ ID NO: 2838

SEQ ID NO: 9185 - protein, 81 aa, Homo sapiens; identical to SEQ ID NO: 2839

SEQ ID NO: 9186 - protein, 81 aa, Homo sapiens; identical to SEQ ID NO: 2840

SEQ ID NO: 9187 - protein, 81 aa, Homo sapiens; identical to SEQ ID NO: 2841

SEQ ID NO: 9188 - protein, 81 aa, Homo sapiens; identical to SEQ ID NO: 2842

SEQ ID NO: 9189 - protein, 81 aa, Homo sapiens; identical to SEQ ID NO: 2843

SEQ ID NO: 9190 - protein, 81 aa, Homo sapiens; identical to SEQ ID NO: 2844

SEQ ID NO: 9191 - protein, 81 aa, Homo sapiens; identical to SEQ ID NO: 2845

SEQ ID NO: 9192 - protein, 81 aa, Homo sapiens; identical to SEQ ID NO: 2846

SEQ ID NO: 9193 - protein, 81 aa, Arthrobotrys oligospora
NMKLLRFLYDANIFLLQSWQSIDEAPLQIYSSALIFSPKASVIRKIFQNCIPKWISRWPEPPEPWKATLKLELNTLDPSAL

SEQ ID NO: 9194 - protein, 81 aa, Nitrospiraceae bacterium
QCVLVVDEAFIDFRPEESVIDHVQDNPYLIVLRSMTKFYALTGLRIGYGVFHPDLISRIIYFKEPWTVNNLAQKAAITALE

SEQ ID NO: 9195 - protein, 81 aa, Nodularia spumigena UHCC 0039
YAYGMEEADVALQLLDAGWKILDVPSLAVYHDTQLEHHNTVAINSSHISNTALLAYLRYPISAWPLGMMQVLNRVRYAASV

SEQ ID NO: 9196 - protein, 81 aa, unidentified
  REGION 1..81: note = Gordonia sp.
VDEAFADITIDPATGRPEPESVAHRSHPDLIVIRSVTKTFGLAGLRAGYLLAAPEVIARLTVGRRPWPLGTLALTALTACV

SEQ ID NO: 9197 - protein, 81 aa, Alteromonadaceae bacterium
QLQTYTFKKLALEYVEKRSKEFKTEQQVRKLTKMLENYAYPVIGGMRVGDIDLNAVKSMLDEIWLTKNETANRLRIYVGHI

SEQ ID NO: 9198 - protein, 81 aa, Magnetospirillum moscoviense
RLPTGTLDRLVAFTAEELAALESATRLFERDNREDEAAELATLGAKLRALLKPDVARRVEPDLEALLEAEGLAMRPGPRPR

SEQ ID NO: 9199 - protein, 81 aa, Arthroderma gypseum
SSEISEFIQDAKQFTLKNRQMVDTAPLQLYNSGLVFAPRTAVTRKFFEMDFPKWLSRLPNVEETWSAHIQALEGHGHWVTS

SEQ ID NO: 9200 - protein, 81 aa, Chloroflexi bacterium
GGVLVLDEAFVDFVEDGWDSVELARSGRVLALRSLTKAFALAGLRLGYALGRPELLERLRAHQPPWSVNAFAVAAGVACAV

SEQ ID NO: 9201 - protein, 81 aa, Rattus norvegicus
SKGPLSFKDVAVAFSQEEWQQLDSEERTTYRDVMLETYSNLVSVGYDVTKPNVIIKLEQGEEPWTVEGDRHAKRHLEIKKV

SEQ ID NO: 9202 - protein, 81 aa, Rattus norvegicus
PKVTVSFEDVSVYFTKTEWKLLDLKQRNLYKQVMLENYSHLVSVGFAFSKPNLVSQLEKGEKPWIRDGGMESAAGSCTGNR

SEQ ID NO: 9203 - protein, 81 aa, Rattus norvegicus
MEDMLSFWDVAIYFSGEEWEYLGPAQWNLYRDVTLENYNNLVFLGLASSKPYLVTFLEQIEEPLVVKKGEVTTMYSGKSEG

SEQ ID NO: 9204 - protein, 81 aa, Mus musculus
AQCLLTFKDVFLDFSSEEWECLNFAQRTLYMDVMLENYNNLLFVENHCICGNYEKEKVLEQETQHIVNEHGHNRKKSSKCN

SEQ ID NO: 9205 - protein, 81 aa, Mus musculus
MDLVTYDDVHVNFTQEEWALLHPSQKSLYKGVMLETYRNLTAIGYIWEEHTIEDHFQTSRSHGRHERSCSAEQPPEFIQCG

SEQ ID NO: 9206 - protein, 81 aa, Rattus norvegicus
GSVSFEDVAVDFSWDEWQHLDVAQRRLYRDVMLENYSSLLFLGRCMTKPEVIFKLEHGFGPRPVVDSSVRSLPGQKKVTAP

SEQ ID NO: 9207 - protein, 81 aa, Rattus norvegicus
KPELVSFADVAVYFSPQEWGCLRPAQRALYREVMRETYGLLGALGFPGPKPALISWMEQESEAWSPAAQDPEEGESLGGAP

SEQ ID NO: 9208 - protein, 81 aa, Rattus norvegicus
MLENYSHLVSLGYPITKPEVISSLEQGILGIIKKEIPSSNCTEDGQAEYNLAWNQKKQNMPLEQTISVIEKNVTEERSYEC

SEQ ID NO: 9209 - protein, 81 aa, Rattus norvegicus
LQGFLTFKDVAPEFTLEEWESLNYAQRALYMDVILETYNNLLSVENHLIRGKHGKVLEQYTECIVHEHVNIQKKFCKWDEI

SEQ ID NO: 9210 - protein, 81 aa, Rattus norvegicus
MLSFWDVAIYFSGEEWEYLGPAQWNLYRDVTLENYNNLVFLGLASSKPYLVTLLEQRQELSDVKRQVANSKYSGAKGYMCK

SEQ ID NO: 9211 - protein, 81 aa, Mus musculus
LQEAVTFNDVAIDFSPEEWDWLNPAQRSLYRTVVLENYRNLVSVGACISKPSLISLLEHGKEPWEVKGQVTGSRVQGGKSV

SEQ ID NO: 9212 - protein, 81 aa, Mus musculus
PQGLLTFKDVALVFSLEEWECLSFAQRTLYMEVMLENYNNLLFVENHCIHGKNGKVLDQDSQYIVHEHMNIQEKSSKWDKL

SEQ ID NO: 9213 - protein, 81 aa, Rattus norvegicus
GKDLLTFEDVSVDFTQEEWQQLSDTQRDLYRKVTLENYRSLVSLGIPIYKPVVISLLEQGKDPWMVQKKGARDTCPDWEYV

SEQ ID NO: 9214 - protein, 81 aa, Dipodomys ordii
SLKLMSFDDVAVYFTWKEWQDLDTSQRTLHRDVMLETYRNLRSLGHCVPKPELIVKLEQGAEPWIRETSDKNFTDVPVMED

SEQ ID NO: 9215 - protein, 81 aa, Dipodomys ordii
SLRLVSFEDVAVDFSWEEWQDLDNAQRTLYRDVMLETYSSLVSLGHCVPKPEAIIKLEQGAEPWVGEPSGQSFADVQQVDD

SEQ ID NO: 9216 - protein, 81 aa, Dipodomys ordii
LEGLVSFEDVAVDFSLEEWQDLDSAQRTLYKDVMMETYSNLVFLGHCVPKPEVIVKLEQGTEPWMGGASDKNFSDVPQVDH

SEQ ID NO: 9217 - protein, 81 aa, Dipodomys ordii
EAPEPPTLEDVAVVFSWEEWRLLRPAQKDLYRDVMLENYRSLLAVGGGAGRPGALSTLLRGGPWTAGGDPHRGSRADAGAA

SEQ ID NO: 9218 - protein, 81 aa, Dipodomys ordii
APLPLTFEDVAIYFSEQEWQHLQTWQKMLYKHVMKTNYETLVSLDGDLSKPELILWIEHGREPFKSWEETQKLDSIMHSSA

SEQ ID NO: 9219 - protein, 81 aa, Rattus norvegicus
MLENYSHFVSLGLAISKPSVISLLEQGKEPWRVEQAGWYPDLLSVNEAKNLSLKHGIFGKESLKWKVTERVGSSCLEESRF

SEQ ID NO: 9220 - protein, 81 aa, Rattus norvegicus
GCVTIEDVTVYFSQEEWKLLDEAQRLLYLDVMLENFTLISSLVYRYEAEAEEKTCAQSLSQTEAPQVRTPKQGQLRQKPHP

SEQ ID NO: 9221 - protein, 81 aa, Rattus norvegicus
AMESVSFEDIAVYFTWEEWQVLDVAQKLLYRDVMLENYSSLVSLGCCVIKPELILMLEREFGPWRVADTSIWNLPGYCITR

SEQ ID NO: 9222 - protein, 81 aa, Rattus norvegicus
TWVPALFDEVAIYFSDEEWEVLTEQQKALYREVMRMNYETVLSLEFPFPKPDMINRLEREEECPESDEWRLQGVTFAENEE

SEQ ID NO: 9223 - protein, 81 aa, Mus musculus
MLENYSNLVFLGLAFSKPYLVTFLEQSSDPWSMKRKESAAIHLGSKPHKCKECGKAFDRNSVLIQHQRIHTGERPYKCEEC

SEQ ID NO: 9224 - protein, 81 aa, Rattus norvegicus
YQDSVTFDDVAVEFTPDEWTLLDLTQKNLYREVMLENYENLTSVGCQFFIPSLTPWLKQEELGVAESALPQQLELQPTIDD

SEQ ID NO: 9225 - protein, 81 aa, Mus musculus
LSFADSASLHEGRPLLLPSSFRESVTFKDVVVNFTQEEWKHLDPIQRDLFRDVTLENYTHLVSIDRFLFFLPLSRAPGFQT

SEQ ID NO: 9226 - protein, 81 aa, Mus musculus
VCGSVTFRDVAVDFSQEEWACLDATQKVLYRNIMLETYSNLVAVVGRCISKPDLIVLLEQEKEPWMAVKEETDRPSPDVET

SEQ ID NO: 9227 - protein, 81 aa, Mus musculus
YREVMFENYHNVVSLAGCFISKPDVISLLEQGKEPWKVVRQRKPCPDSETKDETNQVFSENGIYEMNLSQWKIMERVGNSG

SEQ ID NO: 9228 - protein, 81 aa, Mus musculus
MLSFRDVAIDFSAEEWECLEPAQWHLYRDVMLENYSHLVFLELADSKPQLVTFLEQRQQSTGVKRQEVIQTPAGKCGEGIR

SEQ ID NO: 9229 - protein, 81 aa, Octodon degus
VQGCVTFEDVTIYFSQEEWGLLDEAQRLLYYTVMLENFALIASLGLTSFRCHDIGECEMRREPNRVDMTSAMARGAFGKAD

SEQ ID NO: 9230 - protein, 81 aa, Octodon degus
QVPISFKDLAVRFSEEEWRLLEEGQREFYRDVMRENYETLVSVGTAELLPLSAFLLPTEPGGTAGAGSRTEDGQELPVGGG

SEQ ID NO: 9231 - protein, 81 aa, Octodon degus
SPVLVSFEDVVVDFTCEEWQDLDDAQRTLYKDVMLETYRSLVLLGHCITKPAVIFKLEQGAEPWMREESPHLSSPDVQKVD

SEQ ID NO: 9232 - protein, 81 aa, Octodon degus
VDSVDFEDVAVQFTFEEWALLDPSQKRLYRDVMRETIRNLAAVGRNWKDWNIEDDDQNVRRNLRSYVVKRPRESKASLQCR

SEQ ID NO: 9233 - protein, 81 aa, Octodon degus
QQGCVTLEDVTIYFSQEEWGLLNEAQRLLYCNVMLENFALIASLGLTSFKCHISAQLEMRRELWGPGRVNMTSAVARRAFG

SEQ ID NO: 9234 - protein, 81 aa, Octodon degus
MDLVTFKDVAVHFTQEDWALLDPFQKNLYRDVMEETVSNLASVGIKLEDLNIEEVYQSPDENLRSHMVVILWARVEDGQCA

SEQ ID NO: 9235 - protein, 81 aa, Octodon degus
AHGAVTFADVAVEFSQEEWACLDTAQRDLYWDVMLDNYSNLVSLDLESAHTDRNSAVEKSFDKMNLQRRNALGRSKSCPAD

SEQ ID NO: 9236 - protein, 81 aa, Octodon degus
MALLTFRDVVIDFCLEEWKCLDLAQRTLYRDVTLENYRNIFSLGLAVSKPHLVTCLEQNRDPWNVQPRNRAAAPPAFVKSH

SEQ ID NO: 9237 - protein, 81 aa, Octodon degus
RRGLVTIKDVSLCFSQEEWRSLDPSQTDFYGEYVMQENCGIVVSLRFPIPKLDMLSQVGGGEEQWVPDSQDFEERDILRVT

SEQ ID NO: 9238 - protein, 81 aa, Octodon degus
PQEPILFEDLAVYFSQEECVSLHAAERSLSREFTQECFKDVALMGGETNTDVNEQLSLEPMEIEKVSLENHSTATPLVSYP

SEQ ID NO: 9239 - protein, 81 aa, Octodon degus
HAQGSVTFGDVAVDFSWEEWKLLDETQRLLYLDVMLENIALVASLGLISSRIHVVQLEVGEQTQVPDTADFTPVVSKDTGS

SEQ ID NO: 9240 - protein, 81 aa, Octodon degus
EAVTLEDVLVNFTLEEWAVLNPSQKKLYQDVMWETFMNVTAIGGTWDNQQTEDGCISSPRNLRNDEVFKFCQYKAWNQHEK

SEQ ID NO: 9241 - protein, 81 aa, Fukomys damarensis
VFDISVTLREKWLWVFAEETPAAQTRRPRGLARRSNSLDLSLSGHSIAKPDIITLLEQGREPWMVLREETRRECTDLESSY

SEQ ID NO: 9242 - protein, 81 aa, Fukomys damarensis
QGSVSFEDVAVDFTQEEWNRLDPTQRILYRDVMLENYSHLVSLGYPITKPDVIASLEKGVLGIIKREIPSSSCSEDGQAED

SEQ ID NO: 9243 - protein, 81 aa, Fukomys damarensis
MQEWALLDPSQKKLYRDVMWENFKNVAAIGRNWDDQQIEDEYRNYRKNRRSEEVDECCQFKLWYERGEKVFMTPNTNVHMK

SEQ ID NO: 9244 - protein, 81 aa, unidentified
  REGION 1..81: note = marine metagenome
LERNLIEKDIVLEKEQKKWETRAEERQSKYRQQVREMESKLVELGDAIKEKDKISMTEQEKRDNVLEKKQEQYFSRERQLQ

SEQ ID NO: 9245 - protein, 81 aa, Terrapene carolina
FQMPVTFEEVAVYFTQGQGALLDPAQRALYRDVMQENYETVTSLGKGFLSPQILEAVGSACLNLVMFFPCQLDQRGMGSIM

SEQ ID NO: 9246 - protein, 80 aa, Terrapene carolina
MTMTFEEVAVYFTQGQGALLDPAQRALYRDVMRENYETVTSLGFPLPKPDLITRLERGEEPWVPNLQACEERENPRGTHT

SEQ ID NO: 9247 - protein, 81 aa, Terrapene carolina
VTFEEVAVYFTERQGALLDPAQRALYRDVMQENYETVTSLGFPLPKPDLISRLERGEEPWVPDLQACISKCPQFLPYLTQG

SEQ ID NO: 9248 - protein, 81 aa, Aptenodytes forsteri
PKAPAAFESNAAYFSAQEWENLEEWQRELYKNVLRGNNESLISLDDAISKPDLLSRLQRGEAPCNGDGAASREIPAEPNYG

SEQ ID NO: 9249 - protein, 81 aa, Paroedura picta
TPGQVTFEDVAVYFTESEWALLDPGQRALYYEVMRENHANMASLGTGFVKDEDNLRPEDATQAESNEMFIGPHGIFQHPKM

SEQ ID NO: 9250 - protein, 81 aa, Latimeria chalumnae
MEKTFADIEIFFTEDIWDELQDWEKEVYRDIKEHYDTLVSFGYNVPKPDFMCKVEETCRVPAYKPSAREKEFSLPALAESN

SEQ ID NO: 9251 - protein, 81 aa, Terrapene carolina
FQGLVTFEEVAVYFTREEGALLDPTQRALYRDVMQENYETVVLLGKEVCGKSAPDRFDLSHTYFGLFIAFSIPLAEISFLS

SEQ ID NO: 9252 - protein, 81 aa, Terrapene carolina
GPVSFEEVAVYFTAGQGALLDPAQRALYRDIMQENYENVTSLGKVSFKGYSIPTIFTCTSLHITVTSLPSCSQSSTADTHA

SEQ ID NO: 9253 - protein, 81 aa, Terrapene carolina
INGPVTFEEVAVYFTREEWALLDLTQRALYRDVMQENYETVVFLVGFPISKPDVISQLERGEEPWLHSQLKPCLTSENPHG

SEQ ID NO: 9254 - protein, 81 aa, Terrapene carolina
GDPQGSAVCFTEGQGALLDPAQRALYRDVMQENYEMVTSLDKGFPKQSGEGAVRVGKVKAQSGWAEGPWIGIRCRGWARVP

SEQ ID NO: 9255 - protein, 81 aa, Terrapene carolina
TKGPVTFEEVAVYFTREEGALLDPTQRALYRDVMQENYETVVFLVGFPISKPDVISQLERGEKPWVLDLQVTYVWILSVSH

SEQ ID NO: 9256 - protein, 81 aa, Terrapene carolina
AGELVTLEEVAVYFTEEEWALLDPGQRALYTAVMRENFETVTSLGFLISKPEVISWLERGEEPWVPDLQGYEEREIPRDAH

SEQ ID NO: 9257 - protein, 81 aa, Terrapene carolina
MPFMTDALNPPCTLIWSDFIPCAGFPIPKPELIAQLERGEEPWVPDLQACKEREILRGTRTGAERGSENEEGNHHEEVEPQ

SEQ ID NO: 9258 - protein, 81 aa, Terrapene carolina
MFPFSWVPHSPAEHRDRFHSQNVLYDRCSLNPPCTLICLISPPPPGFPIPKPELISHLERGEEPWMPDFRACEERESLRCA

SEQ ID NO: 9259 - protein, 81 aa, Terrapene carolina
LVTDALSYPSCTLISSDFPPCAGFPIPKPELISHLERGEELWVPDLQACKEREIPRGARTGAERGSENVEGNHHQEVPGEV

SEQ ID NO: 9260 - protein, 81 aa, Terrapene carolina
ELPFYWPCSPINSVIITGAAGTDWEITLFQGPVTFEEVAVHFTKEVWALLDPAQRALYRDVMQENYENMAWLGKNSCPISY

SEQ ID NO: 9261 - protein, 81 aa, Terrapene carolina
AGFPVSRPDVSSQLERGEEPLVPDLQSSEDREGICTAGDGTVSETREQNSKEEDTEQVELYRASSQRAKGNVPGNCEQGEG

SEQ ID NO: 9262 - protein, 81 aa, Terrapene carolina
MPVTFEEVAVYFTQGQGALLDPAQRALYRDVMQDNYETVTSLGKGFLSPRLLEAEGQCVGLWLSSSLVRSEGNVLCNAQLP

SEQ ID NO: 9263 - protein, 81 aa, Terrapene carolina
LQVPVTFEDVAIYFSREEWEMLAEWQKELYRDVMKEHYDNLISLGHAGTKPDVLSWIEQGGEPWVVDQKEERERLECSSLE

SEQ ID NO: 9264 - protein, 81 aa, Terrapene carolina
VGLLLFQRPVTFEEVALYFTKEEWALLDPTQRALYGDVMQENYENLTQGTLLECLRRNAGVQSEEHKTHSGMFLVLPSGDQ

SEQ ID NO: 9265 - protein, 81 aa, Lithobates catesbeianus
PITVPPTHCLITKRTVEKILEVTKKIIELLTGEVPIRCQDVTVYFSMEEWEYLEGHKDHYKDVMMEDQQMSTLLGKRRLGF

SEQ ID NO: 9266 - protein, 81 aa, Terrapene carolina
SSPVNGRVVTGQQVLSVGLLLFQRPVTFEEVALYFTKEEWALLDPAQRALYGDVMQENYENVTSLGKDSCPLIWEQSKTWG

SEQ ID NO: 9267 - protein, 81 aa, Lithobates catesbeianus
VPIRCQDVSAHFSMEEWEYLEGHKDLYKNVMIDNKPPLTSPDGSSNGNPPERCPRLLYSQDSTQEGHTIPHHHQSGNLRDS

SEQ ID NO: 9268 - protein, 81 aa, Terrapene carolina
PSGLVTFEEVAVYFTREEGALLDPTQRALYRDVMQENYETVVLLGFPVSKPDVISQLERGEEPWVPDLQGSEKEVLPRAAC

SEQ ID NO: 9269 - protein, 81 aa, Terrapene carolina
SGGPVTFEEVAVYFTREEGALLDPTQRALYRDVMQENYETVVFLVGFPISKPDVISQLERGEKPWVLDLQGSEKEVTTWNV

SEQ ID NO: 9270 - protein, 81 aa, Terrapene carolina
MSVTFEDVAMYFSPAEWVLLGEEQKQLYRHVMWENYQTLVSLGIQISKPVVISSIERGEELWAQSPTEDEDEDILSGTSPG

SEQ ID NO: 9271 - protein, 81 aa, Terrapene carolina
FQMPVTFEEVAVYFSEDEWALLDEKQKELYRDVMQENYETLLSLGFPIAKPDVLSQIERGEEPWFPDLQDLGEFTSYLSGS

SEQ ID NO: 9272 - protein, 81 aa, Lithobates catesbeianus
PIRCQDVTVYFSMEEWEYLEGHKDLYKDIMMENQQLLNYVNMKKNLHKRILLLTLEIVCLLTGEDCTVVMKSSIENIIRSR

SEQ ID NO: 9273 - protein, 81 aa, Terrapene carolina
AGFPVYKPYVISQLEGGEEPWVPDLQGSEESEILRSPCTSEETLNQPRNCDGVVRENKEQNPHQEDAQLAEAHGALLRRSK

SEQ ID NO: 9274 - protein, 81 aa, Lithobates catesbeianus
GQISSHSPISVPSLSFLTPERNTDKKILEVTQNIIEVLTGEVPIRHQDVTVYFSMEEWEYIEGHQYLYKDVMMENRPPLTS

SEQ ID NO: 9275 - protein, 81 aa, Terrapene carolina
MRRSGVGAVTHAQRQRSPAAELQPPGFPVSKPDVISQLERGEEPWVTDLHDSEKKVLPRAACAGVGMVSENEENPQQEDAE

SEQ ID NO: 9276 - protein, 81 aa, Podarcis muralis
MLENERNMASRALPLPKTSLIPSAEQAEEPRTPQYQISDGTGAAILDTSSAGNSRRKHFCPECGQCFAFGLALARHQRIHT

SEQ ID NO: 9277 - protein, 81 aa, Podarcis muralis
LTLVTFEDVAIYFCREEWAELIPWQKELYRGVMVENYEAVLSVGKYTAVLWNSVRWWGGRGHGGWSSGPTLVSFAEPISYS

SEQ ID NO: 9278 - protein, 81 aa, Podarcis muralis
WLVCFEDVAVRFTDEEWALLDPDQRALHKDVMEENRGIVASLGKAPCGIVISAWKYKKYLYVTNLIYFHRAQQRPLQHLGT

SEQ ID NO: 9279 - protein, 81 aa, Paroedura picta
VQEVLSSFKVCLGKSFFCSRFFCCCRKYGREAAVLETDQEPVTFEEVAVRFTEGEWALLDPHQKALYRDVMQENYENITSV

SEQ ID NO: 9280 - protein, 81 aa, Paroedura picta
VSFQEVAVFFTWEEWTLLDPAQKALYWEVMRENYEAVASLGDAQDPEKWGQPGEVSSEGDEDLQEEPWDQDGPLRKPKRKR

SEQ ID NO: 9281 - protein, 81 aa, Terrapene carolina
GQAVPVTFEEVAVYFTQGQGALLDPAQRALYRDVMQENYETVTSLGTPSEGITIPLTSPEVCFPQAVSVTMFPSSWIPHSP

SEQ ID NO: 9282 - protein, 81 aa, Terrapene carolina
PLPAPRPRAPWGTPGWGLERMLQVAFEDVALYFTREEWELLSQPEKQVYRDQMLRNYRVLVSLGKYKISHPLLTPTGRNLL

SEQ ID NO: 9283 - protein, 81 aa, Lithobates catesbeianus
VPIRCQDVTVSFSMEEWEYLEGHKDLYKDVMIENRPPLTSPDGSSNRNTPESSPSPLHSWDSTQEQLKVPYENQAEHQNNV

SEQ ID NO: 9284 - protein, 81 aa, Terrapene carolina
ACMPVTFEEVAVYFTQGQGALLDPAQRALYRDVMQENYKIVTSLGFPIPKPELISRLERGEEPWVPDLHEKEEGNHNEEVP

SEQ ID NO: 9285 - protein, 81 aa, Gopherus agassizii
GQGPVSFEDVAVYFTQGQGALLDPTQRALYRDIMQENYETVTSLGKRFPSPRLLEAVGSVMFPFLVFLNQLDFRAMSPMVT

SEQ ID NO: 9286 - protein, 81 aa, Gopherus agassizii
GPVTFEEVAVYFTREEWALLDPAQRALYRHVMQENYKNVTSLGKDSHPLTVGPRFPGLRGKRDPERQLHDKDLVRSLGSGW

SEQ ID NO: 9287 - protein, 81 aa, Gopherus agassizii
LTFEEVAVYFTQEQGALLDPAQKDLYRDVMRENYEAVTSLGKRFPSPQLVEAVQRFNGTVWSRASTGTELVNHLREQVSVQ

SEQ ID NO: 9288 - protein, 81 aa, Podarcis muralis
VCFEDVAVHFTDEEWALLDLDQRALHKEVMEENCGIVASLSKAPLWIITSLWKFHTYLSVISLPDFEGALQGHLHLTSQEI

SEQ ID NO: 9289 - protein, 81 aa, Podarcis muralis
SSVYFEDVSVCFTAEEWALLDPAQRALHKEVMEETWRTMISLEFIRERSPITAWSVERASVSAPVSLLIEEFIQGRNHISA

SEQ ID NO: 9290 - protein, 81 aa, Podarcis muralis
QDMVTFEDVAVSFSPEEWEMMEDWQRELHWEVMMENYRMLISLGNDLYLLSSSGMFWNTSDEENVPAEPQRGPAMGSPETS

SEQ ID NO: 9291 - protein, 81 aa, Podarcis muralis
SGETLGGGEREGMVSQGCSLSFEDVAVPFPGEEWVLLDPDQRALHQGELWDHESLDCCIGLDGESHLLQVSAMQDIQQKNS

SEQ ID NO: 9292 - protein, 81 aa, Alligator sinensis
RKLEEAFEDVAVYFTRKEWELLGDEDKVLYQDQMLRNYHTLVSLGYRGPTPELICRIQQKEVEIWVWNDEDPGESSWSEDL

SEQ ID NO: 9293 - protein, 81 aa, Alligator sinensis
TQLREAFEDVALYFTRKEWELLGDGDKALYRDQMLRNYQALVSLGYEGPIPDLICRIQRGEVELWVCDDYDPGESVQSEGV

SEQ ID NO: 9294 - protein, 81 aa, Alligator sinensis
AGSAQGPVTFREVALYFTDPSQRALYREAMQENHESGSLPGTGSPVPQPEAVSQLKLEENPWVQDLQGCEVREIPSSACTD

SEQ ID NO: 9295 - protein, 81 aa, Alligator sinensis
MRENYDVLMALGSPITKPELVPQIEHAEEPCVQAQGQAEEQEAPGCVNPGSIVPKPEVFPLGEQEQQQQRGGQQRGPEEGN

SEQ ID NO: 9296 - protein, 81 aa, Gopherus agassizii
LVPVTFEDVAVYFSREEWGLLDDMQRTFYRDVMKENYQTVVSLPGSSIPKPDVISQMERGEEPWVPDLQKLGPHQTPENPL

SEQ ID NO: 9297 - protein, 81 aa, Gopherus agassizii
FQGPVTFKEVAMYFTREEGALLDPTQRALYRDVMHENYETVTSLGFPISKPDVILQLERGEEPWIRDLQSSEKEVLLRAAF

SEQ ID NO: 9298 - protein, 81 aa, Gopherus agassizii
TTRPVTFEEVAVYFTRDEWALLDSTQRVLCWDVMQENYENVTSLGKESCPPRFLEGEMQGEGSHHPTMPPLLCPVSASPRR

SEQ ID NO: 9299 - protein, 81 aa, Gopherus agassizii
FQMLVTFEEVAVYFTQGQGALLDPAQRTLYRNVMQENYETVTSLGFAVPKPDLIAQLERGEEPWVPDLQAAEERESQRGTH

SEQ ID NO: 9300 - protein, 81 aa, Gopherus agassizii
PVIFEEVAVKLTRKEWTLLDPTQRALYWDVMQENYKDVTSLGKGSCPSVLGRGNEELRLTPAPRCPLCSVLFQHHPNMPVT

SEQ ID NO: 9301 - protein, 81 aa, Gopherus agassizii
HRPVTFEEVAVYFTREEWALLDPTERALYRDVMQENYENVTSLGKDSHACSGNFQGPYECRECGKTFSQISTLSVHQRIHT

SEQ ID NO: 9302 - protein, 81 aa, Gopherus agassizii
GPVTLEEVAVYFTREEWALLDPTQRALYRDVMQENYENVTSLGKGSCPLCSWKGKRREMEGGLPGEVEKRANCQRLEGRRH

SEQ ID NO: 9303 - protein, 81 aa, Gopherus agassizii
FQGLVTFEEVAVYFTREEWALLDPAQRALYRDVMQENYENVTSLGFPVSKPDVISQLEQKDEPWVSNLHASEEREIPKGAC

SEQ ID NO: 9304 - protein, 81 aa, Gopherus agassizii
LQVAFEDVALYFTREEWELLSQREKHLYRDQMLRNYWALVSLGKDQLRFFLTAVKCLGSLHTSASVIIIKSLLIYTPASEG

SEQ ID NO: 9305 - protein, 81 aa, Gallirallus okinawae
RWQKDLYRAVMRGNYEMLISLGCAVPKPDTLSQLQRGEDEELCVKPSQEPLQMGVREGLESPLTQREAGLESLQPPKETDS

SEQ ID NO: 9306 - protein, 81 aa, Taeniopygia guttata
NFWILRLPPGAKGEVPKEWKSLNEWQKELYRHIMKGNYEAVISMDAAISKPDLLTRIEQGEDPNCFGKCPLPRCFFWMILF

SEQ ID NO: 9307 - protein, 81 aa, Podarcis muralis
ECSGEDVAVCFTDKGWTLLDPDQRAQHKEVKEETRGIVDSLGKAPCWIITWKNKGEHNRIHIAEKSYKYSERGENIRQSSH

SEQ ID NO: 9308 - protein, 81 aa, Podarcis muralis
RLVSFEEVAVYFSKGEWDLLGPCQRALYKEVMLENYANVMFLANQRDKSSSEPLETGQHKAEEEMFGHQRRGNRLEGYRLK

SEQ ID NO: 9309 - protein, 81 aa, Podarcis muralis
TARSQGPVCFEDVAVCFTDEEWALLDPDQRALHKDVMKENCGILASLGKAPCGIVISAWKFKKYLYGTNLIYFHRVQQHPP

SEQ ID NO: 9310 - protein, 81 aa, Alligator sinensis
MEPVTFEMLAVYFTKEQWALLDPAQTALYKEVMLENYATVASLGFLISKPSLISRLEQGEELWVQAWQNYKEREIPGDSSP

SEQ ID NO: 9311 - protein, 81 aa, Alligator sinensis
MLRNYQALVSLAGYRGPAPDLICRIQRGQVELWVRDDEDRGEMRKSEDVLPGHAWLLSRPEEQAPEEGPGKLKPPWASLRS

SEQ ID NO: 9312 - protein, 81 aa, Gopherus agassizii
MPVTFEEVAVYFTEGQGALLDPAQRALYRDVMQEIYEMVISLGFLLPKPDVIIQLERGEEPWVPDLQGSAEREMSRGTCAG

SEQ ID NO: 9313 - protein, 81 aa, Gopherus agassizii
WSRPVTFEEVAVYFTQGQGALLDPGQRTLYRDVMWENYETVTSLGKGTPVPSVITKFWDYKSPGRETLSLPPGWGTIHSEI

SEQ ID NO: 9314 - protein, 81 aa, Gopherus agassizii
FQGPVTFEEVAVYFTREEWALLDPVQRALYRDVMQENYEMVVLLGFPISKPDVISQLERGEEPWVADLQDLKVSCPLIGPL

SEQ ID NO: 9315 - protein, 81 aa, Gopherus agassizii
AGPEVWTLVAVYFTREEWALLDPVQRALYRDVMQENYETVTSLGKEQENDCHPGEAHGMLSGRSKENKPYTCTECGKSFNW

SEQ ID NO: 9316 - protein, 81 aa, Gopherus agassizii
KLGPVTFEEVAVYFTKEEWALLDPSQRALYRDIMQENYEMVTSLGFPIPKPDVISQLERGEEPWVLEEGTFRACFFQSSQK

SEQ ID NO: 9317 - protein, 81 aa, Gopherus agassizii
FQGLVTFEEVAVYFTREEWALLDPAQRALYRDVMQENYENVTSLAGFPVSKPDVISQLEQKDEPWVSNLHASEEREIPKGA

SEQ ID NO: 9318 - protein, 81 aa, Gopherus agassizii
MSVMFEDVAMYFSPAEWALLGEEQRQLYRHVMWENYQTLVSLGEDASQRHRLSPNIHSTILQSHSPSLKPKSSDPGQLQLF

SEQ ID NO: 9319 - protein, 81 aa, Taeniopygia guttata
KAPAVALENDATGFSTQEWENLEEWQKELYGKVLTGKREALVQLDDVISEPALLSRLQGGEAPCSEAEAAPGEIPAEPESL

SEQ ID NO: 9320 - protein, 81 aa, Podarcis muralis
PPLVPNPQSAIPAGTKWYSLVDLCSAKEEWALLDPDQRALHKEVMEENRGIMASLGKAPSWMIISALKFQREREREREIAN

SEQ ID NO: 9321 - protein, 81 aa, Podarcis muralis
PASPQCNFSFQDLVTFEEVAVHFTQEEWALLDPGQRALHREVMEENYEIVTSLGKDAPTPPPPPDTPTVWISLFSPLYIHI

SEQ ID NO: 9322 - protein, 81 aa, Podarcis muralis
MEPWVYLDPRQRALYRDVMQESYETLMSLAADKLLNSNNNEEEEEEEDDEEEEDEGPEELRPGTSQSTPRRVKPVVRRAPP

SEQ ID NO: 9323 - protein, 81 aa, Podarcis muralis
GRKQPGNQEGKTAQSRRSGRGGRMSVCFEDVAVRFTDEEWELLDPDQRALHKDVMEENWGIVASLGKAPLNQVFSSAAVIM

SEQ ID NO: 9324 - protein, 81 aa, Podarcis muralis
GLVSFDEVSVHFTNEEWALLDPGQRALYEEVMEEIREMMTSVGDVSEFLTEGEQSEPSREGAEEQKEQRKQRVQVGTYRKE

SEQ ID NO: 9325 - protein, 81 aa, Podarcis muralis
YSVSFEDVAVCFTAEEWALLDPAQRALHKEVMEETWRTMISLGKVPCWVIISVLEFSRYFSGTNLPYLDGSQRCHLECQGF

SEQ ID NO: 9326 - protein, 81 aa, Podarcis muralis
LTTDGVCFEDVAFHFTHKDWALLDPDQRALQEEVKGVKCGILDSLVRLPAGSSDQFLNSIQISAGQTSAILREPNSASYSV

SEQ ID NO: 9327 - protein, 81 aa, Podarcis muralis
FQSSVSFEDVTVCFTAEEWALLDPAQRALHKEVTEENRGILASLSFILIKGKGSLFYLPISFCWYCFFFPSLGVYHSGSCG

SEQ ID NO: 9328 - protein, 81 aa, Taeniopygia guttata
MRGNYETLVSLDYAVSKPDILSQMERDEELSDKEGQEPPWTQTGDGQEPLRAAEERDKADEAPGDETPMEAAPDGAESTPN

SEQ ID NO: 9329 - protein, 81 aa, Phasianus colchicus
SQEPVSFAEVAVYFSREEWALLDPAQRALYRDVMLETYQCVASLAPLPVPKPAVITLLEGGADPWIPDVCSPEEMAGELSP

SEQ ID NO: 9330 - protein, 81 aa, Podarcis muralis
AQVPVAFEDVVVYFSREEWAQLAEWQKELYQDVMAENYELVSSLECLLSIPELLSRLARGEAPHPAADPPPSAGNADSPAD

SEQ ID NO: 9331 - protein, 81 aa, Podarcis muralis
SSRGCDLSELRLLVAMEQYVLLDPRQKALYHDVMQESYETLMALEFPLSKPDLLSRLEQGDEATTFDLQDPSVILPAISGN

SEQ ID NO: 9332 - protein, 81 aa, Podarcis muralis
GPVCFEDVAVCFTDEEWAFLDPDQRALHKDVMEENCGIVASLDKAPCGIIISAWKFTELNSAPYNPWEPNTPTINSKLQFF

SEQ ID NO: 9333 - protein, 81 aa, Podarcis muralis
LCFEDVAVHFTDEEWVLLDPDQRALHKEVMEENREVMDSLSKTPSCFIISVLILKNQAEGLLGSGTCPVERPPTSCQREKQ

SEQ ID NO: 9334 - protein, 81 aa, Podarcis muralis
LGPVTFEDVTVHFTEEEWALLDPGQRALHREVMEENYRNLASLGDQKESSQENEPQRIKTEAEENVRKDAVVPDGASFNEI

SEQ ID NO: 9335 - protein, 81 aa, Alligator sinensis
AELQKAFEDVAVYFTRKEWALLEDEDKLLYRDQMLRNYQALVFMGHRGPTPDLISRIQQGDAELWVSDGEDSGESSWSEGP

SEQ ID NO: 9336 - protein, 81 aa, Alligator sinensis
LQLREVFEDVAVYFTREEWELLDDDDKVLYQEQMVKNYQALVSLGYRGPTPDLICSIQQGRVDLWTCADEDCGEMSRWEDL

SEQ ID NO: 9337 - protein, 81 aa, Alligator sinensis
AQFQEAFEDLALFFTRKEWELLGDGDKVLYRDQMLRNYQALVSLGYQGPTPDLICRIQRGEVELWVCDDEDSGESASSEGL

SEQ ID NO: 9338 - protein, 81 aa, Alligator sinensis
SKLLEAFEEVAGYFTQEEWELLETGDKGLYQDQMLRNYRALVSLGYQGPTPDLICRIQQGEMELWICDEEAGENLFSEDLT

SEQ ID NO: 9339 - protein, 81 aa, Paroedura picta
VTLEEVSVHFTEEEWALLNPDQRMLYQEVMEDNRQNVAFLGKAASPLSCDSQVLKGEMAPSKKDIVGEWSGSGSHADKRDV

SEQ ID NO: 9340 - protein, 81 aa, Paroedura picta
TQSWVSFEEVAVYFTPGEWALLRPAQRALYKRVMLENFGHLASLGPVTGKPDLISWLEEEEEEEPLLQGCDQVGRSAGSCP

SEQ ID NO: 9341 - protein, 81 aa, Paroedura picta
PVSFEEVVVSFNAEEWALLDPGQRALHREVMVENYGIVASLGDGWNKEAKDDRPGMPRGRGRLQPSGTQRQKTEINALPEP

SEQ ID NO: 9342 - protein, 81 aa, Gopherus agassizii
MPYAGFLVSKPDVISQLEQGEEPWVSDLQGNQPGEKLGKRISSQGTQKDLKETTTRQEIITGKRKNTCIECGKNVCDYSAL

SEQ ID NO: 9343 - protein, 81 aa, Gopherus agassizii
MSVTFEDVAMYFSPAEWALLGEEQRQLYRHVMWENYQTLVSSGEELLMISSIERGEDLCVAYRTLTFSTSPALGPLGVWPL

SEQ ID NO: 9344 - protein, 81 aa, Taeniopygia guttata
HGVPVLFEDVAVRFSRQEWANLSEGQKEMYRSVMEDCALSKPELLLQLEREELSTPPESEAEAAEVSPELAVEPARQNCTS

SEQ ID NO: 9345 - protein, 81 aa, Phasianus colchicus
GRKPLGLEFLSSEPVSFADVATYFSREEWALLDPVQRVLYQDVMLETYECVGFAAFPSLWIETKQPNVNVEEIIPVQFLKV

SEQ ID NO: 9346 - protein, 81 aa, Podarcis muralis
RLGRDRACACFSEQEWRSLDEGQKDLYRHIMKCNYKAVVSMGKEGSTWRGQAELSVMGDLEESEIPGDPAMSKLERPKWGV

SEQ ID NO: 9347 - protein, 81 aa, Podarcis muralis
GSVSFDEVSVRFSNEEWALLDPGQRALYEEVMEEIREMMTSVGDVSEFLTEGEQSELSREGAEEQKEQRKQRVQVGTYRNE

SEQ ID NO: 9348 - protein, 81 aa, Podarcis muralis
RSGVCFEDVAVRFTDEEWALLDPDQRALHKDVMEENRGIVASLGKAPCGIVISAWKYKKYLYGPTSYIFTELNSAPATPGT

SEQ ID NO: 9349 - protein, 81 aa, Gopherus agassizii
WNGPVTFEEVAVYFTREEGALLDPAQRALYRDVMQENYENVTSLAGFPVSKPDVISQLERGEEPWVPDLQELIPSSLLFWG

SEQ ID NO: 9350 - protein, 81 aa, Gopherus agassizii
PVTFEEVAVYFTQGQGALLNPAQRALYRDVMWENYETVTSLGKGFPSPRLLESEKLLGNHPRNKLDESIKCGVGYKDPTTQ

SEQ ID NO: 9351 - protein, 81 aa, Gopherus agassizii
VTFEEVALYFTEGQGALLDPGQRALYGDIMQENYETVTSLAYALFSLSAISLSVFSTREGKPQQECPEQVELQGSILRRAD

SEQ ID NO: 9352 - protein, 81 aa, Gopherus agassizii
LEGPVTFEDVAVYFTREEWALLDPTQRALYRAIMQENYENVTSLGFPVSKPDVISQLEQGEEPWVPDLQGSEEREILRVPL

SEQ ID NO: 9353 - protein, 81 aa, Gopherus agassizii
IPEDMSFEEVAVYFTQAQGALLDPTQRALYKDVMVENYETVTSLGKGFLSPQILEAVGEVKPCSASGITHRRKTAQVLGLW

SEQ ID NO: 9354 - protein, 81 aa, Gopherus agassizii
CGWGMTFEEVAVHFTREEGVLLDPTPRARYRDTMQENNETVTLLGFPIPKPDLIAWLEGWEEPCVPDLQWGRIAQWFEHWP

SEQ ID NO: 9355 - protein, 81 aa, Gopherus agassizii
FQGPVTFEEVAVYFTKDEWALLDSVQRTLHRDVMQENCETVTLLGFPISKPDVISQLERGEEPWVPELQGSEKEVLPRAAF

SEQ ID NO: 9356 - protein, 81 aa, Gopherus agassizii
SEGLEQMRLYLRVPVTFDDVSVYFNEQEWENLDEWQKELYKNVMKGNYETLISLGKDRLGHLGIWGKNQYLVLLVKAGDRI

SEQ ID NO: 9357 - protein, 81 aa, Alligator sinensis
LELQEVFEDVAVCFTRKEWELLEDDDKVLYRDQMLKNYQALASLGYRGPTPDLICRIQQGEVELWVCEDEDGGEIPRSEDL

SEQ ID NO: 9358 - protein, 81 aa, Alligator sinensis
MLRGWRLPWRWPNLAMEPYVLLDPRQRALYRDVMQESYETLMALEFPISKPDLLSRLDHGDEPTALDLHVPKGARAAEGAT

SEQ ID NO: 9359 - protein, 81 aa, Alligator sinensis
MELREAFEDVAVYFTRKEWELLEDEDKELYRDLMLRNYQALVSLGYQGPTPGLICRIKQREVELWVCDDEHHGESSVSENL

SEQ ID NO: 9360 - protein, 81 aa, Alligator sinensis
QSLVPVTLEDVALDFSLEWVELAAWQQDLYWDVMRENHTLVASLGYPALEPALFSHAERGEEPGAGEQLDPAGADIPWDPC

SEQ ID NO: 9361 - protein, 81 aa, Alligator sinensis
LQVCVSFEEVAVYFTKEQWALLDPSQRALYRGVMLENYEAVTSLGFPVPNTSLISWLEQGEELWVTDLQDSKEWEIPRNTC

SEQ ID NO: 9362 - protein, 81 aa, Alligator sinensis
LELREVFQDVAVYFTRKEWELLEDEDKGIYQDQMLRNFQALVSLGHRGPTPDLICRIQRGLVELWVCDDEDGGEISRSEEL

SEQ ID NO: 9363 - protein, 81 aa, Alligator sinensis
MELREAFEDVAVYFTREEWELLEDAQKGLYRDQMLTNCRALVSLGYRGPMPDLILCMQRGQEELWVSDEKDHGDISRLEDL

SEQ ID NO: 9364 - protein, 81 aa, Alligator sinensis
LQLREVFEDVAVYFTREEWELLDDEDKVLYRDQMLKNHQALVSVGYRGPTPDLICSIQQEQVELWVCDDEDRGEISRWEDL

SEQ ID NO: 9365 - protein, 81 aa, Alligator sinensis
MQENYETLISLAEEMAISLPRITALAESHRRGLVSAGFPISKPDLLSWMDRGDEPWVPDLQASEGTEIPRDASPAGDGSAS

SEQ ID NO: 9366 - protein, 81 aa, Alligator sinensis
PQVPVTFDDVSVYFSEEEWESLAGWQKELYKNVMKGNYETLVSLDYAISKPDLLSRIERGETPCIGEQVDGEVPVEPSTVV

SEQ ID NO: 9367 - protein, 81 aa, Gopherus agassizii
GGPVTFEEVAVYFTREEGALLDPTQRALYKDVMQENYETVTSLGKGSCPLGAPSLPTEGLDGMRTGPALGKWHLGRTCILV

SEQ ID NO: 9368 - protein, 81 aa, Gopherus agassizii
SLFVPTPWCFQDALSSWGWDSVDCSPPTVLSVGCLLFQGPEEWALLDPAQRALYRAIMQENYENVTSLGKDSCPLCSWKGK

SEQ ID NO: 9369 - protein, 81 aa, Gopherus agassizii
MAGPVTFEEVAVYFTREEGALLDPAQRALYRDVMQENYENVASLGKDSRPLEDAMVSEDEEQNPQQEDGEHMEAHGGLSQG

SEQ ID NO: 9370 - protein, 81 aa, Gopherus agassizii
FQGPVTFEEVAVYFTREEWALLDPAQRALYRDVMQENYENMTLLGLPISKSDVISQLEKGEEPWVPDLQESEEQEILRGAC

SEQ ID NO: 9371 - protein, 81 aa, Gopherus agassizii
VYFTQGQGALLDPAQRALYRDVMQENYEMVTSLGKRFPSPWLLEVLPKSLRLRPHSIWEVGFPAQGDLHALDREKPYKCLV

SEQ ID NO: 9372 - protein, 81 aa, Gopherus agassizii
FQIPVTFEEVAVYFTQGQGALLDPAQRALYRDVMQENYETVTSLGFPIPKPDLIARLERGEEPWVLDLQASDESVSLRGTC

SEQ ID NO: 9373 - protein, 81 aa, Gopherus agassizii
FQMPVTFEEVAVYFTQGQGALLDPAQRALYRDVMQENYETRLLRNYSREQMDEFIICGEGYRDPTAQQTTPKEDKHHEWFG

SEQ ID NO: 9374 - protein, 81 aa, Gopherus agassizii
MSGLVSFEEVAVYFTAGQGALLDPAQRALYRDVMQENYENVSSLGCPASKPDVISQLERGEEPWIPDLQGCEEGEIPRGAC

SEQ ID NO: 9375 - protein, 81 aa, Gallirallus okinawae
MQEPVTFEDVAVYLSRAEWDAMAEGQRELYRSVMLDNYNLLTSLGYSGPKPDLLHRLERGEEPWVCTPQSPGRWDGPDSPS

SEQ ID NO: 9376 - protein, 81 aa, Phasianus colchicus
FPCFVLGTHFAQVAVYFSREEWALLDPAQRALYRDVMLETYQCVASLGEAPELVLASRHQPWRAEPSPCKQPLCSCITRCH

SEQ ID NO: 9377 - protein, 81 aa, Phasianus colchicus
GWGFAQVAVYFSREEWALLDPAQRALYRDVMLETYQFLISPVSLIEAPLPAPKPMVISLLEGGEDPWIPDARSSGALLGDL

SEQ ID NO: 9378 - protein, 81 aa, Phasianus colchicus
GRKGEVPKVPVTFDDVSVYFNDKEWEKLEEWQKELYKNVMKGNYESLISLGAHQEPEWAQQRGQHCGKQPGAAGTPGGDCW

SEQ ID NO: 9379 - protein, 81 aa, Gopherus agassizii
FQGRVTFEEVAVYFTREEWALLDPAQRALYWDVMQENYETVVLLGFPISKPDVISQLERGEEPWCPSIKREIKTTQETTDQ

SEQ ID NO: 9380 - protein, 81 aa, Podarcis muralis
EVTFEDVTVSFSREEWSMLDGWQKDLHQEVMLENFTLLLSVGKAWCATVALVERATLPPYFGVAPVSRRIQRKAEHPHHYI

SEQ ID NO: 9381 - protein, 81 aa, Podarcis muralis
SVSFKEVTVNFTDEEWALLDPGQRALYGEVMLEILPPETAEEQRKLGVQDGTSTQEGRQMQKAGSESAASQVYGNQITREE

SEQ ID NO: 9382 - protein, 81 aa, Alligator sinensis
PKVPVTFDDVSVYFNEKEWEKLEEWQKELYRNVMRSNYESLISLDYAISKPGALSQVEQGRESSIGDQQDLEEREIITDPS

SEQ ID NO: 9383 - protein, 81 aa, Alligator sinensis
AAGSAQGPVTFREVALYFTDPSQRALYREAMQENHESGSLPGSPVPQPEAVSQLKLEENPWVQDLQGCEVREIPSSACTDE

SEQ ID NO: 9384 - protein, 81 aa, Alligator sinensis
TELREAFEDVAVYFTREEWGLLEDAQKGLYRDQMLRNCRALIFLGYRGPAPDLIHRMQRGQEELWVSDDEDCGDISRSEGL

SEQ ID NO: 9385 - protein, 81 aa, Alligator sinensis
LELWEVFEDVAVYFTLKEWELLDDDNKALYQDQMLKNYQALVSLGYQGPTPDLICSIQEGQVELWVCDGEDHGEISRSEDL

SEQ ID NO: 9386 - protein, 81 aa, Alligator sinensis
VVLLEAFEDVAVYFTQKEWALLDDGDKALYRDQMLRNYQALISLGYRGPTPALINRIQRGEMELWVCDKDYGEKSSLEGLF

SEQ ID NO: 9387 - protein, 81 aa, Alligator sinensis
GGGPGRFEEVALRFTRAEWRLLGDGDKALYRDQMLRIYEALVCLGYQGPTPDLIGRIQRGEMELWVCDESPGENSWSEGHL

SEQ ID NO: 9388 - protein, 81 aa, Alligator sinensis
PKVPVMFNDASFNFSEQEWKNLNEWQKELYRHIMKGNYEAVISLDAAISKPDLLSRIEQGDDPSDGDQGDFEGRETPRDPN

SEQ ID NO: 9389 - protein, 81 aa, Alligator sinensis
SKLLEAFEDVAVYFTREEWELLEASDKGLYQDQMLRNYQALVSLGYRGPTPDLICRIQQGEMELWIRDDEEARESSLSEDL

SEQ ID NO: 9390 - protein, 81 aa, Paroedura picta
RLQPRAKRDAEAAAAAAMPRRPAPVTFEDVAVYFTEGQWALLDPEQRALYKEVMQENYSSLASLGKGPSQCTSWIYGFLQV

SEQ ID NO: 9391 - protein, 81 aa, Paroedura picta
TLLNRRPGRDVGRAVVLPVQSPVSFEEVAVDFTEAEWALLDLGQRALYREVMLENYRSVAFLRDHQGDEEEEELHHLSPGE

SEQ ID NO: 9392 - protein, 81 aa, Paroedura picta
CPFSFEEVAVRFTEAEWALLDPGQRALCEEVMLENHENLAFLARSMRETVAETDNGLASEERLESFSRGSQEHISFPDVLA

SEQ ID NO: 9393 - protein, 81 aa, Paroedura picta
VQGPVFFEEVAVHFSPGEWSLLHPAQRALYKEVMLENFGNMASLGPGMAKPDLISWLEGEEELFSPFSGEEEGLAAKRMRR

SEQ ID NO: 9394 - protein, 81 aa, Paroedura picta
GPFSFGEVAVSFTEAEWALLDPGQRALYKEVMLENYGDLAFLAEDDQGNEESAKFGQQFPDGVKTKDFKDKVVNQGASKGS

SEQ ID NO: 9395 - protein, 81 aa, Paroedura picta
GPFYFEEVAVSFTEAEWALLDPGQRALCEEVMLENYGDFSFLEARSIRETLVETDNGLASEEKLEKYSRASQEHISFPSEL

SEQ ID NO: 9396 - protein, 81 aa, Paroedura picta
FSLEDVSVSFSPAEWALLDPAQRALWREVMRENAENVAFLARSIGETLVEANNDPVSEGRLERSSGGAEEQISFPNGLAKR

SEQ ID NO: 9397 - protein, 81 aa, Paroedura picta
SGPPVSFEEVAVFFTREEWALLDPAQRALYWEVMQENYETAASLGLCVPGPFLDSGQHARDTPFRQSSEKSGRCAVNSFSG

SEQ ID NO: 9398 - protein, 81 aa, Paroedura picta
MENYELVTSLGYPVLKPDLLSRIERAGEPCLGDQLDSARGIPQDPCPGYRFFKPEGLSWIERWEELGIADRQKVEEGKLCT

SEQ ID NO: 9399 - protein, 81 aa, Paroedura picta
PVSFEEVAVFFTEEEWILLDPSQRALYWDVMQENYETAAYLAGWLEEDEEGEPTLGSLSHLQLNRIVWGSDEVSFPRGEGQ

SEQ ID NO: 9400 - protein, 81 aa, Paroedura picta
MQGPVSFKDVAVYFTKKEWALLDPHQRGLYREVMRENYRMAMSVGCRDSTPTLISWLKEKALFLPSATEVTQSEDDVWGSQ

SEQ ID NO: 9401 - protein, 81 aa, Paroedura picta
FPLSKPDLLSWMDRGEDLWAPDLQASEGSEILKEASPGDDLRRKNEGGLPHPEAPGKTEQRAKSSLEGNPVEGESQPADRL

SEQ ID NO: 9402 - protein, 81 aa, Podarcis muralis
PLLCFEDVAVRFTDEEWAYLDSDQRALHKDVMEENCGIVASLDKAPCGIIISAWKFTELNSAPYNPWEPNTPTINSKLQFF

SEQ ID NO: 9403 - protein, 81 aa, Podarcis muralis
GSMSFAGVSLHFTDEEWSLLDPGQRALYNEVMMEIYEMVASVGDVWRILVEGDPSEGPPERAEEQQKLRIQDGTNRQEGRR

SEQ ID NO: 9404 - protein, 81 aa, Podarcis muralis
SGDLHRGRVSVCFSEEEWGNLDEDQRELYKNVMKGNYESLVSLGKENPKATKPEGLACVDGQTSGGSLEEPAACGSDFADF

SEQ ID NO: 9405 - protein, 81 aa, Alligator sinensis
SEPVQVKTGQSRPPKQEESWELREVFEDVAVYFTRKEWKLLEDEDKVLYQDQMLRNYEALVSLGKALVLASPWSYGSSGVL

SEQ ID NO: 9406 - protein, 81 aa, Alligator sinensis
LELWEVFEDVAVYFTRKEWELLEDENKVLYQAQVLKNYQALVSLGYRGPTPALICSIQQGQVELWVCDDEDHGEISRSEDP

SEQ ID NO: 9407 - protein, 81 aa, Alligator sinensis
AQELVTFEDVAVYFTKEQWALLDPSQKALYRDVMLEHYETVASLAGFPIPKPEVISQLEQGKDPWIPGLQGSEGRKIPGML

SEQ ID NO: 9408 - protein, 81 aa, Paroedura picta
GWVTLEEVSIHFTEEEWALLDLDQRRLHQKVMEENRQTVASLEVDGPQNKSVEEPKHHVLEKIQQKRISREKMLSRCRPST

SEQ ID NO: 9409 - protein, 81 aa, Paroedura picta
KETLQRSEFESRRQSSRARVWTSSSLGGRAETPKMRPAQGPVSFEEVAVRFTKAEWGLLNPDQRALYREVMVENYGNVAWL

SEQ ID NO: 9410 - protein, 81 aa, Paroedura picta
GVVTFEDVAVYFSEEEWALLDVGQKNLHREVTVENCGILASLERESQQGGKPPHQHKSSQENFTSRQLDSKHLLGGKGMFL

SEQ ID NO: 9411 - protein, 81 aa, Podarcis muralis
RGQVTLDDVTVSFSPEEWAGLQEWQRRLHRDVMRENYELLASLGCDLRVKDEEGESGEEDGRGLFSEMVLRRWKPEGKTSR

SEQ ID NO: 9412 - protein, 81 aa, Alligator sinensis
LELREVFEDVAVYFTRKEWELLKDEDKVLYQDQMLRNFQALVSLGYQGPTPDLICCVQQGQVELWVCDEDDGEISRSEDLL

SEQ ID NO: 9413 - protein, 81 aa, Alligator sinensis
SKLPEAFEDVAVYFTRKEWELLEAEDKGLYRDQMLRNYQALVSLGYRGPTPDLICRIQRGEMELWVSDDEEAGESSLSEDL

SEQ ID NO: 9414 - protein, 81 aa, Paroedura picta
GVSFEEVVVSFTEEEWTLLDPGQRKLYWEVMQENYETVVSLGNYNSQKGLGAPQWSTLSFLGDDREKEISGEGEGNIRNSK

SEQ ID NO: 9415 - protein, 81 aa, Paroedura picta
AQVAFEDVAVYFTEEQWALLDHSQRALYRDVMQENYETVASLGLPIPGPDSISRLQQREESRIEAQPVLEGNDVSSDDDLG

SEQ ID NO: 9416 - protein, 81 aa, Paroedura picta
GVERALEPSPLQAEGRRAAMPSAQGGVSFEEVAVYFSPGEWSLLRPAQRALYKEVMMENFGIVASLGEDLSLRLAQRNDAS

SEQ ID NO: 9417 - protein, 81 aa, Paroedura picta
GAPVSFEEVAVFFTEEEWALLDPDQRALYQEVMEENYEMVTSLAAGMRETKSEGETGGGSSGRDKSPEFEEETGSRERATK

SEQ ID NO: 9418 - protein, 81 aa, Paroedura picta
MRGLVTFEDVAVYFTKEQWALLDPDQRTLYREVMLENYENVAMLGVQAVKPDLVSRLEQGQEPWVSDSPAKNGRKISDATS

SEQ ID NO: 9419 - protein, 81 aa, Podarcis muralis
ECSSDDVAVCFTDKAWMLLDPDQTAQHKEVKEENCGIVESLGKAPCWIIISVLIGDGVDSRTQSEKYPSQIKFFLYHKHSL

SEQ ID NO: 9420 - protein, 81 aa, Podarcis muralis
FPPPSPPCFEDIAVHFTDEEWALLDPDQRALHKEVMEENGGIMNSLSKAPCWIISLSEFKIPWEESGRVSCSHTYSANLAS

SEQ ID NO: 9421 - protein, 81 aa, Alligator sinensis
LELREVFEDVAVYFTQMEWELLEDEDKVLYQDQMLRNFQALVSLGHQGPTPDLIHRIQRGQVELWVCDDEDSGEISRSEDL

SEQ ID NO: 9422 - protein, 81 aa, Alligator sinensis
ALLREAFEDVALYFTQKEWELLEDRDKMLYQDQMLRNYQALVSLGYQGPAPDLICRIQRGEVELWVYEDEGHGERTWSEGL

SEQ ID NO: 9423 - protein, 81 aa, Alligator sinensis
QELREVFEDVAVYFTRKEWELLEDEDKVLYRDEMLKYYEALISLGYQGPTPDLICRIQQGQVELWVCEDEDGGEISRSEEL

SEQ ID NO: 9424 - protein, 81 aa, Alligator sinensis
QQLQEVFEDVAVYFTRREWELLDDDDKVLYRDQMLKNFQALVSLGYQGPTPDLICSIQQGQAELWISDDEGGGEISRSEDL

SEQ ID NO: 9425 - protein, 81 aa, Alligator sinensis
GQVPVAFEDVAVYFSAEEWAELAGWQRELYREVMKENYELISFLGCPSTKPELICQLEKGEELYVWDPQGWRAGCRPPDTW

SEQ ID NO: 9426 - protein, 81 aa, Alligator sinensis
LELLDAFEDVVLHFTRKEWELLEDEDKVLYRDQMLRNYQALISLGYRGPTPDLIRRIQRGEVALWVCEDEDRGEISRSEDL

SEQ ID NO: 9427 - protein, 81 aa, Alligator sinensis
GALLLFQGPVTFEEVPTYFTEGQWDLLDPHHRILYRDVIGFPVPKPSVISKLERGEELWVLDLQGFGKREIPRGACTGEGT

SEQ ID NO: 9428 - protein, 81 aa, Alligator sinensis
MQENYETLISLAEEMAISLPRITALAESHRRGLVSGFPISKPDLLSWMDRGDEPWVPDLQASEGTEIPRDASPAGDGSASE

SEQ ID NO: 9429 - protein, 81 aa, Alligator sinensis
VQMLVTFEEVAVYFSEVEWTLLDPSQKALYRNVMQENYETVTSLGLLISKPDVVSQLEQGEDPWVLDLQGSEEKKPLSWTH

SEQ ID NO: 9430 - protein, 81 aa, Alligator sinensis
MAQDLDSDHREEMAISLPRITALAESHRRGLVSGFPISKPDLLSWMDRGDEPWVPDLQASEGTEIPRDASPAGDGSASENE

SEQ ID NO: 9431 - protein, 81 aa, Alligator sinensis
AKGEIPKVPVMFNDASFNFSEQEWKNLNEWQKELYRHIMKDAAISKPDLLSRIEQGDDPSDGDQGDFEGRETPRDPNMGFP

SEQ ID NO: 9432 - protein, 81 aa, Paroedura picta
QCPLSSFEDVAVYFSEAEWALLDPGQRALYREVMLENYGSVASLEGNQGTEEDNEMHRLLPEEVKAADLGGNFSHRVEKRD

SEQ ID NO: 9433 - protein, 81 aa, Paroedura picta
QVAFEDVAVYFTEEQWALLDQSQRALYRDVMQENYETVASLVITVVKEEDFWVPVNPYSKESKASPGPVKEEEEQTLLSED

SEQ ID NO: 9434 - protein, 81 aa, Paroedura picta
VQGPFSLEEVSVSFTEAEWALLDPGQRALHGEVMREISQDLAFLEEARSKRETLVETDGGLVAQERLPGSSRGLRGQVSFR

SEQ ID NO: 9435 - protein, 81 aa, Podarcis muralis
MRPETQPVCFEDVTIRFTDEEWAFLDPVQRALHKDVMEDTRGVVASLGKAPSGIIISAWKFKTYLYGTNLIYFHRAQQRPL

SEQ ID NO: 9436 - protein, 81 aa, Podarcis muralis
PKVPVTFGDISVHFDAQEWANLDEGQKELYKGVMRSNYEMLVSLDYAVAKPEILTRIEQGEELCEKGLGDSEGSGVPEQLD

SEQ ID NO: 9437 - protein, 81 aa, Podarcis muralis
GSVSFDEVSVRFTNEEWALLDPGQRALYEEVMEEIREMMTSVGDVSEFLTEGEQSELSREGAEEQKEQRKQRVQVGTYRNE

SEQ ID NO: 9438 - protein, 81 aa, Alligator sinensis
PKVPVAFDEASVQFPREKWENLEDWQKELYKNALKGSYEPSISVDHTISKPDILSRVEPGEEPHIREQQDLEVREVPTGPS

SEQ ID NO: 9439 - protein, 81 aa, Alligator sinensis
AQDPVSFEDVAVYFTEGEWVLLGASQRALYWEVMRDNYEAVALLGFPIFKPVMIAQLEQGEEPWVPSPPGADHQVEMVPRD

SEQ ID NO: 9440 - protein, 81 aa, Paroedura picta
VQGPFSLEEVSVSFTEAEWALLDPGQRALHREVMREISQDVAFLAKEARSPRETLVETDKGLAGQEFLANSSRGSRGQVSF

SEQ ID NO: 9441 - protein, 81 aa, Paroedura picta
AQGLVTFEDVAVYFTARQGALLDPEQIALYKEVMMENFGNVASLGFPIAKPDLISHLEEGEVPWVPDGKESDSNSGDLTEE

SEQ ID NO: 9442 - protein, 81 aa, Phasianus colchicus
SSEPVSFAQVAVYFSREEWALLDPAQRALYRDVMLETYQFSWGLIVFSTLIKAPELVLASRHQPWRAEPSPCKQPLCSCIT

SEQ ID NO: 9443 - protein, 81 aa, Phasianus colchicus
TEPVSFAQVAVYFSREEWALLDPAQRALYRDVMLETYQCVASLGEGFAAFPPFERKQTNCFKGNQGERFKKSLGNYPGKRA

SEQ ID NO: 9444 - protein, 81 aa, Phasianus colchicus
MPGEREVAVYFSREEWALLDPAQRALYRDVMLETYQCVASLGEGFAFHGAGISHGGQNHLPANSPCVLALHGATRKRARNP

SEQ ID NO: 9445 - protein, 81 aa, Podarcis muralis
LETAQCSVCFEDVAVRFTDKEWALLDPDQRALHKDVMEENCGILASLGKAPCGIIISAWKFKKYLYGTNLIYSQRAQQRPL

SEQ ID NO: 9446 - protein, 81 aa, Paroedura picta
VQFSLEEVSVSFSAAEWALLDPGQRALCKEVMLENCENVAFLAGNYRRNEEGEELHQQLLDRFKNEVTKENARNRGRPNEK

SEQ ID NO: 9447 - protein, 81 aa, Paroedura picta
AQGRLSFEEVAVYFTEEQWTLLSPPQRAVYKEVMLENFGNVASLGLAIAKPDLILWLEGGRGGGGGELFGNGFDVVGGWAD

SEQ ID NO: 9448 - protein, 81 aa, Paroedura picta
SRVFLQKWLMYFAEIQWALLDPCQRPVYRDIVQDNYGTLLSLDTGTMNPNPHPAGAENTQAPKELPGRSEGSLYLSPPGHQ

SEQ ID NO: 9449 - protein, 81 aa, Paroedura picta
RQSRTSFEEVAVCFTEAEWALLDPGQRALYEEVMLENDEALASLGELEVSKPDLIAWLEESRRAEAGGEGEDTAGSLWECD

SEQ ID NO: 9450 - protein, 81 aa, Paroedura picta
PQVQVRFEDVMVRFSEEELGLLEKWQQDLYVEVLTDIYESLIIIGNPVTYSDFIAWWKQGEQQNCPGSQESRAVDSSANEG

SEQ ID NO: 9451 - protein, 81 aa, Paroedura picta
TQGLVPFEEVAVYFTPGEWALLHPAQRALYKRVMLENFGNVASLGLLIAKPALIAWLEEEEEEEPFLLASAEEERWAVGQT

SEQ ID NO: 9452 - protein, 81 aa, Paroedura picta
LRKELVTFKEVYVYFTEEEWALLDREQRALFIEVMLENYGIVASLGLVPNPDLVFRLKEEEELVGARWGRRGHSAADGERS

SEQ ID NO: 9453 - protein, 81 aa, Paroedura picta
AQRPVTFEDVAVYFSEAQGTLLDPDQKALYREVMMENYENVASLGSLTPKPELIIRLERGEEPWVSDPGDAPVSGDFRKSH

SEQ ID NO: 9454 - protein, 81 aa, Paroedura picta
APVTFEDVAVYFTEGEWALLDPEQRALYKEVMQENYNIVVSLDTNAGNPVPKPDLICRLEGGEMLWLPDPPKITERQVASH

SEQ ID NO: 9455 - protein, 81 aa, Paroedura picta
PAVQCPVSFEEVAVHFTKAEWALLDPGQRALYVEVMLDNAGSVASLEGRDVRVITVETEEGKESFSRGSQQNVSFPRDPAA

SEQ ID NO: 9456 - protein, 81 aa, Paroedura picta
VWDPVTFEEVAIYFSPEEWEELAGWQKQLYKDVMRDNYETFVSLGLAAPKPDIILQIEQGEELCTGGLREPKANIVPSQDF

SEQ ID NO: 9457 - protein, 81 aa, Paroedura picta
EEPASGQPAQRLVSFEEVAVYFTEEEWALLEPCQRVLYREVMLENYGMVFSVEGLCSSMPHLLAQRRVPLSPELCRRPLEE

SEQ ID NO: 9458 - protein, 81 aa, Gopherus agassizii
LNMPVTFEEVAVYFTQGQGALLGPTQRALYRDVMQENYETVTSLGFPLPKPDLITRLERGEEPWIPELQACEERESLRCTC

SEQ ID NO: 9459 - protein, 81 aa, Gopherus agassizii
MELLFEVAVYFTREEWALLDPTQRALYRDVMQQNYENVTSLAGFLVFQHDVISQLEQGGEPWVPDLQGSEEREILRSPCTG

SEQ ID NO: 9460 - protein, 81 aa, Gopherus agassizii
GSARSPVTQLVGLWLEQEALNGRFLLFQEPVTFEEVAVYFTKEQWALLVPGQRALYRDVMQENYEAVASLGKDSCPLGYSL

SEQ ID NO: 9461 - protein, 81 aa, Podarcis muralis
MENYELVTSLGYPVLKPDLLSRIERAGEQCVGDQLDSSRGIPTDPCPGYRFFKPESLSWIERWEELGVTDRQKLEEGKLCT

SEQ ID NO: 9462 - protein, 81 aa, Podarcis muralis
NFWILRLPPGVNGEAPKEREKMEDWQKELYKKVLKGNCEYLISLDYAISKPDILSRIERGEDLGPGEQQDADSRENLGDAS

SEQ ID NO: 9463 - protein, 81 aa, Alligator sinensis
VQLRAVFEAVAVYFTRKEWELLEDEDKVLYRDQMLKIYQTLVSLGYRGPTPDLICSIQLGQVTLWHYDDEDSGENSRSEEL

SEQ ID NO: 9464 - protein, 81 aa, Alligator sinensis
MTFEEVAIYFNKGEWALLDATQRSIYKDVMQENYETVVSLTPEVAVPKPVVITQLEQGEEPWVEDLQKSTERENLQDICPG

SEQ ID NO: 9465 - protein, 81 aa, Alligator sinensis
MLRNYRALVSLGYQGPTPDLICRIQRGEVELWAHDDEDPGESAFFEGLSPGLWQCHSFQQCLLSPSSENLSLTHLGEGEDS

SEQ ID NO: 9466 - protein, 81 aa, Alligator sinensis
MQENYETLISLEEMAISLPRITALAESHRRGLVSGFPISKPDLLSWMDRGDEPWVPDLQASEGTEIPRDASPAGDGSASEN

SEQ ID NO: 9467 - protein, 81 aa, Alligator sinensis
SPFLTLLLPLPFVSTPRPDAPGMATATLDQLPEAVEDVSVYFTREEWELLEDEDKELYRDQMLRNYQVLVSLGNMVLVFLI

SEQ ID NO: 9468 - protein, 81 aa, Paroedura picta
GKGLVLFEDVAVCFSPEEWALLTAWQRDLHQEVMEANFELVASLGSQMHPKPALLCKTKQGEELYAMDLPGQGGEVARGPP

SEQ ID NO: 9469 - protein, 81 aa, Paroedura picta
AQAGVSFEEVAVHFSPGEWSLLQPAQRALYKEVMLENFGHVASLGPPGATPDLIAWLQEGLFLLGGDEEAGSAGDAWRSAT

SEQ ID NO: 9470 - protein, 81 aa, Paroedura picta
CPGLVTLEEVSVHFTVEEWSLLDPDQRRLHQEVMEENRQNVASLGGLLGPSPDSISPEGETVEPSVQEADEAERFTGADGP

SEQ ID NO: 9471 - protein, 81 aa, Paroedura picta
SGVSFEEIVVSFTEEEWTLLDPDQRKLYWEVMQENYETVVSLGNYSSQKNLGAPKSFTLSFLGDDRVLFTLEGEGNFRNSE

SEQ ID NO: 9472 - protein, 81 aa, Paroedura picta
MPQVPEAFVEVTVRSSEGQCSLMGRRQRVLYKNIMQANSVASLGGFPVSTAELLTRLERGEEAWVPDLHSSDESADEGPVK

SEQ ID NO: 9473 - protein, 81 aa, Podarcis muralis
SQATVRFEDVILYFSRSEWKSLAKWQKELYWEVLTDNYEALLVAGQPVTKAEVVAWLEQCERLDIERTQESRVRDPAANVS

SEQ ID NO: 9474 - protein, 81 aa, Podarcis muralis
MEVSAASGDGSAPFSREKWERLEDWQRELYKNVAKGNGESLISLGKEQGRLSVGSLSRWQQEPPEGPRRWISVSGQNDGGG

SEQ ID NO: 9475 - protein, 81 aa, Alligator sinensis
LQLREVFEDVAVYFTREEWELLDDEDKVLYRDQMLKNYQALVSLGYRGHTPDLISSIQRGQMELWACDDEDRGEISRWEDL

SEQ ID NO: 9476 - protein, 81 aa, Alligator sinensis
LEGLVTFEEVAVYFTKDQWALLDPDQRALYRDVMLENYETVASLGFLTSKPDVVSQLEEGDAPWVPDCQECEERRSLRHTS

SEQ ID NO: 9477 - protein, 81 aa, Alligator sinensis
SKLPEAFEDVAMYFTRKEWELLEAGDKGLYRDQMLRNYQALVSLGLQGPAPDLICRMQLGEMELWVCDDEEAGESSLSEDF

SEQ ID NO: 9478 - protein, 81 aa, Alligator sinensis
PVTFEDVAVYFSPEEWKELVEWQKELYWDVMKENYELVTSLVDDGLTNESLEEKSREEEVESLPIQPFLAKLKEKVPQSPA

SEQ ID NO: 9479 - protein, 81 aa, Alligator sinensis
MELREAFEDVAVYFTREEWELLEDAQKGLYRDQMLRNWRALVSLGYRGLTPDLICCIVRGQEELWVCDDEDRGDISKLEDL

SEQ ID NO: 9480 - protein, 81 aa, Alligator sinensis
PKVPVTFDDVSVYFNEQEWERLDEWQKELYKNVMKGNFETLISLDYSVSKPDILSWTERGEEPCIKDQQDLKEREIPSFPD

SEQ ID NO: 9481 - protein, 81 aa, Paroedura picta
MQAQEGAQDALSCEWALLDPGQRALYREVMLENYESVKSLGAQSIRWTLDNRLASEEGLESFSGGSQEQISFPNEPAETET

SEQ ID NO: 9482 - protein, 81 aa, Paroedura picta
TQDEAAHRHAVSPQKAETLLPEQRSSYTAMETTGRRPAQGPVSFEEVAVFFTGEEWALLDPCQRALYRQVMLENYGMVVSV

SEQ ID NO: 9483 - protein, 81 aa, Paroedura picta
PKVPVTFDDVSVYFNEKEWEKLEEWQKELYKNLMKGNHESLISLDYAISKPGVLSQSEPRADSCLGDEQDSEEPGSLPNPT

SEQ ID NO: 9484 - protein, 81 aa, Paroedura picta
QDALSSVTGGGEGLLSCHLFRHVETAAARPVLGLPSFSLEDVSVSFSPAEWALLDPGQRALWREVTRENAENVAFVGEDLS

SEQ ID NO: 9485 - protein, 81 aa, Paroedura picta
KMPVTFVDIAVYFSAEEWKNLAEWQKDLYSNLVKENYESLLSQGVDINISKPEAQQRIQRSTEPCVPEQPNSKDREVAADP

SEQ ID NO: 9486 - protein, 81 aa, Paroedura picta
PSGPAVSFEEVAVFFTREEWALLVPAQRALYWEVMRENYETAASLGLWVPGPFPNLQDHAREMWFLQSSEKSGRRAGTPWP

SEQ ID NO: 9487 - protein, 81 aa, Terrapene carolina
MPVTFEEVAVYFTQAQGALLDPGQRALYRDVMQENYETVTSLGFPIPKPDLIARLERGEELWVPDLQATEERENPRGTRTG

SEQ ID NO: 9488 - protein, 81 aa, Terrapene carolina
DGGPVSFEEVAVYFTAGQGALLDPSQRALYRDVMQENYENVTLLGCPVSKPDVISQLERGEEPWVPDLQVRRRSRILSRKI

SEQ ID NO: 9489 - protein, 81 aa, Terrapene carolina
FEPGTFCEVAVYFTREEGALLDPTQRALYRDVMQENYETVVLLGFPVSKPDVISQLERGEEPWVPDLQGSEKEVLPRAACT

SEQ ID NO: 9490 - protein, 81 aa, Terrapene carolina
VSACMPVTFEEVAVYFTQGQGALLDPAQRALYRDVMQENYKIVTSLGFPIPKPELISRLERGEEPWVPDLQSYKDPTTQQT

SEQ ID NO: 9491 - protein, 81 aa, Terrapene carolina
FQGLVTFEEVAVYFTREEGALLDPTQRALYRDVMQENYETVVLLGKESFSKPDVISQLERGEEPWVPDLQGSEKERPEENF

SEQ ID NO: 9492 - protein, 81 aa, Microcaecilia unicolor
AQVRVTFEDITVSFSQEEWEYLDEGQKELYREVMKENYQTLISLGYEKINPEILSNIKQEEESYVQDPQESGEREVTHLYP

SEQ ID NO: 9493 - protein, 81 aa, Microcaecilia unicolor
QVPLTFDDVAVYFTLDEWRKLEDWQKELYKTTMQENYDSLESMVLAILERLEKRIARMEHHQIFFLTHLFKHLKPATLEKD

SEQ ID NO: 9494 - protein, 81 aa, Terrapene carolina
QAEESRPRFVAVYFTQGQGALLDPAQRALYRDVMQENYETVTSLGKGFLSPQILEAVGSARQKPGEVGTGQRGFWETTQGR

SEQ ID NO: 9495 - protein, 81 aa, Terrapene carolina
IPKPDMISQMEQGEEPWTPDHKGSEERQILRNIRAGEELVKRTQKPSVLDINRKRQVISTLRGGGFKNHNETVIQLTLCTK

SEQ ID NO: 9496 - protein, 81 aa, Terrapene carolina
FQGPVTFEEVAVYFTREEGALLDPTQRALYRDVMQENYETVVFLGFPISKPDVISQLERGEKPWVLDLQGSEKECGKSFSR

SEQ ID NO: 9497 - protein, 81 aa, Lithobates catesbeianus
GEVPIRCQDVTVYFSMEEWEYIEGHKDLYKDVMMENWPPLTSPDGSSNRNPPERCPRPLYSRDPTLEDQEIPQEDQNDDLI

SEQ ID NO: 9498 - protein, 81 aa, Terrapene carolina
INLLIFCMPVTFEEVAVYFTQGQGALLDPAQRALYRDVMQENYETVTSLGKGFPVIVSPSSWIPHSSTRAQGLVPLTECPF

SEQ ID NO: 9499 - protein, 81 aa, Terrapene carolina
MPRAGFPIPKPELIARLQRGEEPWVPDLQASEKKEVMRVTHTGDETLSENKEVNWQVEPERAFLRGAEGNFSQCLEQGEAW

SEQ ID NO: 9500 - protein, 81 aa, Terrapene carolina
MSRPDLICQLEQGEETWVPDLQGSEERGIRRGACTGDKILCKNEGENPQQEGPAQVEPHGMVLGGSRGNVPAQGEAGGSQN

SEQ ID NO: 9501 - protein, 81 aa, Terrapene carolina
SLMPVTFEEVAVYFTQGQGALLDPAQRALYRDVMQENYETVTSLGKGFLVPWLLEAGVGGRSLRVLSCLCCFSVPHRIPLL

SEQ ID NO: 9502 - protein, 81 aa, Terrapene carolina
AGLPIPKPDLVARLEAGEEPWVPDLQASEEKKVPRDTHTGDKTKSENEEETPQQEGPEQVEIQGTILRSDSNFSQCLEQRT

SEQ ID NO: 9503 - protein, 81 aa, Terrapene carolina
ERMVAFEDVALYFSQEEWELLSPPEKQLYRDQMLRNYWALISLGKDLFIFTHSFMDKWGNRSIPGLGILGGTRTQSECGES

SEQ ID NO: 9504 - protein, 81 aa, Lithobates catesbeianus
VPIRCQDVTVYFSTEEWEYLEGHKDLYKDVMIENQPPFTSPGHIIEEPSNDRITLSLSCEMEDEDITRDCAGEKTTSSAMD

SEQ ID NO: 9505 - protein, 81 aa, Lithobates catesbeianus
IDLLTGEVPIRCQDVTVYFSMEEWEYLEGHKDLYKDVMIENQQTLNYGKLGKNKLSLNEMILNLAMEIIHMLTAEVRRILI

SEQ ID NO: 9506 - protein, 81 aa, Lithobates catesbeianus
IELLTGEVPIRCQDVTIYFSMEEWEYLEGHKDLYMDVMMENQQTLNYGKLGKNKLSLNEMLLNLAMEIIHMLTAEVRRILI

SEQ ID NO: 9507 - protein, 81 aa, Terrapene carolina
FQMPVTFEEVAVFFTQGQGALLDPAQRALYRDVMQENYKTVTSLGKGFLGPLWEELKGIFPSAWSRQKPGEVGKGQRGFWE

SEQ ID NO: 9508 - protein, 81 aa, Terrapene carolina
FQMPVTFEDVAVYFTQGQGALLDPAQRAIYRDVMWENYETVTSLGFPLPKPDLITRLEQGEEPWEVPGHGELKGTSVGRPH

SEQ ID NO: 9509 - protein, 81 aa, Terrapene carolina
AQGPVTFEEVAVYFTREEGALLDPTQRALYRDVMQENYETVVLLGFPVSKPDVISQLEQGEEPWIPDLQGSEKEVLPRAAC

SEQ ID NO: 9510 - protein, 81 aa, Terrapene carolina
PVTFEEVAVYFTQGQGALLDPAQRALYRDVMQENYETVTSLGKGFLSPQILEAVGSASGAERGSENEEGNHHEEVPGEVEP

SEQ ID NO: 9511 - protein, 81 aa, Terrapene carolina
GKEMAAAEPVTFEEVAVYFSEKEWALLDPGQRALYRHVMQENYETVISLGKDSCPLSYQSSWMLSPELPQISPPVTFPFIR

SEQ ID NO: 9512 - protein, 81 aa, Terrapene carolina
MFPFSWVPRSPAEHRDRFHSQNVLYDRCSLNPPCTLICLIPPPPGFPIPKPELISHLERGEEPWMPDFQACEERESLRCAH

SEQ ID NO: 9513 - protein, 81 aa, Terrapene carolina
FQMPVTFEEVAVYFTQGQGALLDPAQRALYRDVMQDNYEMVTSLGFPIPKPELIARLERGEEPWVPDLQACEERRLPRCTR

SEQ ID NO: 9514 - protein, 81 aa, Lithobates catesbeianus
KPERNNMQKILEVTKKMMELLTGEVPIRCQDVTVYFSMEEWEYLEGHKDLYEDIMMEKQPPLTPLGKRRLYCKGEQYGGST

SEQ ID NO: 9515 - protein, 81 aa, Lithobates catesbeianus
IRCQDVTVYFSMEEWEYLEGHKDLYKDVMMENQPPLTSPERCPRPLYSWDSTQEDHTIPHHHQHEEQMYVKVEVKEEEEEV

SEQ ID NO: 9516 - protein, 81 aa, Lithobates catesbeianus
VPIRCQDVTVYFSMEEWEYLEGHKDLYKDVMMENQPPLTSPDGSSNGNPPERCPLPLYSRDSTQEDHTIPHHHQVGGNQHV

SEQ ID NO: 9517 - protein, 81 aa, Terrapene carolina
STCRVPVTFKEVAVYFTQGQGALLDPAQGTLYRDIMQENYEMVTSLGKGFLSPRLLELLPWSVRLEENGLRNAHLPCERDL

SEQ ID NO: 9518 - protein, 81 aa, Lithobates catesbeianus
VPIRCQDVTIHFSVEEWEYLEGHKDLFEDIMEDDWQTLTPLGELISCGTPERSPSPVYAQNRLENIVDVSRQPEEENNSIT

SEQ ID NO: 9519 - protein, 81 aa, Terrapene carolina
FQMPVTFEEVAVYFTQGQGALLDPAQRALYRDVMQENYETVTSLGKGFPSPQLLEAVGSACLNVFRFFPGQLDQRQMGSIM

SEQ ID NO: 9520 - protein, 81 aa, Lithobates catesbeianus
VPIRCQDVTVYFSMEEWEYIEGHKDLYKDVMMENQPPLTSTDLSEGVEKLKSHRAIYEELDSLEDWSVNTKEEGDLPGGHC

SEQ ID NO: 9521 - protein, 81 aa, Terrapene carolina
MSQVSLGKNLGDCDPACPTHPLFTGFPVSKPDVISQLERGEEPWVRDLYDSEKKVLLKAACTGEELVKPTQKQSEHIGNIW

SEQ ID NO: 9522 - protein, 81 aa, Lithobates catesbeianus
GEVPIRCQDVTVYFSMEEWEYLEGHKDLYKDVMMENQPPLISPDGSSNGNPPERCSCHLYSRDSTQQEQNISCKVKEEIKK

SEQ ID NO: 9523 - protein, 81 aa, Lithobates catesbeianus
TGEVPIRCQDVTVYFSMEEWEYLEGHKDLYKEVMMENQPPLTSPDGSSNGNPPERCPRPLYSWDSTQEGHTIPHPHQGEER

SEQ ID NO: 9524 - protein, 81 aa, Terrapene carolina
MLVTFEEVAVYFTQGQGALLDPGQRALYRDVMQENYKMVTSMGKGFLSPRLLEAMGSACLTLVRRRAVGARSPGLQGKRDP

SEQ ID NO: 9525 - protein, 81 aa, Terrapene carolina
AGLGVAFEDVALYFSQEEWELLSPPEKQLYRDQMLRNYWALISLGYSGSTPDLIHRIEPPLQGEAPVQKTVMDKWGNRSIR

SEQ ID NO: 9526 - protein, 81 aa, Lithobates catesbeianus
GEVSIRCQDVTVYFSMEEWEYIEGHKDLYKDVMMENRPPLTSPDGSSNRNPPERCPCPLYSQDSTQEDQEILQDYQDEDLI

SEQ ID NO: 9527 - protein, 81 aa, Terrapene carolina
MPVTFEEVAVYFTQAQGALLDPGQRALYRDVMQENYETVTSLGKRYLSPRLLEAAGSAFLNLFFPWSRSPQLQCGRETFIC

SEQ ID NO: 9528 - protein, 81 aa, Terrapene carolina
AGFPIPKPDLVARLEAGEEPWVPDFQASEERKLPRGTRTGDKTKSENKEGNPQQKCPEQVELQRTFLRRAEENFSQCFEQR

SEQ ID NO: 9529 - protein, 81 aa, Terrapene carolina
FQMPVTYEEVAVYFTQGQGALLDPAQRALYRDDMQENYETVTSLGLPIPKPDLISQLEQGEKPWVPDLQACEEREISRGAH

SEQ ID NO: 9530 - protein, 81 aa, Lithobates catesbeianus
LLSLLTKHRPDRRVPPCCSLKPERHNMEKILEVTKKMMELLTGEVPIRCQDVTVYFSMEEWEYLEGHKDLYKDVMMDNQQN

SEQ ID NO: 9531 - protein, 81 aa, Terrapene carolina
LERMLQVAFEDVALYFTREEWELLSQPEKQVYRDQMLRNYRVLVSLGKYKISHPLLTPVKCVWSLDASSSPTDRVDSPSLG

SEQ ID NO: 9532 - protein, 81 aa, Lithobates catesbeianus
PIRCQDVTVYFSMEEWEYLERHKDLYKDVMMDNQQILSCVKKKIHLNKKIHKLSLEIIYLLIGENFPPVKSGDQVTITVPP

SEQ ID NO: 9533 - protein, 81 aa, Lithobates catesbeianus
VPIRCQDVTVYFSMEEWEYIEGHKDLYKDVMMENQPPLTSPDGSSNRNTLERCPRPLCLQDSLEEDFNMDLQDSVDVCHSI

SEQ ID NO: 9534 - protein, 81 aa, Terrapene carolina
SFYPLMPPGCSRQASIYLVLLFRVGLLLFQGPVTFEEVAVYFTREEWALLHPTQRALYRDVMQENYENVTSLGKDSRPLSF

SEQ ID NO: 9535 - protein, 81 aa, Lithobates catesbeianus
GEVPIRCQDVTVYFSMEEWEYLEGHKDLYKDIMMENQPPLTSPDGSSNGNPPERCPRPLYSRDSTQEHHKDPQDFEADHLI

SEQ ID NO: 9536 - protein, 81 aa, Terrapene carolina
FLVDMGTVKSLMRRGSFSKPDVISQLERGEEPWAPDLQGSEEREILRGSCTGEGSLNQLRICHCLKETAGITNKDLVSSLS

SEQ ID NO: 9537 - protein, 81 aa, Terrapene carolina
MSNEFTCPPLFSFPLAGFPISKPDVISQLELGEEPWVPDLQGSEEKELLRCAYTAGDEMVRENEEQVELSGALLQRSKGTV

SEQ ID NO: 9538 - protein, 81 aa, Lithobates catesbeianus
GEVPIRCQDVTVYFSMEEWEYLEGHKDLYKDVMMGDHKNPNDSQSRSLTDFNVIVKEEVNDEIDEDDVTKEWKNLEGHKDL

SEQ ID NO: 9539 - protein, 81 aa, Microcaecilia unicolor
AEMLVTFEDVAVYFSEEEWKVLEDGQKELYKDVMKENYESLTLLGYPLVKPDVLLRLERGEDPWEKNWGHLRNTVISKTSC

SEQ ID NO: 9540 - protein, 81 aa, Microcaecilia unicolor
DQALVTFKDIAAYFLEAEWDVLGELQKELYKKVIKEIHSFLISQGYSIANPDVIFKIKEEDEKYVTQKCEWEGKENMNDPT

SEQ ID NO: 9541 - protein, 81 aa, Microcaecilia unicolor
RKMRVTFEEIAIYFSQEEWEYLDEGQKELYREVMKENHETLMFLENEVTEEEVKETNREGRPLKWKLRPRHVSVYEGIERG

SEQ ID NO: 9542 - protein, 81 aa, Microcaecilia unicolor
FQASVVFNDVAIYFSEEEWNILKQRQRDLYKNVVKEIHQAVISLGYSIINPDVLVRISKEEEPCLWKDHDSERRRNNSPFN

SEQ ID NO: 9543 - protein, 81 aa, Terrapene carolina
IPHSPAQHRDRFRSRNVLSDRRSLSPPHTLIWSDFTPCTGFPIPKPDLITRLERGEEPWVPDLQVCEEREIPRGAHTAGDE

SEQ ID NO: 9544 - protein, 81 aa, Terrapene carolina
MEPVTFEEVAVYFTREEWALLDLTQRALYRDVIQENYETVVFLGFPVSKPEVISQLERGEEPSVPDLQGSEKEVFNLSRTY

SEQ ID NO: 9545 - protein, 81 aa, Terrapene carolina
QVPVTFEDVAVYFTLEEWEKLTEWQKALYREVMRENYDHLISLGKDRFSLFDCVLEDRALGKSPNLCLSHGNPAGSSLGQP

SEQ ID NO: 9546 - protein, 81 aa, Terrapene carolina
FQMPVTFEEVAVYFSEDEWALLDEKQKELYRDVMQENYETLLSLAGFPIAKPDVLSQMKQGEEMWLPDLQGSAEREIPRGT

SEQ ID NO: 9547 - protein, 81 aa, Terrapene carolina
RVTFEEVAVYFTREEGALLDPAQRALCRDVMQEKYENVTSLGKDSLKVHVTPTMQPLLCLVSASPEHATFHAQRRVPTPGI

SEQ ID NO: 9548 - protein, 81 aa, Terrapene carolina
VTFDDVSVYFNEQEWANLDEWQKELYKNVMKENYETLISLGRARVLLVYFRLGDGQLMTKETRFDGDCEPENLEAEGELPG

SEQ ID NO: 9549 - protein, 81 aa, Lithobates catesbeianus
PIRCQDVTVYFSMEEWEYLEGHKDLYMDVMMENKQLLNYVNMKNNNLHNWILLTLEIVCLLTGEDCTVVMKSSIENNIKGI

SEQ ID NO: 9550 - protein, 81 aa, Lithobates catesbeianus
REVPIRCEDSTVPFSMEEWEYIEGHKDLYKDVMMENRPPLTSLDGSSDRNPPERCPRLLYSKDSTQEHQEIPQEDQDENPI

SEQ ID NO: 9551 - protein, 81 aa, Lithobates catesbeianus
PIRCQDVTVYFSMEEWEYIEGHKDLYKDVMMENRPPLTSPAESSNRNPPERCPRPLYSQYTKQEHQEIPQKDQEENLCESR

SEQ ID NO: 9552 - protein, 81 aa, Lithobates catesbeianus
KKILEVTNKIIDLLTGEVPIRCQDVTVYFSMEEWEYLEGHKDLYKDIMMENQPPLTSPGKRRLYCKGESSTEGPPRSPIIL

SEQ ID NO: 9553 - protein, 81 aa, Microcaecilia unicolor
QIPVTFEDIAIYFFQEEWKDLDAWQKELYKDVMKENYQTLMSLGTGSQNVTPDIISHIERGEEPYIRDEPRSEERETGENS

SEQ ID NO: 9554 - protein, 81 aa, Microcaecilia unicolor
KEALVTFKDVAAYFLEVDWDLLGEWQKELYKKVIEEFHAILISRGYSIVNPDVIFKIKKEDEKYFTQQFEWEGKENPNDFN

SEQ ID NO: 9555 - protein, 81 aa, Microcaecilia unicolor
QVPVTFEDITVYFSKEQWGYLDEGQKELYREVMKENYETLISLGTDHESINPEVLMWIKQEEEPHGWDPKESGGKEVSHSC

SEQ ID NO: 9556 - protein, 81 aa, Microcaecilia unicolor
KVPVKFEDVAVSFSQDEWGYLDEGQKELYREVMKENFQTLISLESGLQRIEEPYVQDPQEADGREFVQSYSADHEIMQKEE

SEQ ID NO: 9557 - protein, 81 aa, Microcaecilia unicolor
RQMSVTFEDIAVYFSQEEWEDLEERQKDFYKEVMKENYEILSSLGYSTLRPEILCRMERGEEPWVNDPQKGEHSIYLYAGN

SEQ ID NO: 9558 - protein, 81 aa, Microcaecilia unicolor
PEPVSFEDITVYFSQEQWEYLDEGQKELYREVMKENFETLISLGTNHESINSEVLLRINQEEEPRVWDPKESGQREVTHSY

SEQ ID NO: 9559 - protein, 81 aa, Microcaecilia unicolor
DQALVTFKDVSAYFLEVDWEILGEWQKELYKKVVREVHAFLISRGYSIINPDVIFKIKKEDEKYFTQHFEWEGKENPDDPM

SEQ ID NO: 9560 - protein, 81 aa, Microcaecilia unicolor
KEALVTFQDVAAYFLEVDWDILGEWQKELFKKVIKEIHDVLISRGYSIVNPDIIFRIEKEDEKYFTQHFEWEGEKTPNDST

SEQ ID NO: 9561 - protein, 80 aa, Paroedura picta
APVTFEDVAVYFTEGEWALLDPEQRALYKEVMQENYFSLASLGYPVAKPDFICRLEGGEVLWLPDPPGTAMRDMPPDYSS

SEQ ID NO: 9562 - protein, 81 aa, Paroedura picta
PVTFDDNTVRFSAQEWARLEEWQKELCKNITKGHHEPLVSLDSALCKAGSLPPAERVGALHVADQEVLEDRAFLPEVRTGP

SEQ ID NO: 9563 - protein, 81 aa, Paroedura picta
APVSFEEVAVFFTEEEWALLDPAQRALYWEVMQENYEAVASLGKEFGPFILNREGESRPAGDAPDSEKRGQPGEVSSEGGE

SEQ ID NO: 9564 - protein, 81 aa, Paroedura picta
ELVSFEEVAVRFTVEEWALLDPDQRSLYKEVMLENYDNVTFLGVLKPDYLSYLEEGEDPFALDSEEEEEEEEAERPARTFP

SEQ ID NO: 9565 - protein, 81 aa, Paroedura picta
DVLEETSSHFSHEEWENLQGWQKELYRNVVKGNCESLISLEGEPPCGLAQAASRAPQEPPARNPAEPSAPKMEGSSWVQPQ

SEQ ID NO: 9566 - protein, 81 aa, Paroedura picta
FQEPVTFEDVAMYFTKEQWAMLDPTQRALYTDVMRENYGNVLAAGFSVSKPALIYFLERGEVLWEPDQQRIRAREILSGIS

SEQ ID NO: 9567 - protein, 81 aa, Paroedura picta
SPLCSDGQRADMKPFQGPVSFEEVAVYFTQGEWVLLRPAQRALYKKVMLETFGNVASLGPVTVKPDLILWLEGKDQIDGEK

SEQ ID NO: 9568 - protein, 81 aa, Alligator sinensis
AKLADVFEDVAVYFTQEEWELLEAGDKVLYQDQMLRNYQALVSLGYQGPTPDLICHIQQGEMELWVWNDEKAEENAFSEDL

SEQ ID NO: 9569 - protein, 81 aa, Alligator sinensis
LQEAFEDVALYFNQKEWELLGDGDKVLYQDQMLSNYQALVSLGYQGPTPDLINCIQGGEVELWVCDVEDPGESTLSEGLFP

SEQ ID NO: 9570 - protein, 81 aa, Alligator sinensis
WQLPEAFEDVAVYFTPEEWQLLEAGDKGLYRDQMLRNYQALVSLGYRGPTPALICRIQRREMELWACDDEEGGESSLSEDM

SEQ ID NO: 9571 - protein, 81 aa, Alligator sinensis
PKVPTGFENGAAYFSEQEWKNLDECQKELYKNVMKGNFDSLVSLDYAISKPDLLSRIERGEAPCPRDAGDSEEREIPAEPS

SEQ ID NO: 9572 - protein, 81 aa, Alligator sinensis
SELREVFEDVAVYFTRKEWELLDDEDKVLYQDQMVKNYQALVSLGYRGPTPDLICSIQQGRVDLWTCADEDCGEMSRWEDL

SEQ ID NO: 9573 - protein, 81 aa, Paroedura picta
LQGGVSFEEVAVYFTWGEWALLHPAQRALYKEVMRENFGIVASLGPLTVKPDLISWLEEEKELFFCGCEELEEMPAGNVQE

SEQ ID NO: 9574 - protein, 81 aa, Alligator sinensis
VQVPVTFDDVAVYFSKEEWEELVEWQKELYKDVMRDNYEVLFSLGCSAVKPDIISQIEQGEDPCVSGHQEGCTSYSAPAAV

SEQ ID NO: 9575 - protein, 81 aa, Alligator sinensis
MDLREAFEDVAVYFTREEGELLEDAQKGLYRDQMLRNCRALVSLGYRGPTPDLICCIKQGQEELWVSDNGDRGDTSRLKEL

SEQ ID NO: 9576 - protein, 81 aa, Alligator sinensis
MVPVNSEASGCFSEQEWGNVEQWPADLHRDAVRSNYEALMSLGQGTDSVLSSAEIPCEVTLGDEPSVPDQADSQGAESPTD

SEQ ID NO: 9577 - protein, 81 aa, Alligator sinensis
PVQLREAFEDVAVYAKEWELLEDGDKVLYRDQMLRNYQTLDSLGYQGPTPDLIYHIQRGEVELWVCDEEPGESVLSQGLSP

SEQ ID NO: 9578 - protein, 81 aa, Alligator sinensis
TELPEAFEDVAVYFTREEWELLEDAQKGLYRDQMLRNWRALVSLGYRGSTPDLIHRIARGQEELWVCDDEDRGDISKSEDL

SEQ ID NO: 9579 - protein, 81 aa, Alligator sinensis
MELREAFEDVAVYFTREEWELLEDVQKGLYRYQMLRNCRALISLGYQGPTPNLICRIQQGQEELWVGDSEERGDISGLEVL

SEQ ID NO: 9580 - protein, 81 aa, Alligator sinensis
VQLREAFEDVALYFTREEWELLGDRDKVLYQDQMLRNYQALISLGYQGPTPDLICRIQQGEVELWVCDDENRGETAWSEGL

SEQ ID NO: 9581 - protein, 81 aa, Alligator sinensis
LGPQEMFEDVAVYFTRKEWELLEDEDKVLYQDQMLRNFQALISLGYRGPTPDLICSIQQGQVELWVCDDEDCGELSKLEDL

SEQ ID NO: 9582 - protein, 81 aa, Alligator sinensis
LELWDVFEDVALHFTWKEWKLLEDEDKVLYRDQMLRNYQALVSLGYRGSTSDLICCIQRGEVELWVRDDEDCGEISGSEDL

SEQ ID NO: 9583 - protein, 81 aa, Alligator sinensis
AQELVTFEDVAVYFTKEQWALLDPSQKALYRDVMLEHYETVASLGFPIPKPEVISQLEQGKDPWIPGLQGSEGRKIPGMLN

SEQ ID NO: 9584 - protein, 81 aa, Alligator sinensis
LPEAFEDVAVYFTREEWELLEDAQKGLYRDQMLRNWRALVSLGGTWLLCRAEKHSLEEGPANLEPPWTSPRDLAEMESLRP

SEQ ID NO: 9585 - protein, 81 aa, Alligator sinensis
AQLWEAFEDVALYFTRKEWEQLQDGDKMLYREQMLRNYQALVSLGYQGPTPDLIGRIQQGEVELWVYDDEEPGECICSEGL

SEQ ID NO: 9586 - protein, 81 aa, Podarcis muralis
SQGLVSFEEVSVSFAAEEWVLLDPDQRALYKEVMLENYRNVASLEGPLMPKSDLVSWLEGKEELLSWEEPAKKDEGFFQEK

SEQ ID NO: 9587 - protein, 81 aa, Podarcis muralis
PPFNGPVCFEDVAVHFTDEEWALLDLDQRALHKEVMEENLASFGSFSNTADVGISRDVFDPWVLTFSSPVPKAPLPLLFLN

SEQ ID NO: 9588 - protein, 81 aa, Podarcis muralis
GLCALKMSAVRFTDEEWALLDPDQRALHKDVMEENWGIVASLGKAPCGIVLSRRLTLEMEGNAMTGPNKIHPREEELDLLN

SEQ ID NO: 9589 - protein, 81 aa, Podarcis muralis
MGPVCFEDVAVPFTDENLALLDPDQRALQKEVKEDNPGIVASLVRLPISVGETREPVWCSGSEQWIRNLGNRVRVSAPPPP

SEQ ID NO: 9590 - protein, 81 aa, Paroedura picta
PVSFEEVDVDFTREEWELLDPGQRALAMEVTLENLGNVASLEADAPQNKFKEEPKQHPLEEKPKRRNAGTKQGRDNECPAS

SEQ ID NO: 9591 - protein, 81 aa, Paroedura picta
WELLDPGQRALAMEVTLENLGNVASLGELLTPRPEEETTSAWSCKEREAAGGSGRQGGEGEREPCGALAGRAWWPEVGKSR

SEQ ID NO: 9592 - protein, 81 aa, Podarcis muralis
RIPTLKMQNKRIQLKLCFEDVAVRFTDEEWELLDPDQRAMHKDVMEGNRGIVASLGKPPCGIVLSQEQRRTQHNLQSGEGT

SEQ ID NO: 9593 - protein, 81 aa, Latimeria chalumnae
QLEMENTFADIEIYFSEDEWQELQDWEKEVYRNLKEHYDIIISFGYKFPKPDFMCKKEDTYQPTMFKSIRGKEEEFLVVSR

SEQ ID NO: 9594 - protein, 81 aa, Alligator sinensis
LREVFEDVAVYFTQMEWELLEDEDKVLYQDQMLRNFQALVSLGGTWLLNGAEEETPVEGPANLGPPWTSPRSLGEMDSLRH

SEQ ID NO: 9595 - protein, 81 aa, Alligator sinensis
MREEWELLDDADKELYQDQMLKNYQALVSLGYRGLTPDLICRIQGGQVELWVCADEDHKRISRSECLLPGELLWQAPVPDS

SEQ ID NO: 9596 - protein, 81 aa, Alligator sinensis
MEHWVFLDPRQRALYRDVMQESYETLMSLKYPISKPDVISRLEQGEGMCVPDLQDSGEKENPGGTSAGTASEDEVEDLGQG

SEQ ID NO: 9597 - protein, 81 aa, Alligator sinensis
AQLQEAFEDVALYFTQKEWELLEDRDKVLYQDQMLRNYQALVSLGYEGPIPDLICRIQRGEVELWVCDDYDPGESVQSEGV

SEQ ID NO: 9598 - protein, 81 aa, Alligator sinensis
AAEEPAQGPVTFEEMPAYFSEGQWDLLNPSQRAFCRDVIGFPVPKPSVVSWMEKQKEPWAPDLLGSEQKELLGEVCTDDRT

SEQ ID NO: 9599 - protein, 81 aa, Alligator sinensis
GEAPVTFEDVAVYLTTEEWKELVDWQRELYQDVMKENYELATSMEAVLEKPEIVARLERGEEPYVADPLDSRKGCWAGSPS

SEQ ID NO: 9600 - protein, 81 aa, Paroedura picta
LLGRGPEGGYFTEEEWALLDPGQRALYREVMMENFGSVAFLGSRKRSLMGFLSPPVGRRVESNVLHEPPTRVEGPVSFEEV

SEQ ID NO: 9601 - protein, 81 aa, Paroedura picta
TQSLVSFKEVAVYFSTEEWALLDPCQRALYREVMLENYGMVVSMGRQDSTPALIAWLREEGDLLQSSTEEVQSADDILGNE

SEQ ID NO: 9602 - protein, 81 aa, Paroedura picta
GLQTAFLHTNQAMERSKEWIRPSFLSEGGLSDSTRCQIEGPVSFEEVAVYFPEEEWALLDPGQRALYREVMLENYRSLVSL

SEQ ID NO: 9603 - protein, 81 aa, Paroedura picta
AQGGVSFEEVAVDFSPGEWALLHPAQRALYKEVMRENFGIVASLGSLIATPDLISWLEEEEDPFLLIAEEEEGLAGGCLGG

SEQ ID NO: 9604 - protein, 81 aa, Paroedura picta
PKVPVTFQDNSAYFSEQEWGDLEGWQKELYKNVMKSNYESLVSLDYAIAKPDLLSRIEQGEAPCEEEEEASKEREIPAEPS

SEQ ID NO: 9605 - protein, 81 aa, Paroedura picta
GPFSFEEVAISFSEAEWALLDPGQISLYREVMLENYGSVAFLVRNTGETTVETDEILTSEESSESFSRASPESISFPDELE

SEQ ID NO: 9606 - protein, 81 aa, Paroedura picta
SPPAYAAMDPVAGWPAQRPVSFEEVAVYFTVEEWALLDVCQRALYREVMLENYRMVVSVGKNPLNACSGDRFLLIFFLQKK

SEQ ID NO: 9607 - protein, 81 aa, Paroedura picta
ETAAALAVQSPISFEEVVVDFSDVEWALLDPGQRALYREVMLENWGSVVFLEEARKFCHSQRTYTGEKPFQCSDCGNKFSG

SEQ ID NO: 9608 - protein, 81 aa, Podarcis muralis
PVCFEDVAVRFTDEEWELLDPDQRAMHKDVMEGNRGIVASLDCDELESKNKEEHNTICRVEKARKKLECGKSCSQSSHSTS

SEQ ID NO: 9609 - protein, 81 aa, Podarcis muralis
ICFEDVTIRFTDEEWAFLDPDQRALHKDVMEETRGIVASLGKAPCGIIISNEGDHDRIPREEKPRENLECGESCSQRSHST

SEQ ID NO: 9610 - protein, 81 aa, Podarcis muralis
PKVPVTFDDVSVYFNEKEWEKLEEWQKELYKNLMKGNHESLISLDYAISKPGVLAQAEPGTDSCLGDEQDSEEQGSLPDPT

SEQ ID NO: 9611 - protein, 81 aa, Podarcis muralis
GSVSFDEVSVRFSNEEWALLDPGQRALYEEVMEEIREMMTSVGDVSEFLTEGEQSEPSREGAEEQKEQRKQRVQVGTYRKE

SEQ ID NO: 9612 - protein, 81 aa, Alligator sinensis
WKVPVTFEDVAVYFSPEEWAELAGWQQELYRDVMMENYELVASLGWPSVKPEIICKIEQEEEPCVRDPADPSVPGKPRHSW

SEQ ID NO: 9613 - protein, 81 aa, Alligator sinensis
LDGLVTFEEVAIYFTQEEWDLLDPAQRAFYWDVMQENYDMVNSLWNLIYIPSMTSQPEYSQDPWVPALQCSEGMEFSNDIT

SEQ ID NO: 9614 - protein, 81 aa, Alligator sinensis
LQVCVSFEEVAVYFTKEQWALLDPSQRALYRGVMLENYEAVTSLAGFPVPNTSLISWLEQGEELWVTDLQDSKEWEIPRNT

SEQ ID NO: 9615 - protein, 81 aa, Alligator sinensis
MDLREAFEDVAVYFTREEGELLEDAQKGLYRDQMLRNCRALVSLGYRGPTPDIIHCIQQGQEQLWVSNDEDCGDISRSEDL

SEQ ID NO: 9616 - protein, 81 aa, Alligator sinensis
MQENYETLISLEEMAISLPRITALAESHRRGLVSAGFPISKPDLLSWMDRGDEPWVPDLQASEGTEIPRDASPAGDGSASE

SEQ ID NO: 9617 - protein, 81 aa, Alligator sinensis
TELWEAFEDVAVYFTQKEWELLGDEDKELYQDQMLRNYQALLSLGYQGPTPGLICRIERGEVELWVCDDEDHGDSSRAEDL

SEQ ID NO: 9618 - protein, 81 aa, Alligator sinensis
LQLQEVFEDVAVYFTREEWELLDDEDKVLYQEQMLKNYQALVSLGYRGPTPDLISSIQRGQVELWVCDDEDCGEISRWEDL

SEQ ID NO: 9619 - protein, 81 aa, Alligator sinensis
AQLREAFEDVALYFTRKEWELLGDGDKVLYQEQMLRNYQALVSLGYQGFAPDLICCIQRGEMELWVCDDEDPGERSWSETS

SEQ ID NO: 9620 - protein, 81 aa, Paroedura picta
GSMSFEEVAVFFSDEEWALLDPGQRALYREVMLENYGNIASLEILPRWQEESKGGTIRIEMSGKSFPQEGPAPGDVLDCFD

SEQ ID NO: 9621 - protein, 81 aa, Paroedura picta
VQCPFSFEEVSVSFSEAEWALLDPGQRALHREVMLENWGNVAFLAQCLTLLPKEDRRETMMETDYDLATEGNLESSSARAL

SEQ ID NO: 9622 - protein, 81 aa, Paroedura picta
PKVPVVFDEASCSFSEQEWQSLDAEQKDLCKHLMKCNYKAVVSMDAAISKPDLLSQMEEDDAADQGGSEDREPLRESSLGC

SEQ ID NO: 9623 - protein, 81 aa, Paroedura picta
VQGPFSLEEVSVSFTEAEWALLDPGQRALHWEVMLEISRDLAFLAKEARSMWETVRETEEGPAPQGRLQNSSNGSQDQTGS

SEQ ID NO: 9624 - protein, 81 aa, Alligator sinensis
SQGLVTFEEVAMYFTKGQWALLDPNQRALYKEVMLENYETVSTLGFPVPKPDMITQLEQGGEPWVPDLQGSEGREMSRGAH

SEQ ID NO: 9625 - protein, 81 aa, Alligator sinensis
PARQGESMELWEAFDDVAVYFTREEWELLEDAQKGLYRDQMLSNCRALVFLGYRGPTPDLISRIQQGQEELWIFDLEPRKC

SEQ ID NO: 9626 - protein, 81 aa, Alligator sinensis
PQVPVTFDDVSVYFSEQEWESLAAWQKELYKHVMRGNYETLVSLDYAISKPDILSRLERGEEPCIRDQLAAWDGPEKGSQE

SEQ ID NO: 9627 - protein, 81 aa, Alligator sinensis
MLRNYHTLVSLGYQGPTPDLICRIQRGEVELWVCDDKDPGESAWSKNLSPDFSDSWDSLAEDSSVGSFPGPGSSVQAALSG

SEQ ID NO: 9628 - protein, 81 aa, Alligator sinensis
MSMRMSTCTRTVLSQWNQVTHYQAYPKEIYLRFLSRAKLMVLIAGFPITKPDMISRMEQKEEPWVLRVQGYEEKEILNGMR

SEQ ID NO: 9629 - protein, 81 aa, Alligator sinensis
PAKQGQSMELREVFEDVAVYFTREEWELLEEEDKGLYRDQMLRNYQALVSLGKALVLASPWSHVSSEVVLSSPWFSSISSS

SEQ ID NO: 9630 - protein, 81 aa, Microcaecilia unicolor
QQMRVAFEDIAVSFSQEEWEYLDEGQKELYREVMKENYETLISLGYESVNPDILSRIKQEEGPSEEKQDCHSYTGQPITQE

SEQ ID NO: 9631 - protein, 81 aa, Microcaecilia unicolor
MRVTFEDIAVSFSQEEWEYLDDGQKELYREVMKENYEILISLGYERISPDTLSRIKQEEEPYVWDPHESREREVTHADTVD

SEQ ID NO: 9632 - protein, 81 aa, Microcaecilia unicolor
HQTLVTFKDVAAYFMEVEWNILGEWQKELYKKVIKDVHEILMAQGYSIVNPDVIFKIKKEDEKYFVQHCELEGKENLNDPT

SEQ ID NO: 9633 - protein, 81 aa, Microcaecilia unicolor
LKTSVTFKDVAAYFSEEEWAALEEWQKELYRSVMKEIHAALLSLGYRIVNPDAVFWVKNKLEPNAKWSQDLGEIQSINVSY

SEQ ID NO: 9634 - protein, 81 aa, Microcaecilia unicolor
QVPVTFEDITVYFSQEQWEYLDESQKELYREVMKENYKTLITLGTDHESINPEVLARIKQEKEPHVWDPKESEDRGVPHSC

SEQ ID NO: 9635 - protein, 81 aa, Microcaecilia unicolor
IPVTFEDIAVYFSQEEWKDLEDWQKKLYKDVMKENYEILLSLGTGSITVTPDIISYVEREIRDEPGSEERETGKSSCSEAV

SEQ ID NO: 9636 - protein, 81 aa, Microcaecilia unicolor
DEALVTFKDVAAYFSEVDWNILGEWHKKLYKKVIKEIHDILMSRGYSIVSPDVVFKIEKEDEKYFSQPFEWEGKENPYDST

SEQ ID NO: 9637 - protein, 81 aa, Bambusicola thoracicus
VVVAFEDVAVYFSAEEWVLLARWQRELYQEVMMDNYDLVACLVPWDEDTAGDSIQGHRVPPEPESPPLRPAWGGWDPAGAA

SEQ ID NO: 9638 - protein, 81 aa, Micrurus paraensis
LVSFEEVAVYFSEEEWSRLDPDQKALHSEVMLENHRNLVSLGKNGQGNQDSCELSQVINTKDGMEKFGIRTEFEKHERNQS

SEQ ID NO: 9639 - protein, 81 aa, Micrurus paraensis
PKVPLNFSDTSVHFNEQEWRNLEEWQRELYRTVMRSNYDMLVSLDHAISKPDILSQMDQGEEVRMEESEVLENREIPKDPS

SEQ ID NO: 9640 - protein, 81 aa, Micrurus paraensis
QDLVPFEDVAVFFSMEERALLDSEQKALYQKDMLESKRNVASLDPLMAVSSSPGTSVLCSGRSTAAELPTQIFNIMSKKRR

SEQ ID NO: 9641 - protein, 81 aa, Micrurus paraensis
WSDPFEEVTVDFTEEEWALLDSDQRALCAEVTLEAFRNIIALGDGMENANEKQERLMLLQTTNYEGEVTSDHQENPKRERN

SEQ ID NO: 9642 - protein, 81 aa, Xenopus tropicalis
QQMHLTYSDLAVYFSEEEWKDLEGWQKEMYKEVMKDNYENLRSLGIQVPKPDVFLKFRRGKKEVGEAIPCNTGSTKEKQIE

SEQ ID NO: 9643 - protein, 81 aa, Micrurus paraensis
LPQEESSQNTSEGKHRMKFSELYDGAETVVEHPNQVQEGLVSFGEVAVHFSEEEWSQLDPDQKELHWEVMMENYRNVASLG

SEQ ID NO: 9644 - protein, 81 aa, Microcaecilia unicolor
DQTSVTFSDVAAYFLEAEWDILGEWQKELYKKVIKEIHSFLMSQGYSILNPDVIFKIKKEDEKYFIQHCEWEGKENMNDPS

SEQ ID NO: 9645 - protein, 81 aa, Microcaecilia unicolor
EPAPVTFSNVAAYFWEAEWDVLGEWQKELYRQVIKGIHSVLISWGYSIINPDVIFRIKQPEEKYFSQYHDWEEAEPPLGHP

SEQ ID NO: 9646 - protein, 81 aa, Microcaecilia unicolor
MKENYQTLISLGTGSTTVIPDIISHIEQGEEPYIRDEPGPEERETGKSNCSDPRITQGGKRQKKPEEPLVEIEEIQRKTEN

SEQ ID NO: 9647 - protein, 81 aa, Microcaecilia unicolor
QKRVTFEDIAVSFSQEEWGYLDEEQKELYREVMKENYQTLISLGTGSPTVIPDIISHIERGEEPYVREEPGSEEREAGTSR

SEQ ID NO: 9648 - protein, 81 aa, Microcaecilia unicolor
QQPVTFEDITVHFSQEQWEYLDEGQKELYREVMKENYETLISLGTDLKSINSEVLSKIKKEEKPHVWDAKNSREREVTHSY

SEQ ID NO: 9649 - protein, 81 aa, Microcaecilia unicolor
EPMFITFSDVAAYFWEAEWDVLGEKQKEIYRNVIKGIHSVLKSWGYSIVNPDVIFKIKKEDEKYFTQHCERGQKEDSSSLN

SEQ ID NO: 9650 - protein, 81 aa, Microcaecilia unicolor
AQASVIFRDVAVCFSEEEWETLEEWQKELYRNAMKEIHGALISLGYVISNPGVLFKIRKEDETRCGGEHASKDRENNDIAG

SEQ ID NO: 9651 - protein, 81 aa, Microcaecilia unicolor
QMLVTFEDIAVSFSKEEWEYLDEGQKELYREVMKENYQTLISLGTGFPTVIPEIISHIEQGDEPGSEERENGKSSCSGESG

SEQ ID NO: 9652 - protein, 81 aa, Microcaecilia unicolor
FQTLLAFEDVAVFFSEEEWELLDELQKEVYKNTMRENYETLLSLGLTNMKPEIIAKIDAGEAPSVQNASYLEKRGKKSAAG

SEQ ID NO: 9653 - protein, 81 aa, Microcaecilia unicolor
DQASVAFSDVAAYFLEMEWNILGEWQKELYKNVIKEIHSFLILQGYSIVNPDVIFKIKKEDEKYFTQHCEWEGKENMSDPS

SEQ ID NO: 9654 - protein, 81 aa, Microcaecilia unicolor
MEWDILGEWQKELYRKIIKEIHDILTSRGYSIVNPDVIFKIKKEDEKYFTQHFEQDGKENLNDPPKSLPIVTSVFSLSVKQ

SEQ ID NO: 9655 - protein, 81 aa, Microcaecilia unicolor
QVPVTFEDITIYFSQEEWEGLQEWQKELYKDVMKENYEILISLGASSPILTPDVISHIERGEEPYIRDEPRSEERESGKSS

SEQ ID NO: 9656 - protein, 81 aa, Microcaecilia unicolor
QQMRVTFEDIAVSFSQEEWEYLDEEQKELYREVMKENYQTLISLDHQITQERKIKKNPGDHHRNDELFTSTECNQSFTLLS

SEQ ID NO: 9657 - protein, 81 aa, Microcaecilia unicolor
DLTPVTFTDVAAYFCEAEWDILEEWQRELYKKVIEEIHEILMSRGYSIVNPDVIFRIKRQDEKYFSQHHDWKKNENINGPA

SEQ ID NO: 9658 - protein, 81 aa, Microcaecilia unicolor
DQVSVIFKDVAAYFLEVEWNILGEWQKELYKMVIKEIHGILISRGYSIVSPDVIFKIKKEDEKYFTQQIEWEGKEYPNDPN

SEQ ID NO: 9659 - protein, 81 aa, Microcaecilia unicolor
NPASVTFNDVAAYFWEVEWDVLGEWQKELYKKVIKEIHGLLMSRGYSIVNPDVIFKIKKEDEKYFTQHCEWEGRGYTNDPT

SEQ ID NO: 9660 - protein, 81 aa, Xenopus tropicalis
HQMPVTFFDVAASFTEQQWSRLETWKKELYQNVMKELHGALTTLGYKIENPEILFKIKNADDTCVRIDVNSKEKENIDSKD

SEQ ID NO: 9661 - protein, 81 aa, Terrapene carolina
MPVTFEEVAVYFTQGQGALLDPAQRTLYRDVMRENYETVTSLGFPIPKPDLITRLERGQEPWISDLQACEEREIPRGTRTG

SEQ ID NO: 9662 - protein, 81 aa, Terrapene carolina
ERGPVTFEEVAVYFTREEWALLDLTQRALYRDVMQENYETVVFLVGFPISKPDVISQLERGEEPWVLDLQGYEKEVLPRAA

SEQ ID NO: 9663 - protein, 81 aa, Pantherophis guttatus
PKVPVTFDDLSVHFNEQEWGNLDELQKDLYKTVMKSNYEMLVSMDYAIAKPDILTRIEQGDSLCDTNVETMPENNTLAHPG

SEQ ID NO: 9664 - protein, 81 aa, Pantherophis guttatus
IKNSVTFEDVAVYFTEDQGALLDRKQRTLYEDVMVENYGIVASLGFLTLKPALISQIECGEEPWLPETPKLDDTKISNADA

SEQ ID NO: 9665 - protein, 81 aa, Pantherophis guttatus
RVTFEDVVVGFSLEEWSLLEGSQKELHQEVMLETCSLLLSLGHSVPTLDFSSLTCQPDGTAETPQPSWRRRLPLVAGGDKT

SEQ ID NO: 9666 - protein, 81 aa, Xenopus laevis
MEESAKPNDVTVCFSVEELDSLEDGQRDHNKNLKTKVHHSPNLVGYLYVKPEIVPRIRRGEGLCVSSDLYTEKRRNRAYLT

SEQ ID NO: 9667 - protein, 81 aa, Notechis scutatus
MEPWVYLDQRQKALYRDVMQESYETLMSLANQLLNNSNHDNEDEEDVEELRPGTSQSVPRKVKPLTRRETPKQPKIIPVVK

SEQ ID NO: 9668 - protein, 81 aa, Pipra filicauda
DVSFEEVAIYFSPEEWAELLPWQRALYREVMADNYDLVASLGSVSKFTDMKEESPGEVPCAGGDSRTSDASSTVAQDGSAS

SEQ ID NO: 9669 - protein, 81 aa, Pantherophis guttatus
SQDISDGKNKTNLTPFYGGAEILVEAPKEGLVSFKEVAVYFSEEEWSQLDADQKALHREVMLENHRNVASLGENIQEFLSE

SEQ ID NO: 9670 - protein, 81 aa, Pantherophis guttatus
MEPWVYLDQRQKALYRDVMQESYETLMSLANQLLNNSNHDDEDEDEDDEEEHEGMEELRPGTSQSAPRRVKPLTRRETPKQ

SEQ ID NO: 9671 - protein, 81 aa, Pipra filicauda
KAPTLVLENDATGFSAQEWENLEEWQRELCRKVLAGKSQALVLPDAAMSEPALLSRLQGGEVPCNEDEVASREIPEDPDTG

SEQ ID NO: 9672 - protein, 81 aa, Pantherophis guttatus
KVPVTFDEEQAVHFSTPEWAKLEDWQKELYRNITRGSYEPLVSLDSAIAKADVLPPQAGLGAAPHIADQPSAGEKEFPPAP

SEQ ID NO: 9673 - protein, 81 aa, Pantherophis guttatus
TEESRKLSLEFLESPLSDEVEGLAEPLLQDVVSFEEVAVYFSKEEWSQLDADQKALHGEVMLENSRNLFSLGKNPFLCSGM

SEQ ID NO: 9674 - protein, 81 aa, Pantherophis guttatus
LVSFKEVAVSFSEEEWSQLDPDQKALHSEVMLQNHRNVVSLGNNGQENQNSCELLQVINAKDGREKFGIRMEFESHERNQS

SEQ ID NO: 9675 - protein, 81 aa, Pantherophis guttatus
MAQAHSAQIQQDLLGSDQERLYREVMQESYNTIFRASPLQLQKSELLAHLKRGQEGLQSSSNGADQKLVKEALKKWPESGN

SEQ ID NO: 9676 - protein, 81 aa, Xenopus laevis
QQMHLTYSDLAVYFSEEEWKDLEGWQKEMYKEVMRDNYENLRSLGIQVPKPDAFFKFQSGKKDVREAIPPDTGSTNEKQVG

SEQ ID NO: 9677 - protein, 81 aa, Xenopus laevis
ATTSIGFNEVAVYFSEEEWRNLELWQKELYSNVMREIHTTLISLGYTIDHPDVLCRIRKDQDPYISSLEEERKTSCFPSTS

SEQ ID NO: 9678 - protein, 81 aa, Alligator mississippiensis
LLREAFEDVAMYFTREEWELLEDAQKGLYRDQMLRNCRALVSLGSWKLLPTFLPDVIISTGRRLWLGCLYLETFSQARSVV

SEQ ID NO: 9679 - protein, 81 aa, Alligator mississippiensis
LQMCVSFEEVAVYFTKEQWALLDPSQRALYRDVMLENYEAVTSLAGFPVPNTNLISWLEQGEELWVTDLQDSKEWEIPRNT

SEQ ID NO: 9680 - protein, 81 aa, Alligator mississippiensis
REMPVIFEEVAVYFTKEQWALLDPSQRVLYRDVMLENYETVTSFVGFPVPKPNLISQLEQGEEPWVPDLQDSKEWEIPKNI

SEQ ID NO: 9681 - protein, 81 aa, Alligator mississippiensis
ELWRTCAGSLEERSSLTPEPGQVQKGQGRPPKQEESLELWEVFEDVAVYFTRKEWELLDDEDKVLYQEQMLKNYQALVSLD

SEQ ID NO: 9682 - protein, 81 aa, Alligator mississippiensis
MVPVNSEASGCFSEQEWGNVEQWPADLHRDAVRSNYEALMSLGQGTDSVLSSAEIPCEVTLGDEPSVQDQADSQGAESPTD

SEQ ID NO: 9683 - protein, 81 aa, Pantherophis guttatus
LVSFEEVAVSFSEEEWSQLDPDQKALHSEVMLENHRNVASLGNNGQENQDSCELFQVINAKDGTEKFGIRMELGSHERNQS

SEQ ID NO: 9684 - protein, 81 aa, Xenopus laevis
GAGQVTFDDAAIYFSEEQWSNLEEVQKKVYKELIKEIYEIMLSLGYLIPKPEIVSRIERGEEPYGVVGKKQKLQEPQPEGQ

SEQ ID NO: 9685 - protein, 81 aa, Pipra filicauda
PKVPLTFDDISVYFNELEWERLERWQKDLYRAVMRGNYETLVSLDYAMSKPDILSWIERDEELGDKEDQEPPWTRAGDRQE

SEQ ID NO: 9686 - protein, 81 aa, Pantherophis guttatus
NSVSFEDVAVFFSVEEWTLLDCEQKTLYQEVMLENAKNVASLTGDGWEVESSGQEAAAPLPKDKKEVAEKFSGKPSPVEKE

SEQ ID NO: 9687 - protein, 81 aa, Pantherophis guttatus
VVSFEEVAVYFSKEEWSQLDADQRELYREVMLENSRNLAYLGFNGQENINCKEECQAIHLKGGERKFVAQMKLKSDDTKKS

SEQ ID NO: 9688 - protein, 81 aa, Pantherophis guttatus
STPVTFEDVVVYFTAAEWARLTDWQRDLYQAVMVETYELVASLAGDVILMAEDEEGGVERPIRQCVPQGKRRQKTPQLRAE

SEQ ID NO: 9689 - protein, 81 aa, Pipra filicauda
PKVPVTFDDVSVYFNDKEWEKLEEWQKELYKNVMKGNYESLISLDYAISKPGVLSQIEQGEESRGRNEQDLEESEIITDAT

SEQ ID NO: 9690 - protein, 81 aa, Pantherophis guttatus
QAPPFSFEEVAVYFTEVEWPLLDAEQRDLYWDVMQENYETVASLAVAIPKPELICRLERGEEPWIPAQAASEEKKIPLNLY

SEQ ID NO: 9691 - protein, 81 aa, Pantherophis guttatus
LVSFEEVAVYFSEEEWSQLDPDQKALHSEVMLENHRNVVSLGNNGQENQDFCELFQVINAKDGTEKFGIRMQLETHDRKES

SEQ ID NO: 9692 - protein, 81 aa, Pantherophis guttatus
MENYELVTSLGYPVLKPDLLSRIERVGEPCVGDQLDSTRGIPTDPCPGYRFFKPESLSWIERWEELGVTDRQKLEEGKLCA

SEQ ID NO: 9693 - protein, 81 aa, Pantherophis guttatus
AQVLAAFGDVAICFSAEEWAELDGWQKDLYREVMAENFQLVSSLECLLAIPELLSQLARGEVSQIGARPPPGQDGECQVVR

SEQ ID NO: 9694 - protein, 81 aa, Pantherophis guttatus
MQESRKLSLDFLESPLCAGAEGLAEPSLQDVVSFEEVAMYFSEEEWSQLDADQKELYREVMLENSRNLFFLGKKHCLCSGT

SEQ ID NO: 9695 - protein, 81 aa, Xenopus laevis
VQMHLTYSDLAVYFSEEEWNDLEGWQKEMYKEVMRDNYENLHSLGIQVPKPDVFLKFHKGKKDVREAILPDAGSTNEKQVG

SEQ ID NO: 9696 - protein, 81 aa, Pantherophis guttatus
NSVSFEDVAVFFSVEEWTLLDCEQKTLYQEVMLENAKNVASLSDGWEVESSGQEAAAPLPKDKKEVAEKFSGKPSPVEKEL

SEQ ID NO: 9697 - protein, 81 aa, Alligator mississippiensis
ADSAQGPVTFREVALYFTDPSQRALYREAMQENYESGSLPGTGSPVPQPEAVSQLKSEENPWVQDLQGCEVREIPSSACTD

SEQ ID NO: 9698 - protein, 81 aa, Alligator mississippiensis
LREVFEEVAVYFTRKEWLLLEDEDKVLYRDQMLRNFQALVSLGGAWLLRGPKEEAHVEGPANAESPWTSLGSLGEMDSPRP

SEQ ID NO: 9699 - protein, 81 aa, Alligator mississippiensis
RRPLRPGPDQMCEKLGSGPPQREDMAVSKLREVFEDVAVYFTRKEWELLENDNKVLYRDQMLKNYQALVFLEDFSIYFHTS

SEQ ID NO: 9700 - protein, 81 aa, Alligator mississippiensis
LLVPVTFEDVAVYFSREEWDVFAGWQKALYRAVMTETYNMLLSLGYPGPKPDILYRMERGEEPWIYTPRGPVVWERPDSPI

SEQ ID NO: 9701 - protein, 81 aa, Alligator mississippiensis
QQPSEDGPGNLELQRTSPGRPEERSSLTPEPGQVQRGQGRPPKQEESWELPEVFEDVAVYFTRREWELLDDDDKSVLSKHI

SEQ ID NO: 9702 - protein, 81 aa, Alligator mississippiensis
MVPVTFEDVAVYFSPEEWAELAGWQRELYRDVMMENYELVASLGWPSVKPEIICKIEQEEEPCVEDPADPSVPGKPRHSWS

SEQ ID NO: 9703 - protein, 81 aa, Alligator mississippiensis
PARQGESTELREAFEDVAVYFTREEWELLEDAQKGLYRDQMLRNCQALVSLGRRLWLGCVYLEICSEAHFTVLRSFAEGLP

SEQ ID NO: 9704 - protein, 81 aa, Alligator mississippiensis
MGPVRFEDVAIHFSREQWEMLAPWQQELYRAVMMENYELLVQLGQEAAKPELVSRLERGAEPYGPEQQDLERGAVPASTST

SEQ ID NO: 9705 - protein, 81 aa, Pantherophis guttatus
LETRQLLATKCFLLKYIFPTWKKNKNSISFEDVAVFFSMEEWGLLDLKQRTLYREVMLENARNVASLSKGFCFFWTEIMVE

SEQ ID NO: 9706 - protein, 81 aa, Pantherophis guttatus
GSITFEEVAVYFTEDEWELLDPSQKVLYGEVMLENSRNVADLAYGQENENYEHPALLQMIKFEEGMLRHQDALQKGMKSCI

SEQ ID NO: 9707 - protein, 81 aa, Pantherophis guttatus
KQRMKLSGFSDGDQTAVEPPNQESLVSFEEVAVYFSEEEWSLLDPDQKVLHSEVMLETHRNMASLGKSSLVPNQRVQEDRL

SEQ ID NO: 9708 - protein, 81 aa, Xenopus laevis
YQMPVTFFDVAASFSEEQWSRLEAWQKELYRNVMKELHGALTTLGYKIENPEILFKIKIADKTCVRIDINSQERENIKSKD

SEQ ID NO: 9709 - protein, 81 aa, Pantherophis guttatus
ELSQVAFEEVAVYFTEQEWALLNVGEKVLYRDVMKENFEHVMSLGILLALKESKIAPCLLLVTPYSSSVAFRQVSFEEVAM

SEQ ID NO: 9710 - protein, 81 aa, Xenopus laevis
HRDSVFFTDVAATFSECEWNMLAQWQREVYGTVMREIHTVLMDLGYHIHNSEILFRITKNEEPGRSHRYVAARSKEGHAPD

SEQ ID NO: 9711 - protein, 81 aa, Xenopus laevis
RKVSIKFEDVAVYFSEDEWNYLEDGQKNLYKNVMMENYYAVSSVGCANKKPNIIVNIEQGEKTYLGYTPPDRTKYVSMLRN

SEQ ID NO: 9712 - protein, 81 aa, Xenopus laevis
EVHIKSGDAAVYFSTEEWEYIESHKESYKDVMMETIGSSGIPNNKTFGKIVTKVAFEKEQKEESYAIRRLDTKVQKISGYA

SEQ ID NO: 9713 - protein, 81 aa, Xenopus laevis
VSPQVIFRDVAVYFSEKEWDLLEGWQRDLYTGVIKEIHGILISLGFIILNPNNFLRIQPEDEPCRKSRNVLERHESINITE

SEQ ID NO: 9714 - protein, 81 aa, Pantherophis guttatus
PKVPMTFEDNAVYFSEQEWGNLEEWQKELYKNVMKSNYESLVSLDYAIAKPDLLSRIEQGERPCAEEEEAATMDRVIPSEP

SEQ ID NO: 9715 - protein, 81 aa, Pantherophis guttatus
FLESSLVAGAEGLAEPLLQDVVSFEEVAVYFSKEEWSQLDADQKVLHGEVMLENFRNLFSLGKNQCSRNFMVAFPRSVPSQ

SEQ ID NO: 9716 - protein, 81 aa, Pantherophis guttatus
QGSVSFEDVAVYFTEEEWALLDSSQRALHREVMLENSRNLAAVGYGQEHKNYQEPSLALFQSEERMLGIQRVLQKTRRSCL

SEQ ID NO: 9717 - protein, 81 aa, Xenopus laevis
GVGQVTFDDAAIYFSEEQWSNLEEVQKKVYKELIKEIYEIMLYLGYRIPKPEIVSRIERGEEPYGVVSKKQKLQEPQPEGP

SEQ ID NO: 9718 - protein, 81 aa, Xenopus laevis
SLTQVAFEDVAVYFSELEWALLKDCQKDLYKTVMRDNYEVVASLGFPVLSSKALGRMRHGVTVELEGTEEIDIGDSAQNMK

SEQ ID NO: 9719 - protein, 81 aa, Xenopus laevis
LVPVSFDEVAVYFSEVEWCFLSDQQQDLYKEVMLENLELVLSLGHQYRPAVPHHVLHDVPHHVPHHVPHHVPHHVLHDVPH

SEQ ID NO: 9720 - protein, 81 aa, Xenopus laevis
PKVSVTFRNLSVCFATEDWAILTESDRNMYKDAIQEIYRTLLSMGHRIMNPNILMYTEETENCGATKKRKSNADIPKLHNA

SEQ ID NO: 9721 - protein, 81 aa, Xenopus laevis
LVKFEEVAVVFSEDEWNLLSDQQRGLYMEVMKENYEHLIYLGYEVPVILSLLQDGGGISSDAGSQSKSQQVAVAEGSNVNS

SEQ ID NO: 9722 - protein, 81 aa, Xenopus laevis
MEEWQRELYRNAMKEIHGALLDLGYRILNPELLVKVEKSLDRGRGKVPSASAAVLVPDILLNIEKLHSPDTSCATDKGRVR

SEQ ID NO: 9723 - protein, 81 aa, Callipepla squamata
ALCLQEPVSFAEVAVYFSREEWALLDPAQRALYRDVMLEMYECVTSLGEGFAAFPPLLDTFGCAECASASRAQSNRHAVPS

SEQ ID NO: 9724 - protein, 81 aa, Alligator mississippiensis
SPGSLGRRGSPRLELGQLHKRQGRPPKRKENVVLLEAFEDVAVYFTQKEWALLDDGDKALYRDQMLRNYQALVSLGMQDLF

SEQ ID NO: 9725 - protein, 81 aa, Alligator mississippiensis
VTFEDVAVYFSPEEWKELVEWQKELYWDVMKENYELVTSLVDDGLTNESLEEKSREEEVESLPMQPFLAKLKEKVLQSPAK

SEQ ID NO: 9726 - protein, 81 aa, Lepidothrix coronata
PKVPVAFNDASFSFSEEEWKSLNEWQKELYRHIMKGNYEAVISMDAAISKPDMLSRIEQGEDPNAEEQEDSEAGETPTDPS

SEQ ID NO: 9727 - protein, 81 aa, Lepidothrix coronata
MQENYESLILLDFPIPKPTVVSRLELEEELGELGVPDPNDSKEWQILRVAPADDGTGSEEEEEEEESESPEPPELDAALPR

SEQ ID NO: 9728 - protein, 81 aa, Pantherophis guttatus
LVSFEEVAVYFTEEEWALLDPSQRALYEEVMLENSRNVAALASGLEHENCKEPSIIVFRMIKSEEDTLVDEEPSQGSKKSC

SEQ ID NO: 9729 - protein, 81 aa, Athene cunicularia
PLQPPLLPERAHVPVTFVDIAVYFSAEEWKNLEEWQKELYNNLVKENYESLLSLGKHPFSPLSVPASLWREGPRCGCPGSL

SEQ ID NO: 9730 - protein, 81 aa, Notechis scutatus
MEEWALLDSEQKALYREVMLENKRNKASLAGDGWEMEDSGQEAAASSLKDKKEVAEKMYGKQSSEENQLTGELENCCGLPC

SEQ ID NO: 9731 - protein, 81 aa, Pantherophis guttatus
LVSFEEVAVYFSEEEWSVLDPDQKALHWEVMLENYRNVASLGDNGQDHKESRESFQVFRYGNVTEKPKMQMKFQRQERNQS

SEQ ID NO: 9732 - protein, 81 aa, Pantherophis guttatus
MQESRKLSLYFLESPLVAGAEGLAEPLFQDVMSFEEVAVYFSKEEWSQLDADQRELYREVMLENSRNLLSLGKNHCLCSGT

SEQ ID NO: 9733 - protein, 81 aa, Alligator mississippiensis
AVELITFEEVAVYFTLEEWALLDSGQRALYWDVMQENYEAMVNLGFPIPKPSVISKLKGGEAQWVPDLKGCEAKRILRSPC

SEQ ID NO: 9734 - protein, 81 aa, Alligator mississippiensis
PKVPVIFNDASFNFSEQEWKNLNEWQKELYRHIMKGNYEAVISLDAAISKPDLLSRIEQGDDPSDGDQGDFEGRETPRDPN

SEQ ID NO: 9735 - protein, 81 aa, Alligator mississippiensis
SLTPEPGQVQRGQGRPPEQEESWEVREVFEDVAMYFSRKEWELLEDDDKVLYRDQMLKNYQALVSQDHKPITDKKRAMCRA

SEQ ID NO: 9736 - protein, 81 aa, Notechis scutatus
RKLFSIFLESSLCVGAERVAATLPQDVLSFEEVAVYFSEEEWSQLNADQKALYGEVMLEISRNLASLGKNPYHKEDMKKRA

SEQ ID NO: 9737 - protein, 81 aa, Alligator mississippiensis
GWAIGGRRMYFAEIQWALLDPGQRPVYRDVVPDGYGTLVSLADGGMTNANPQQGCLETAQPHGTLPGLRSELFVQQWFPKQ

SEQ ID NO: 9738 - protein, 81 aa, Alligator mississippiensis
PQLREVFEDVAVYFTRKEWELLEDEDKVLYWDQMLKNYQALISLGYRGPTPDLICSIQQGQVELWVCEDEDGGEMSKSKEL

SEQ ID NO: 9739 - protein, 81 aa, Alligator mississippiensis
AQLREAFEDVALYFTRKEWELLGDGDKVLYQDQMLRNYQALVSLGYQGFAPDLICCIQRGEMELWVCDDEDPGESSWSETS

SEQ ID NO: 9740 - protein, 81 aa, Alligator mississippiensis
ADVFEDVAVYFTQEEWELLEAGDKVLYQDQMLRNYQALVSLGLFRRCRAESGGRSVETCAGAATLPERFQLGQAEDEKLQV

SEQ ID NO: 9741 - protein, 81 aa, Alligator mississippiensis
PWLQEAFEDVALYFTQKEWELLEDRDKMLYQDQMLRNYQALVSLGSSNTEDTWYLLEEENSMDLFLRSGTSLHAAGARILN

SEQ ID NO: 9742 - protein, 81 aa, Alligator mississippiensis
SKLVEAFEDVAVYFTREEWELLETGDKGLYQDQMLRNYRALVSLGYQGPTPDLICRIQQGEMELWICDEEAGENLFSEDLT

SEQ ID NO: 9743 - protein, 81 aa, Alligator mississippiensis
GTLSRAEQQLPEEGPGNLELQRTSPGRPEERSSLTPEPGQVQRGQGKPPKQEESWELREVFEDVAVYFSRKEWELLEDDDK

SEQ ID NO: 9744 - protein, 81 aa, Alligator mississippiensis
GQRRQGPEHGGQGVQLPVVCEAVAVCFMLEEWELLDDEGKELYRDWMLRHSQALVSLEKGFIINHCPGSFSLPRVLVLNLQ

SEQ ID NO: 9745 - protein, 81 aa, Notechis scutatus
VQDRVTFEEVAIYFSAKEWETLTDWQKTLYLDVMKDNYKNLVSLGLAAQPPSVLLQIEGWEKPCVGRAQFPKSREDSEDNL

SEQ ID NO: 9746 - protein, 81 aa, Notechis scutatus
LVPVTFDEEQAVNFSTPEWAKLEDWQKELYRNITRGSYEPLVSLDSAIAKADVLAPQVGPGSVPHVVDQPSAGGKGLPPAP

SEQ ID NO: 9747 - protein, 81 aa, Notechis scutatus
DVVSFEEVSVYFSKEEWSQLDADQKALHREVMLENSRNLAFLGYNGQESKNCKEECQAIHSKGRKGKFSDQMQPKSDETKQ

SEQ ID NO: 9748 - protein, 81 aa, Notechis scutatus
GFPTQGPVSLGEVAIHFNSEEWLLLDPSQKALYQEVMLETSRMVASLAFDAQKNEIVQEPNLVPLQIIKTEIPGEISTNKW

SEQ ID NO: 9749 - protein, 81 aa, Notechis scutatus
AQDLVSFEEVAVYFTEEEWAMLDPNQRALHKDVMLENFRSVAALAYGQEHENYKEQVIKSEEDSLVDQDPSQGSKKSCEVS

SEQ ID NO: 9750 - protein, 81 aa, Alligator mississippiensis
LGERGSLTPDLGQVQKRQSRPPKQGESTELLEVFEAVAVYFTRKEWELLGDEDKELYRDQMLRNFHALVSLGRKDLFETTC

SEQ ID NO: 9751 - protein, 81 aa, Alligator mississippiensis
TPEPGQMQRQQSKPPKQGESLELREVFEDVAVYFTRKEWELLKDEDKVLYQDQMLRNFQALVSLGKALVLASTWTCVNCEI

SEQ ID NO: 9752 - protein, 81 aa, Alligator mississippiensis
AQDPVSFEDVAVYFTEGEWVLLGAAQRALYWEVMRENYEAVALLGFPIFKPVMIAQLEQGEEPWVLSPPGADHQVEMVPRD

SEQ ID NO: 9753 - protein, 81 aa, Alligator mississippiensis
DSRGWRLPWRWPNLAMEPYVLLDPRQRALYRDVMQESYETLMALEFPISKPDLLSRLDHGDEPTALDLHVSKGARAEGATS

SEQ ID NO: 9754 - protein, 81 aa, Alligator mississippiensis
MELQEVFEDVAVYFTREEWELLEEEDKGLYRDQMLRNYQALVSLGKALVLASPWSHIRHAEEKPHVRATCGKSFTCLSTLA

SEQ ID NO: 9755 - protein, 81 aa, Notechis scutatus
PKVPVTFDDLSIHFNEHEWGNLDELQKDLYKTVMKSNYEMLVSMDYAIAKPEILTRIEQGDSLCDTNVDAMPENNTPAHPG

SEQ ID NO: 9756 - protein, 81 aa, Notechis scutatus
RLFTLEDMAVHFTEEEWALLEPDQKALHREVMEEINGILATLGDEWRIMDKRKPSTNPRFHQEGKPYECSECGKAFRMKTN

SEQ ID NO: 9757 - protein, 81 aa, Athene cunicularia
LEITLLFPASPYVLLDPRQRALYRDVMQESYETLMALEFPVSKPDLLSRLDHRDEPTALDLHVPRDAPAAGESLITPRSQR

SEQ ID NO: 9758 - protein, 81 aa, Notechis scutatus
QAPPFSFEEVAVYFTEVEWTLLDAEQRDLYWDVMQENYETVASLAVAIPKPELICRLEQGEDPWIPSQAASEEKKIRLNLY

SEQ ID NO: 9759 - protein, 81 aa, Notechis scutatus
VVSFEEVAVYFSEDEWSQLDPDQKALHSEVMLENHRNVVSLGNNGQENQDSCELFQVINAKDGTEKFGIRMEFESHERNQS

SEQ ID NO: 9760 - protein, 81 aa, Limosa lapponica
PKVPLTFDDISVYFNEEEWERLERWQKDLYRAVMRGNYEMLVSLDYAVSKPDILSRMERDEELCVREGQELPMTGLGKDQE

SEQ ID NO: 9761 - protein, 81 aa, Alligator mississippiensis
PQVPVTFDDVSVYFNEQEWENLASWQKELYKHVMRGNYETLVSLDYAVSKPDILSQIERGEEPCVREQPGSPERSEEAEEK

SEQ ID NO: 9762 - protein, 81 aa, Alligator mississippiensis
SKLQLPEAAEDISVYFTREEWELLEDEDKELYQDQMLRNYQVLVSLGGIISRTTRVHAGEKPFSCPQCGKSFIKSSTLTQH

SEQ ID NO: 9763 - protein, 81 aa, Notechis scutatus
PKVPMTFEDNAVYFSEQEWGNLEEWQKELYKNVMKSNYESLVSLDYAIAKPDLLSRIEQGERPCAEEEEAATTDRVIPSEP

SEQ ID NO: 9764 - protein, 81 aa, Notechis scutatus
PKVPVTFDDMSVYFNEKEWEKLEEWQKELYKNLMKGNHQSLVSLDYAISKPGVLSQTERATDSCHEDNGDSEEQGRLPDAT

SEQ ID NO: 9765 - protein, 81 aa, Lepidothrix coronata
AQVPVTFEDVMVYLSRAEWDSLQAGQRELYRDVVLDTYELLTSLGHPGPKPDILYRLERGEEPWICPSSGHTGSWQEEPLS

SEQ ID NO: 9766 - protein, 81 aa, Notechis scutatus
QVTFEDVAVDFSLEEWSLLEGSQKDLHQEVMLELCSLLLSLGHSVPSLDFSSLTCQPARTAQRPPPSWRRWLPLAAGSDQI

SEQ ID NO: 9767 - protein, 81 aa, Limosa lapponica
LEVPVTFEDVAVCFSREEWEILDEEQKELYRTVMEDNYDTLVSLYAEVGIPTEVPQEEVAAEELAVPETPSKSLKEQDVKD

SEQ ID NO: 9768 - protein, 81 aa, Callipepla squamata
ARHGAGTRSVSPSLWGTMEPYVLLDPRQRALYRDVMHESYETLMSLGNADPKSSVPPPIPTLPTFGVPPSVGESHCAHLHL

SEQ ID NO: 9769 - protein, 81 aa, Alligator mississippiensis
QGLLTFEEVAIYFNKGEWALLDATQRSIYKDVMQENYETVVSLTPEVAVPKPVVITQLEQGEEPWVEDLQKSMERENLQDI

SEQ ID NO: 9770 - protein, 81 aa, Alligator mississippiensis
PQSQHGVHVQGTPPGRLGEGGSLTPDPGRLHMGPPKQELREAFEDVAVYFTRKEWELLGDEDKELYRNQMLKNYQALVSLV

SEQ ID NO: 9771 - protein, 81 aa, Callipepla squamata
SKEPLSFEEVALYFSREEWALLDHAQRALYRNVMLEKYECVASLAPIPAPKPMVISLLEEGEEPWIPDVGSPEAMAGDVSP

SEQ ID NO: 9772 - protein, 81 aa, Callipepla squamata
SLCLQEPVSFEEVAVYFSREEWALLDPAQRALYRDVMLETYECVASLGEGFAAFPSLLGTFGCAECASARGPQSKPHAVPS

SEQ ID NO: 9773 - protein, 81 aa, Alligator mississippiensis
VQMLVTFEEVAVYFSEVEWTLLDPSQKALYRDVMQENYETVTSLGLLISKPDVVSQLEQGEDPWVLDLQGSEEKEPLSWTH

SEQ ID NO: 9774 - protein, 81 aa, Alligator mississippiensis
GALSPEQGQLHKGQGRLARQGESMELWEAFEDVAVYFTREEWELLEDAQKGLYRDQMLSNCRALVFLGKAVSSFSLQPCEH

SEQ ID NO: 9775 - protein, 81 aa, Alligator mississippiensis
PKVPTGFENGAAYFSEQEWENLDECQKELYKNVMKGNFDSLVSLDYAISKPDLLSRIERGEAPCPRDAGDSEEREIPAEPS

SEQ ID NO: 9776 - protein, 81 aa, Alligator mississippiensis
VTFEDVAVYFSPEEWKELVEWQKELYWDVMKENYELVTSLDDGLTNESLEEKSREEEVESLPMQPFLAKLKEKVLQSPAKT

SEQ ID NO: 9777 - protein, 81 aa, Alligator mississippiensis
VTLEEVAVGFPGKQRSPLDSSQRALYWDVMLEKNETLVSLDFRGSGLIFPVSVAYSRAPACPSASKETFSQNKAENPQQPY

SEQ ID NO: 9778 - protein, 81 aa, Alligator mississippiensis
KLREAFDDVAVYFTLEEWELLEAGDKGLYRDQMLRTYQALVSLVHQVTHAGEQLYRCAECKKSFTKWDHLQSHVCVHAGEK

SEQ ID NO: 9779 - protein, 81 aa, Limosa lapponica
PKVPVTFVDIAVYFSAEEWKNLEEWQKELYNNLVKENYEALLSLDGAISRSEAQPRGERGEGPCVPEQRELEQRELPPDAC

SEQ ID NO: 9780 - protein, 81 aa, Alligator mississippiensis
AQGPVTFEDVAVYFSAEEWQELAGWQRELYRDVMMDTYELVASLGPAGLKPEVVSKLERGEEPHQPARSRESPRAPLPVLL

SEQ ID NO: 9781 - protein, 81 aa, Alligator mississippiensis
AQVPVAFEDVAVYFSAEEWAELAGWQRELYREVMKENYELISSLGCPSAKPELICQLEKGEEPYVWDPQGWRSGCRPPDTW

SEQ ID NO: 9782 - protein, 81 aa, Alligator mississippiensis
DKLPRVPEEEPLPHQESVQRGQGRPPKQEESLEVREVFEDVAMYFSRKEWELLDDDDKVLYRDQMLKNYQAPVSLGKALVF

SEQ ID NO: 9783 - protein, 81 aa, Alligator mississippiensis
AQAPVTFEDVAVYFSPEEWAELVDWQRDLYRDVMMENHELIASLGPRLKPSVKRAKREKAPRAWDHQYSRMTDLMPPGQGN

SEQ ID NO: 9784 - protein, 81 aa, Alligator mississippiensis
KLSEAFEDVAVYFTWKEWALLEAGDKMLYRDQMLKNYQALFSLADAETLGRAEQQLSEEGPATLELFPTQTRRLAQLGQRT

SEQ ID NO: 9785 - protein, 81 aa, Alligator mississippiensis
QEAFEDVAVYFTQKEWELLEAGDKELYRDQMLRNYQALVSLESLTHGKTPVATSNFITARNASSRIENRDKCISSWLNPAT

SEQ ID NO: 9786 - protein, 81 aa, Alligator mississippiensis
AGAPDETPAQEQRESLELREVFEDVAVYFIWKAWELLEDEVKVLFQDQMLRNYQASVSLEKKKFHCEPSVMDLFQHHESLL

SEQ ID NO: 9787 - protein, 81 aa, Notechis scutatus
DLVSFEDVAVFFSVEEWALLDSEQKALYQEVMLENKRNIASLGDRWEMEDSGQEAAAPLPKDKNEVAEKIYGKQSSEQNQL

SEQ ID NO: 9788 - protein, 81 aa, Notechis scutatus
LQVLVSLAEVAVCFSEEEWSQLDPVQKDLHREVMLENSRNVAFLGNNVQENKEIFQTFRDEERRKEFSYSMETTENERNLS

SEQ ID NO: 9789 - protein, 81 aa, Notechis scutatus
ELPQVAFEEVAVYFTDQEWALLNVGDKVLYKDVMQENFEHVMSLGILLALKESKIAPCLLLVTPYSSSLAFHQVSFEEVAM

SEQ ID NO: 9790 - protein, 81 aa, Athene cunicularia
PKVPVAFNDASFNFSEEEWKSLNEWQKELYRHIMKGNYEAVISMDAAISKPDLLSRIEQGEDPNAEDQEDSEGGETPTDPS

SEQ ID NO: 9791 - protein, 81 aa, Notechis scutatus
DIVTFEEVAVYFSKEEWSQLDADQQELYREVMLENSRNVLSLGFNGQENKKCKEERQAIHSKGAERKFVDQMQPKSDETKQ

SEQ ID NO: 9792 - protein, 81 aa, Alligator mississippiensis
LEGLVTFEEVAMYFTKDQWALLDPDQRALYRDVMLENYETVASLGFLTSKPDVVSQLEEGDAPWVPDCQECEERRSLRHTS

SEQ ID NO: 9793 - protein, 81 aa, Alligator mississippiensis
MQENDQTVLSVGFPIPSAAMISCLEQGEKPRVLDPLDSEMTEIPRVTDEGIPSNSKVDAPDSEKTELHEMLLRGSSQATSW

SEQ ID NO: 9794 - protein, 81 aa, Alligator mississippiensis
AQVPVTFEDVAVYFFREEWDVFADWQKALYREVMMENYGTLLSLGYAGPKPDILYRMERGEEPWVCTLQSPVVWESPGSPA

SEQ ID NO: 9795 - protein, 81 aa, Alligator mississippiensis
LDGLVTFEEVAIYFTQEEWDLLDPAQRAFYWDVMQENYDMVNSLWNLIYIPCMTSQPEYSQDPWVPALQCSEGMEFSNDIT

SEQ ID NO: 9796 - protein, 81 aa, Limosa lapponica
GQEPVTFEDVAIYLSRAEWEALEEEQRELYRSVMLDNYRLLSSLGYPGPKPDILHRLERGEEPWVCALPSPLRWDGHDSPS

SEQ ID NO: 9797 - protein, 81 aa, Alligator mississippiensis
PKMPVTFVDVAVYFSAEEWKNLEEWQKELYNNLVKENYESLISLGSSLSKADAQPRPERGVEPCIPQQPELEQRPIPVDHC

SEQ ID NO: 9798 - protein, 81 aa, Notechis scutatus
SGEKQRMKLPGFYDGDQTAVEPPNQEGLVSFEEVAVYFSEEEWSQLDPDQKALHSEVMLENHRNVVSLGKSFLVPNQEERF

SEQ ID NO: 9799 - protein, 81 aa, Callipepla squamata
LPPTIIPACRRVAMAPAHPSQEPVSFAEVAVYFSREEWALLDAAQQAPYRDMMLEMYKCVASLGEGFAAFPPHYGTFGCTE

SEQ ID NO: 9800 - protein, 81 aa, Alligator mississippiensis
MFEMVAVYFIKEQWALLDPAQTALYKEVMLENYATVASLAGFLISKPSLISRLEQGEELWVQAWQNYKEREIPGDSGSGDD

SEQ ID NO: 9801 - protein, 81 aa, Alligator mississippiensis
RTSPGRLEERGSLTPEPGQVQIPEVFEAVAVYFMRKEWELVEDEDKVLYRDQMLKNYQDLVSLGKALVVASPWRYANSEVL

SEQ ID NO: 9802 - protein, 81 aa, Athene cunicularia
FQEPVAFEDVAVYFSAEEWRGLAGWQKGLYKEVMMENYQLIASLGSAGPKPEVVLKLEQGEEPLLGDTPTAPIRGSPQAPS

SEQ ID NO: 9803 - protein, 81 aa, Callipepla squamata
LPPMILPACRRAAMAPAHPSQEPVSFVEVAVYFSREEWALLDAAQQAPYRDVMLETYKCVASLGESFAAFPPHYGTFGCAE

SEQ ID NO: 9804 - protein, 81 aa, Callipepla squamata
VAVTFEDVAVHFCPEEWALLSRWQRELYWEVMMDNYDLVNGLGSYGIPERTLQELLMDLKRCPKGLVLRHPKESHGIPQRT

SEQ ID NO: 9805 - protein, 81 aa, Alligator mississippiensis
LREVFEDVAVYFTQMEWELLEDDDKVLYQDQMLRNFQALVSLGGTWLLNGAEEETPVEGPANLGPPWTSPRSLGEMDSLRH

SEQ ID NO: 9806 - protein, 81 aa, Notechis scutatus
GSVTFEEVAVYFTEEEWALLDPSQRALHKEVMLENSRNVAALAYGQAHENNQEPSLVLFQGIQSEKGMVGNPGAAPKSRNI

SEQ ID NO: 9807 - protein, 81 aa, Notechis scutatus
QTQPVSFEEVAVCFSQGEWSLLGPSQRVLYKEVMQENYENVTSLVLSLTGLGPNSWMEEEDEAVLGLHSQLSEKGDNQDVR

SEQ ID NO: 9808 - protein, 81 aa, Lepidothrix coronata
KAPTLVLENDTTGFSAQEWENLEEWQRELCRKVLAGKSQTLVLPDDAMSEPALLSRLQGGEVPCSEDEVASREIPEDPDTG

SEQ ID NO: 9809 - protein, 81 aa, Notechis scutatus
FRRIPWEDPSQDTSGEKQGMNLSGFYDGDQTAAEPPNQEGLVSFQEVAVPFSEEEWSQLDPDQKALHSEVMLENHRNVVSL

SEQ ID NO: 9810 - protein, 81 aa, Alligator mississippiensis
RPSPGTRGQSGFLTPGPGQLQEGQGRPAKQGQSMELREVFEDVAVYFTREEWELLEEEDKGLYQDQMLRNHQALVSLVSSS

SEQ ID NO: 9811 - protein, 81 aa, Alligator mississippiensis
PQALVTFEEVAVYFSKGQWALLDPGQRALYRDVMQENYEMVASLAGFPVPQPDVISQLERGEEPWVMDLQEREILGYIHTD

SEQ ID NO: 9812 - protein, 81 aa, Alligator mississippiensis
LQEVFQDVAVYFTRKEWELLEDEDKVLYRDQMLRNFQALVSLGGAWLLGGAEEENHAERPANLEPPWASPGNFGDMDSLRP

SEQ ID NO: 9813 - protein, 81 aa, Alligator mississippiensis
PQVPVTFDDVSVYFSEEEWESLAGWQKELYKNVMKGNYETLVSLDYAISKPDLLSRIERGETPCIGEQAGSVDGEVPVDPN

SEQ ID NO: 9814 - protein, 81 aa, Athene cunicularia
SHEPVIFEDVAIYLSRAEWDAIEVEQKDLYCSVMLDNYELLTSLGYPGPKPDVLFRLERGEEPWVCTPQSPVRWDGSVRVP

SEQ ID NO: 9815 - protein, 81 aa, Alligator mississippiensis
LREVFEDVSVYFTRKEWELLEDEDKVLYRDQMLKNYQALISLGSLGEMDSLRPQKKQWHKSQARPKKQKENVAASQHRHVH

SEQ ID NO: 9816 - protein, 81 aa, Alligator mississippiensis
PGRLGERGSLIPELGQVQKGLVRPPKQEESLELQQVFEDVAMYFTQKEWELLEDDDKVLYRDQMLRNYQALVSLGYFVFLC

SEQ ID NO: 9817 - protein, 81 aa, Alligator mississippiensis
TLSRAEQQPPEEGPVILELQRTSPGRLEERSSLTSEPGQVQRGQGRPPEQGESLELQEVFEDVAVYFTQREWELLDDNDKD

SEQ ID NO: 9818 - protein, 81 aa, Alligator mississippiensis
AKLQVVFEDVALYFTRKEWALLEDGDKALYREQMLRNYQALVSLGAMSEPDPSIFATYSRAANWTHEEMKDLLTIWGREEN

SEQ ID NO: 9819 - protein, 81 aa, Alligator mississippiensis
MGGPVTLEEAAVYFAMDQWAAGDPRKALYKDDAQENYDTLVTLSDGTASENEEEAPEQEGPEIVEMDTALISRPEETVPQS

SEQ ID NO: 9820 - protein, 81 aa, Notechis scutatus
EGLVSFKEVAVYFSKEEWSQLDADQKALRIHTGEKPYKCMECRKCFSMKTNLKTHEMIHTGKKPYKCIECGKCFSTKTNLK

SEQ ID NO: 9821 - protein, 81 aa, Notechis scutatus
LVSFEEVAVYFSEEEWSQLDPDQKALNLEVMLENHRNVVSLGNNGQENQDSRELFQVINAKDGTEKFGIQMEFESHERNQS

SEQ ID NO: 9822 - protein, 81 aa, Lepidothrix coronata
DVSFEEVAIYFSPEEWAELLPWQRALYREVMADNYDLVASLGSVSKFTDMKEESPGDVPCAGGDSRTSDASSTVAQDGSAS

SEQ ID NO: 9823 - protein, 81 aa, Notechis scutatus
AQVLAAFGDVAVCFSAEEWAELAGWQKDLYRDVMAENFQLVSSLECLLAIPALLSQLAQREVPQIGAKRPPGQDEECQVAS

SEQ ID NO: 9824 - protein, 81 aa, Notechis scutatus
FRRIPWENPCQDTSGEKQRMKLSGFYDGDQTAVEAPNQEGLVSFEEVAVYFSKEEWSQLDPDQKALHSEVMLENYRNVVSL

SEQ ID NO: 9825 - protein, 81 aa, Callipepla squamata
NFCLPPVIIPACRRAAMASAHPSQEPVCFEEVAVYFSREEWALLDPAQRALYRDVMLETYQTVASLGEEFAAFPPLLGTFG

SEQ ID NO: 9826 - protein, 81 aa, Alligator mississippiensis
QMLVTFKEAAVHFTEEQWNLLDPDQRSLYTDVIQEIYEMVVSLGSLSPSTENDPPLDALSVPAGYWMARGTFSGGWNRPSR

SEQ ID NO: 9827 - protein, 81 aa, Alligator mississippiensis
EDISVSFEDISVSFARGEWEMLAEWQRELYWDVMVESYETLVSLGCDAPKPKILLLMEEKGKPYAEDAAERAGRDLDCASA

SEQ ID NO: 9828 - protein, 81 aa, Alligator mississippiensis
QSLVPVTLEDVALDFSPEWVELAAWQQDLYWDVMRENHTLVASLGYPALEPALFSHAERGEEPGAGEQLDPAGADIPWDPC

SEQ ID NO: 9829 - protein, 81 aa, Alligator mississippiensis
PQVPVTFDDVSVYFSEEEWESLAGWQKELYKHVMRGNYETLVSLDYAISKPDILSRLERGEEPCIRDQLAAWDGPEKGSQE

SEQ ID NO: 9830 - protein, 81 aa, Alligator mississippiensis
LREVFEAVAVYFTREEWELLDDEDKVLYRDQMLKTYQALVSLGGAWLLSKAEEQTPVEGPTDLEPPWTSPGHLGEMDSLRP

SEQ ID NO: 9831 - protein, 81 aa, Alligator mississippiensis
MTFEEVAVYFTTEEWALLDPSQRALYSAVMQENYETVASLGFPIPRLDVVSQMEEGEEPWVLDLQYSTESEMLRSILMVGE

SEQ ID NO: 9832 - protein, 81 aa, Alligator mississippiensis
AQGTVLFEEVAVYFSKGQWDMLDPGQKALYKDVMLENYKTLNSVGLHITKPQVISQLEQGEEPWIPDLQDLEERGILRNIN

SEQ ID NO: 9833 - protein, 81 aa, Callipepla squamata
CLPPVIIPACRRAAMASAHLSQEPVSFEEVAVYFSREEWALLDPAQRALYRDVMLETYECVASLVLKIKDRMWIEEWYEEV

SEQ ID NO: 9834 - protein, 81 aa, Callipepla squamata
PKVPVTFVDIAVYFSAEEWKNLEEWQKELYNNLVKENYESLISLDAALSRSDTQPRLERGDVPCVPEQQDLEQREMPPDAC

SEQ ID NO: 9835 - protein, 81 aa, Alligator mississippiensis
RMGERASLTPEPGQLEQREGMPPKQGGSLELLDAFEDVVLHFTRKEWELLEDEDKVLYRDQMLRNYQALVFLGKALVLAYP

SEQ ID NO: 9836 - protein, 81 aa, Alligator mississippiensis
GKLPEAFEDVAVYFTWKEWELLEAGDKGLYQDQMLRNYQVLVSLGYQGPTPDLICRIQQGEMELWVWEEEEDHCLRTCLQQ

SEQ ID NO: 9837 - protein, 81 aa, Notechis scutatus
MEPWVYLDQRQKALYRDVMQESYETLMSLAANQLLNNSNHDNEDEEDVEELRPGTSQSVPRKVKPLTRRETPKQPKIIPVV

SEQ ID NO: 9838 - protein, 81 aa, Notechis scutatus
DLVSFEDVAVFFSVEEWALLDSEQKALYQEVMLENKRNVASLGDRWEMEVSGQEAAAPLPKDKKEVAEKMYGKQSLKQNQL

SEQ ID NO: 9839 - protein, 81 aa, Callipepla squamata
GTLIQEYGQLQKSFSEDEWKNLNEWQKELYRHIMKGNYEAVISMDTAISKPDLLSRIEQGEDPNAEDPDDSEGGETPTDPS

SEQ ID NO: 9840 - protein, 81 aa, Alligator mississippiensis
PEPGQVQKGQGRPPKQAENLELHEVFEDVAVYFTQEEWELLDNEDKVLYQDQMLRDFKVLVSLGKALVLASSWSYMSCEIL

SEQ ID NO: 9841 - protein, 81 aa, Notechis scutatus
QCSVSFEDVAVYFTEEEWALLDSSQRALHREVMLENSRNLAAVGYGQEYENYQELNFTLFQSEERMLGIQRLLQKSTKSCL

SEQ ID NO: 9842 - protein, 81 aa, Alligator mississippiensis
MEEWGLLDARQRALCHHVIQENYGDAIALGFSVPKPAGISQLERGDAACGLDLPHGDRPPGPRAVPAVPRTSPRHFDCSDC

SEQ ID NO: 9843 - protein, 81 aa, Alligator mississippiensis
LREVFEDVAVYFTRKEWELLEGEDKVLYRDQMLRNFQALVSLGSLGEMDSLRPEKEQWPKCQGRPQKQMKNVAVNQHQYIH

SEQ ID NO: 9844 - protein, 81 aa, Alligator mississippiensis
AQTPVTFDDIAVYFSEEEWEELAQWQKELYQDVMRDNYEALVALGHVATRPDIVLLIEHGEKPCVKGPEDSGKRGIFNNDY

SEQ ID NO: 9845 - protein, 81 aa, Alligator mississippiensis
VPKVPATFEDNAVFSQEEWENLEDWQKELYKNVMKGNYEYLISLDYAISKPDILSRIERGEEPCPRDLPGSEGRETSADPN

SEQ ID NO: 9846 - protein, 81 aa, Alligator mississippiensis
AQLREAFEDVALYFTQKEWELLEDGDKVLYRDQMLRNYQALVSLGCRGPAPDLICRIQRGQGELWVGDDKEPGESAWFEGL

SEQ ID NO: 9847 - protein, 81 aa, Notechis scutatus
NFQEGQSQDATQESRKLSLEFLESPLSAGAEGLAELLVQDVVCFEEVAVYFSEEEWSQLDADQKELYTAVMLENSRNLLSL

SEQ ID NO: 9848 - protein, 81 aa, Notechis scutatus
PKVPLLFDDAACSFSEQEWRGLDESQKDLYRHIMMHNYQAVVSVDAAVSKPELLTRIEQRETLEQNDGRGDYPRDESSFGN

SEQ ID NO: 9849 - protein, 81 aa, Notechis scutatus
DLVSFEDVAVFFSMEEWALLDSEQKALYQEVMLENKRNVASLAGDGWEMEDSGQETAAPLPKDKKEVTEKLYVKQCLEQNQ

SEQ ID NO: 9850 - protein, 81 aa, Callipepla squamata
EPVSFEEVAVYFSREEWALLDPAQRALYWDVMLETYECVASLAPLPGPKPMVISLLEEGEEPWIPDVGSPEAVAGDVSPGE

SEQ ID NO: 9851 - protein, 81 aa, Alligator mississippiensis
TQLREAFEDVALYFTRKEWELLGDGDKALYRDQMLRNYQALVSLGCRGPAPDLIGRIQRGEVELWVCVDEHPRRHAWFEGL

SEQ ID NO: 9852 - protein, 81 aa, Alligator mississippiensis
SKLPEAFEDVAVYFTRKEWELLEAGDKGLYQDQMLRNYQALVSLGLQGPAPDLICRMQLGEMELWVCDDEEAGESSLSEDF

SEQ ID NO: 9853 - protein, 81 aa, Notechis scutatus
MEEWALLDYEQKAPHQEVMVEDTKNMASFGDGLKIVHAAQEMATPFLTAEKEVAERMSEKEKPEEKELKEELGKYSSSPYV

SEQ ID NO: 9854 - protein, 81 aa, Alligator mississippiensis
SQGLVTFEEVAMYFTKGQWALLDPNQRALYKEVMLENYETISTLAGFLVPKPDMITQLEQGGEPWVPDLQGSEGREMSRGA

SEQ ID NO: 9855 - protein, 81 aa, Notechis scutatus
LVSFEEVAVYFSEEEWSQLDPDQKALHSEVMLENHRNVVSLGNNGQENQDSCELFQVINAKGGTEKFGIRMEFESHERNQS

SEQ ID NO: 9856 - protein, 81 aa, Notechis scutatus
LVSFEEVAVYFSEEEWSQLDPDQKALHSEVMLENHRNVVSLGNDAQENQDSCELFQVISAKNGTEKFGIRMEFETHERNQS

SEQ ID NO: 9857 - protein, 81 aa, Athene cunicularia
PKVPVTFDDVSVYFNEQEWERLDRWQKDLYRAVMRGNYEMLISLDYAVSKPDILSRIERDEELHVQDGQEPPQTHIRDSQE

SEQ ID NO: 9858 - protein, 81 aa, Alligator mississippiensis
QVPVTFEDVAVYFSPEEWAELREWQKELYWDVMRENYELVASVGAGFADPKPEPALKPERERDSPILEPWDDSDGGVLDVP

SEQ ID NO: 9859 - protein, 81 aa, Alligator mississippiensis
EAFEDVALYFTQKEWELLEDRDKVLYRDQMLRNYQALVSLDSSDTKGTWDSSTEENSWHSFPRGETSLQAAGARMLSRAEQ

SEQ ID NO: 9860 - protein, 81 aa, Notechis scutatus
KMPVTFVDIAVYFSAEEWKNLADWQKDMYNNLMKENYESLLALGADVNVAKPEMHPRAERAAPESSVPEPPSTKERDVIPE

SEQ ID NO: 9861 - protein, 81 aa, Callipepla squamata
SQEPVSFEEVAVYFSREEWALLDPAQRALYRDVMLEMYEFVASLGEGFAAFPPLLGTFGSEECASARELQNKPHKVPSGQT

SEQ ID NO: 9862 - protein, 81 aa, Callipepla squamata
LQEPVSFEEVAVYFSREEWALLDPAQRALYWDVMLGTYECVASLAPHPGPKPMVISLLEEGEEPWVPDVGSPDAVAGDISP

SEQ ID NO: 9863 - protein, 81 aa, Alligator mississippiensis
MFEMVAVYFIKEQWALLDPAQTALYKEVMLENYATVASLGFLISKPSLISRLEQGEELWVQAWQNYKEREIPGDSGSGDDL

SEQ ID NO: 9864 - protein, 81 aa, Alligator mississippiensis
GQLQEGQGRPAKQGESMELQEVFEDVAVYFTREEWELMEEEDKGLYRDQMLRNYQALVSLGKALVALPSSHVSSAVLLSSS

SEQ ID NO: 9865 - protein, 81 aa, Alligator mississippiensis
LQEVFQDVAVYFTRKEWELLDDEDKVLYRDQMLRNFQALVSLGSAWLLREAKEETPVEGPADPESPWTFPESLGEMDSLRP

SEQ ID NO: 9866 - protein, 81 aa, Alligator mississippiensis
DQLQEAFEDVALYFTQNEWELLGDGDKVLYRDQMLRNYQALVSLGYQGPAPDLISRIQRQEVELWVCEEENPGESVWTEGL

SEQ ID NO: 9867 - protein, 81 aa, Alligator mississippiensis
VQLREAFEDVALYFTWKEWELLEDGDKVLYRDQMLRNYQTLDSLGYQGPTPDLIYRIQRGEVELWVCDEPGESVFSQGLSS

SEQ ID NO: 9868 - protein, 81 aa, Alligator mississippiensis
MLTPEPETPGFPITKPDMISRMEQKEEPWVLRVQGYEEKEILNGMRTAGGGILSENEENPHQDDPKSMEPYDTVSDASRGG

SEQ ID NO: 9869 - protein, 81 aa, Notechis scutatus
AQVPAAFRDVAVCFSAEEWAELTGWQKDLYRDVMAETFQLVSSLECLLAIPDLLSQLAQGEVPQIGARQPPGQDQECQVVS

SEQ ID NO: 9870 - protein, 81 aa, Callipepla squamata
SQEPLSFEEVAVYFSREEWALLDHAQRALYRNMMLETYECVASLAPLPAPKPMVISLLEEGEEPWIPDVGSLEAMAGDVSP

SEQ ID NO: 9871 - protein, 81 aa, Alligator mississippiensis
RGWAIGGRRMYFAEIQWALLDPGQRPVYRDVVPDGYGTLVSLDGGMTNANPQQGCLETAQPHGTLPGLRSELFVQQWFPKQ

SEQ ID NO: 9872 - protein, 81 aa, Notechis scutatus
QDRVTFEEVAIYFSAKEWETLTDWQKTLYLDVMKDNYKNLVSLGGRPTIKQEPPLDEDETGLPCCPLAWKGSQDPGSLSEQ

SEQ ID NO: 9873 - protein, 81 aa, Notechis scutatus
FPTQGPVSFEEVAIHFNSEEWLLLDPNQKTLHQEVMLETSRIVDSLVEDPDTENYQEPGVVPSQIIKIEIQGDTSSDKCGK

SEQ ID NO: 9874 - protein, 81 aa, Gopherus agassizii
SSMPMTFEDVAVYFTKEEWMLLDLGQRALYRDVMQENYENVTSLGFLMSRPDLIYQLEQGEETWVPDRQGSEQRGIQRGAC

SEQ ID NO: 9875 - protein, 81 aa, Gopherus agassizii
ALGLVTFEEVAVYFTESEWALLDPAQRALYRDVMEENYENVTSLAFPVSKPDVISWLEQGEEPWVPDLQNVENLQQDDAEQ

SEQ ID NO: 9876 - protein, 81 aa, Gopherus agassizii
TFTSSEVAVYFTKDEWALLDSVQRTLHRDVMQENCETVTLLVGFPISKPDVISQLERGEEPWVPELQGSEKEVLPRAAFPG

SEQ ID NO: 9877 - protein, 81 aa, Gopherus agassizii
VTFEEVAVYFTREEWALLDPTQRALHRNVMQENYENKALRETTTQQEILMGKRKNTCIECGKNLSDYSALIKHQRIHTGER

SEQ ID NO: 9878 - protein, 81 aa, Gopherus agassizii
LAQVRDSQGMAVYFTKEEWALLDPVQRALYRDIMQENYENVVLLGFPVSKPDVISQLEQEEEPWVPDLQGSEKEVFPRARP

SEQ ID NO: 9879 - protein, 81 aa, Gopherus agassizii
FQGPVTFEEVAVYFTKEEGALLDPTQRALYRDVMQENYETVTSLGKDSFSKPDVVSQLEQGEEPWVLDLQGSEERGILRGV

SEQ ID NO: 9880 - protein, 81 aa, Gopherus agassizii
FQGPVTFEEVAVYFTREEGALLDPAQRALYRDVMQENYENVASLGCPISKPDVITQLERGEEPWVPDLQGSEEGEVLRGAC

SEQ ID NO: 9881 - protein, 81 aa, Gopherus agassizii
FQGPVIFEEVAVYFTSEEWALLDPTQRALYWDVMQENYENVTSLGKGYFSKPHIISQLEQGEEPWVPDLQAGDAMLCEKEE

SEQ ID NO: 9882 - protein, 81 aa, Micrurus lemniscatus
QDLVSFEDVAVFFSMEEWALLDSEQKALYREIMLENKRNVASLDPLMAFSSSPGTSVLCNGGSTAAELPTQDLVSFEDVAV

SEQ ID NO: 9883 - protein, 81 aa, Gopherus agassizii
KVPVAFENDSVYFSEQEWQNLDEWQKELYKNVMKGNYESLISLGKYWFSLQEEELFVEEQGPLEEVEIFSEPSTGELSAVS

SEQ ID NO: 9884 - protein, 81 aa, Phasianus colchicus
CQEPVSFAQVAVYFSREEWALLDPAQRALYRDVMLETYQCVASLAPLPAHKPMVISLLEGGEDPWIPDVRSPEAVPGDLSP

SEQ ID NO: 9885 - protein, 81 aa, Podarcis muralis
LLFICGGPAERQKGYWEMIYNELKNCPVSFEDVAVFFAEEEWSLLDPDQRALHSEVMEDNCLVVTSLGKAPSFPSLQCVIL

SEQ ID NO: 9886 - protein, 81 aa, Gopherus agassizii
PVTFEEVAVYFTQGQGALLDPAQRALYRDVMQENYEMVTSLGKRFPSPWLLEGRIVLRWLIRATARAAMASHIAVVRHLCL

SEQ ID NO: 9887 - protein, 81 aa, Gopherus agassizii
FQRPMTFEEVAVYFTREGWALLDPTQRALYRDVMQENYETVTSLGFPVSRPHIISQLEQREEPWVPDLQGSEERQILRAPR

SEQ ID NO: 9888 - protein, 81 aa, Gopherus agassizii
ATKLLISSNKDVHGVVSGAADTECWTPSLSGAGDFEEVAVYFSREEWALLDPVQRALYRDVMQENYETVTSLGKEFCPLGY

SEQ ID NO: 9889 - protein, 81 aa, Gopherus agassizii
WSLLLQVPVTFDDVAIYFSREEWEMLADWQKELYQEVMRENYANLISLGKDQPSLFYWVQQDHCNPWTVFTPSQPPQRLSV

SEQ ID NO: 9890 - protein, 81 aa, Gopherus agassizii
QGLVTFEEVAVYFTREEGALLDPTQRALYRDVMQENYENVTSLDKVHATLTMPPLLCPVSSSFQHARDTHTSPLPSSVTEH

SEQ ID NO: 9891 - protein, 81 aa, Gopherus agassizii
EQGAVTFEEVAVYFTQGQGALLDPTQRALYRDVMQENYEMVTSLGFPITKPDLITQLERGEEPWVPDLQAWEERESPRGTH

SEQ ID NO: 9892 - protein, 81 aa, Gopherus agassizii
MLVTFEEVALYFTEGQGALLDPGQRALYGDIMQENYETVTSLGKDSCPLSYLKPWGLHFCTWSGSSLVSYIRGDWVSQSTP

SEQ ID NO: 9893 - protein, 81 aa, Gopherus agassizii
VSFEEVAVYFTQGQGALLDPAQRALYRDVMQENYEMVTSLGKGVPSPQILDAVGSPPQTTSSAQGGSVTILHSSWIPRSSS

SEQ ID NO: 9894 - protein, 81 aa, Gopherus agassizii
FQGPVSFEEVAVYFTREEWALLDPVQRALYWNVMQENYETVTSLGKESFSKPDVISQLERGEEPWVPDLQGSEKEVKIQRD

SEQ ID NO: 9895 - protein, 81 aa, Gopherus agassizii
PVTFEEVAVYFTSEEWSLLDPTQRALYWDVMQENYENVTSLGKVYRPLCSWKGKWRVKVYASPKMLLHKLSYHGIRGKIFS

SEQ ID NO: 9896 - protein, 81 aa, Gopherus agassizii
MDTPATDDLVAVYFTREEWALLDPTQRALYRDVMQEIYENVTSLGKEIERENTYSECGKNFRYRSSLIQHKIMHTKGRSYE

SEQ ID NO: 9897 - protein, 81 aa, Gopherus agassizii
HTGPVSFEEVAVYFTREEWALLDPAQRALYRAVMQENYENVTSLGKNSSGDSRIYLSTPDPSPSVQTEIPASLSNPGTPTR

SEQ ID NO: 9898 - protein, 81 aa, Gopherus agassizii
LVTFKEVAVYFSEEEWVMLYPGQRALYRDVMQENYETVTSLGKDSCPLRFFISPPYVRGISPNNLWLLGERLSPPHPLPCD

SEQ ID NO: 9899 - protein, 81 aa, Gopherus agassizii
GNTGKNQQGPTGRGLLLFQGPVTFEEVAVYFTREEWALLDPRQRALCRDVMQENYENVTLVKVHATPTMPPLLCPVSATAH

SEQ ID NO: 9900 - protein, 81 aa, Gopherus agassizii
FQGPVTFEEVAVYFTREEWALLDPTQRALHRNVMQENYENVTSLGKDSFSQPDVIFQLEQEEEPGVSLSITAGDVTVHEKE

SEQ ID NO: 9901 - protein, 81 aa, Gopherus agassizii
SRMPVTFEEVAVYFTQGQGALLDPTQRALYRDVMQENYETVTSLGFPLPKPDLISRLERGEEPWVPDLPACGEREIPRGAH

SEQ ID NO: 9902 - protein, 81 aa, Gopherus agassizii
CLGPVTFEEVAVYFTREEGALLDPTQRALYRDVMQENYENVTLLGKGSCPLGSWKGKCRVKVHATPTKHPPLFFSITPTSQ

SEQ ID NO: 9903 - protein, 81 aa, Phasianus colchicus
PKVPMAFNDTSFSFSEDEWKNLNEWQKELYRHIMKGNYEAVISMDTAISKPDLLSRIEQGEDPNAEDQDDSEGGETPTDPS

SEQ ID NO: 9904 - protein, 81 aa, Crotalus adamanteus
SLALAIFEEVAVHFTEDEWMLLNADQRVLHREVLEEIWKTLASLEILLALGSGQISRIDEDLPAEGFKEEEDNFRGNLSVG

SEQ ID NO: 9905 - protein, 81 aa, Podarcis muralis
MLVSFEDVAVYFTKGQWDLLDSHQKSLYSEVMGENYGHVAFLMGSPVLKPDLISRLEQEEEPWIPIPCEVDGGKTLDSGPG

SEQ ID NO: 9906 - protein, 81 aa, Podarcis muralis
HMWWTCRKDVAVFFAEEEWSLLDPDQRALHSEVMEDNSGGEWETQHNRDRLPKVSSERDRCKKSKTHTGQLPYKCLECGKS

SEQ ID NO: 9907 - protein, 81 aa, Podarcis muralis
MLLVRFTDEEWVLLDPDQRALHKDVMEENRGIVASLDCDELEIENKGDHEKIPREEKPQKNLECGESCSQSSNSTSHQQNL

SEQ ID NO: 9908 - protein, 81 aa, Podarcis muralis
QVTFEDVAVYFAEEEWRLLDPDQRVLHKEVMEENWGVVASLERQDSGDPQASGDLHATQAGSSEEFWERTVQKILGEKQDG

SEQ ID NO: 9909 - protein, 81 aa, Podarcis muralis
QGLVCFEDVAVHFTDKELALLDPDQRALHEEVMEENCGLLDSLGGDEMEINNKGDQERIHTVEEPYKYSDCEDNFIQSSQT

SEQ ID NO: 9910 - protein, 81 aa, Podarcis muralis
MPQTIEVAVYFTKEEWALLDPDQRDLHKEVMEENSENLQHYRHYRTATPIISVLVYNCLESLAIYQLLALYVFAHFLKWIN

SEQ ID NO: 9911 - protein, 81 aa, Podarcis muralis
SPLCFEDVAVCFTDKEWALLDPDQRALHKDVMEENWGIVASLGKPPCGIVLSARKFKTYLYWGKAALAPTASPTGSCDAFA

SEQ ID NO: 9912 - protein, 81 aa, Gopherus agassizii
VTFEEVAVYFTREEETLLDPAQRALYRDVMQENYEKATQSPDSPSQGPQTPPETQPGAHQIFPGTQSAESLARDPRCFSNP

SEQ ID NO: 9913 - protein, 81 aa, Phasianus colchicus
SQEPVSFAQVAVYFSREEWALLDPAQRALYRDVMLETYQCVASLAPLAAPKPMVISLLEGGEEPWIPDVHSPEAVPGDLSP

SEQ ID NO: 9914 - protein, 81 aa, Phasianus colchicus
CQEPVSFAQVAVYFSREEWALLDPAQRALYRDVMLETYQCVASLAPLPAPKPMLISLLEGGEDPWVPDVCSPEAVPGDLSP

SEQ ID NO: 9915 - protein, 81 aa, Podarcis muralis
VCFEDITVCFTAEEWALLDPAQRALHKEVTEENRGILASLSKAPSCIMRFVLQFHTYISIVRELNSAAFSSWASNTSTKTK

SEQ ID NO: 9916 - protein, 81 aa, Podarcis muralis
RMPVNFKEVAVHFPGDQGPLLDPDQRILHNSIMAENDENLAFLGDGQADVNEGDMQMQSSEQDKPTGSPPGLAGESVSQCL

SEQ ID NO: 9917 - protein, 81 aa, Podarcis muralis
PKVPVTFDDDAANFSTQEWAGLEDWQKELYRNITKGTYEPLVSLDSAISKADILPPMGQAEPPRAADHEFVGGKGFPAEPR

SEQ ID NO: 9918 - protein, 81 aa, Phasianus colchicus
LKAAEASESDTSCFAEQEWENLEEWQKELYKNVLRGNSESLNSLDYAISKPDLLSRLQRGEVPCSEVTSGQKEIPTEPSAD

SEQ ID NO: 9919 - protein, 81 aa, Podarcis muralis
MEDAWLVADPNQKPVYRETHQETCDSLVALRPASPKPNEIFLVEEDEETCVPASINRENARRATLVEGLGSEEEEESDEED

SEQ ID NO: 9920 - protein, 81 aa, Podarcis muralis
SQRDNLLPYFFYFQGLMTFRALLTFEEVAVFFTEEEWALLNPSQRALHREVMEDNYETVALLGKDTFLPYNNNNNLLAGFQ

SEQ ID NO: 9921 - protein, 81 aa, Podarcis muralis
GLVSFDEVSVRFTNEEWALLDPGQRALYEEVMEEIREMMTSVGDVSEFLTEGEQSEPSREGAEEQKEQRKQRVQVGTYRKE

SEQ ID NO: 9922 - protein, 81 aa, Podarcis muralis
QGPVCFEDVAVHFTDEEWVLLDPDQRALHKEVMEENREVMDSLSADELEIKNKRDHCKIHTVEKPYNYMVCGESFSQSFYS

SEQ ID NO: 9923 - protein, 81 aa, Gopherus agassizii
GPGPVTFEEVAVYFTREEGALLDPTRRALYRDVMRENYETVTSLGFPVSKPSVISQLEGGEEPWILDLQGSEESKILRSPW

SEQ ID NO: 9924 - protein, 81 aa, Gopherus agassizii
FQGPVTFEEVAVYFTKDEWALLDSVQRTLHRDVMQENCETVTLLGFPISKPDVISQLERGEEPWNEEEKPHQEDAEQGEPH

SEQ ID NO: 9925 - protein, 81 aa, Gopherus agassizii
FQGPVTFEEVAVYFTKDEWALLDSVQRTLHRDVMQENCETVTLLVGFPISKPDVISQLERGEEPWVPELQGSEKEVLPRAA

SEQ ID NO: 9926 - protein, 81 aa, Gopherus agassizii
FQMPVTFEEVAVYFTQGQGALLDPAQRALYRDVMQENYETVTSLGFPLPKPDLISRLERGEEPWVTLLFQMPVTFEEVAVY

SEQ ID NO: 9927 - protein, 81 aa, Gopherus agassizii
AVYFTREEGALLDPNQRALYRDVMQENYENVTSLGKSYSPFSSWNGKRRVMVHASHTMQPLLCPVSASPQYASDTHTTRDP

SEQ ID NO: 9928 - protein, 81 aa, Gopherus agassizii
MTQGREMEVAVYFTSEEWALLDPTQRALYWDVMQENYENVTSLAGFPVSKPHIISQLEQGEEPWVPDLQGSEEREILSFSC

SEQ ID NO: 9929 - protein, 81 aa, Gopherus agassizii
KGVPVTFEDVVVYFSPEEWAALAEWQRELYRDVIMENYELVASLGEDPFISRRSSQWGPFLWDVQTESGGVSLSPADSVPL

SEQ ID NO: 9930 - protein, 81 aa, Gopherus agassizii
FQMPVTFEEVAVYFTQGQGALLDPTQRTLYRDIMQENYETVTSLGKGFLSPRLLEAMGSACLNLVRLFPGQLDQRRMGSIM

SEQ ID NO: 9931 - protein, 81 aa, Micrurus lemniscatus
FEDVAVYFSEEEWSRLDPDQKALHSEVMLENHRNVVSLGNNGQENQDSYELFQVICAEDGTENFRIRMEFKSHERSQSKNW

SEQ ID NO: 9932 - protein, 81 aa, Gopherus agassizii
FLFQGPVTFEEVAVYFTREEWALLDPVQRALYRDVMQENYETVVLLVSKPDVISQLERGEEPWVPDLQGSEKEVLPRAAFP

SEQ ID NO: 9933 - protein, 81 aa, Gopherus agassizii
CTSASPATAIPLPVCKLCHAELGCLSFQMLVTFEEVAMYFSPAEWALLGEEQRQLYRHVMWENYQILVSLGNIFYWANFCC

SEQ ID NO: 9934 - protein, 81 aa, Podarcis muralis
MLLVRFTDEEWVLLDPDQRALHKDVMEENRGIVASLDCNESEIENKGDQDKIPREEKPRKNLECGESCSQSSHSTSHQQNL

SEQ ID NO: 9935 - protein, 81 aa, Podarcis muralis
NLTDKSPVAHFSTPYPGWTTNKGIAFLFQGSMSFEGVSLHFTDDECSLLDPGPRVLYKEVMMEIYEMVASVDKVLSPLINS

SEQ ID NO: 9936 - protein, 81 aa, Podarcis muralis
MQENYETLISLAEEMAISLPRITALADSHRRGLASAGFPLSKPDLLSWMDRGEDPWVPDFQEPEGREMPSESSPGDELRRK

SEQ ID NO: 9937 - protein, 81 aa, Podarcis muralis
NSLCFEDVAVHFTDDEWALLHPDQRALHEEVMGENREIMDSLGKTPCCITISVLKIIHTSIAPTASGTAHLECTVIYCLVC

SEQ ID NO: 9938 - protein, 81 aa, Xenopus tropicalis
GMVPVSFDEVAVYFSADEWHYLSERQRDLYKEVMLENLEVVLSLGYQYRRAAPQAVPAHGSAFILSTGKYFDECSPLFSEE

SEQ ID NO: 9939 - protein, 81 aa, Microcaecilia unicolor
DQVPVTFNDVAAYFWEVEWDVLGEWQKELYKNVIKEIHSLLMSRGYSIVNPDVIFKIKKEDEKYFTQHCEWERKEKTNDPS

SEQ ID NO: 9940 - protein, 81 aa, Microcaecilia unicolor
QQVQVTFEDIAISFSQEEWDYLDEGQKELYRQVMKENYETLISLGYERINPDILSRIKRKEEPYVQEVQESEEKEDCHSYT

SEQ ID NO: 9941 - protein, 81 aa, Microcaecilia unicolor
VPDKALFKDVSAYFLEVEWEILGEWQKELYKKVIKEIHDILISRGYSIVNPDVIFKIKKEDEKCLMHHFEWEGKENPDDPM

SEQ ID NO: 9942 - protein, 81 aa, Microcaecilia unicolor
DQASIIFRDVAAYFLDVEWNILGEWQKELYKKVIKEIHDILMSRGYSIVNPDVIFKVKKEDEKYFTQHFECEGNKNPNDPT

SEQ ID NO: 9943 - protein, 81 aa, Microcaecilia unicolor
VPDQDLFKGVSAYFLEADWDILEEWQKELYEKVIKEVHDILISRGYSIVNPDDMFKLLKEDEKYFTPHFEWEGKENPDDPT

SEQ ID NO: 9944 - protein, 81 aa, Microcaecilia unicolor
DQASVTFSDVAAYFLEVDWDSLGEWQKELYKKVVKEIHNFLFSRGYSILNPDVIFKIKKEEKHLTQHYELEGKENMNDPSM

SEQ ID NO: 9945 - protein, 81 aa, Microcaecilia unicolor
NEALVTFKDVAAYFLEVDWDLLGERQKELYKKVIKEIHDILTSRGYSIVNPDVIFKIKKEDEKYFIQQFEREGNENPNDST

SEQ ID NO: 9946 - protein, 81 aa, Microcaecilia unicolor
KVPVKFEDVAVSFSQDEWGYLDEGQKELYREVMKENFQTLISLESGLQRIEEPYVQDPQEADGREFVQSYSDHEIMQKEER

SEQ ID NO: 9947 - protein, 81 aa, Microcaecilia unicolor
QVPVTFEDITVYFSREQWEYLDEGQKELYREVMKENYETLISLGIDHQSINPEVLSRIKQEEESPVWDPKESGEREVTHSD

SEQ ID NO: 9948 - protein, 81 aa, Microcaecilia unicolor
LLFQALFKDVAAYFLEVDWDILGEWQKELYKKVIKEVHDILISRGYSIVNPDVIFKIKNEDEKYFTQHFEWEEKENPDHLI

SEQ ID NO: 9949 - protein, 81 aa, Xenopus tropicalis
SKVSVHFSEVAVYFSEEEWQCLSKSEKDLYQTVTMDSYYMLLSLDLLNVKPEIVQRIEQGRDPSVSCHQEMLWRKKCMGTQ

SEQ ID NO: 9950 - protein, 81 aa, Microcaecilia unicolor
RTMRVTFEDIAVSFSQEEWEYLDKGQKELYREVMKENYETLISLAHNEAVQELKQEQNREEPPVEMEQIPRQSGNVCENFS

SEQ ID NO: 9951 - protein, 81 aa, Microcaecilia unicolor
VDCVQMPVTFQDIAVSFSQEEWEYLDEGQKELYMEVMEENLELLTSVGSLVVQLEQNQEFYVMEQRGTPLIPYTGNGVGVG

SEQ ID NO: 9952 - protein, 81 aa, Microcaecilia unicolor
DQALVTFKDVSAYFLEAEWDILGGWERELYRKVVRDIHDILTSKGYSIVNPDVIVKIKKEDETYLTQHFEWEGKENPNKSF

SEQ ID NO: 9953 - protein, 81 aa, Microcaecilia unicolor
DQASITFKDVAAYFLEVEWDILGEWQKELYKRVIKEIHDILMSRGYSIVNPDVIFKIKKEDAKYFTQHFEWEGNENLNDPT

SEQ ID NO: 9954 - protein, 81 aa, Microcaecilia unicolor
NEVSITFNDVSVYFLEVEWDILGEWQKELYKTVIKEIHDNLMSRGYSIVNPDVIFKIKKEDEEKENPDDPTKSFPIVTSVF

SEQ ID NO: 9955 - protein, 81 aa, Micrurus paraensis
EEVAVYFSEDEWSQLDPDQKVLHLEVMLENHRNVVSLGNNGQDSCELFQVINAKDGTKMFGIQMEFESHERNQSKNWNQES

SEQ ID NO: 9956 - protein, 81 aa, Micrurus paraensis
QDTSGGNRVISFAFVRPSCSGGTEGVAEAPAQGLVSFEEVAVYFSEEEWSQMDAHQKALHKEVMLENSQNVASLGAREQEN

SEQ ID NO: 9957 - protein, 81 aa, Xenopus tropicalis
YQVSVTFHDVAACFSAEEWAGLQDWQKELYRNVMREIHTALQAMGFEIINPDVLFRIKKVKEVYSSLMERAEPSAAFPGAE

SEQ ID NO: 9958 - protein, 81 aa, Bambusicola thoracicus
PKVPVTFDDVSVCFNDKEWEKLEEWQKELYKNVMKGNYESLISLDYAISKPGVLSQIEQGEEPRVRNEQDLEESEMMSDAT

SEQ ID NO: 9959 - protein, 81 aa, Xenopus tropicalis
SFDQVTFEDVAVYFSEREWASLLDAQKDLYKSVMRDNYEAVTSLGFPVVRPKAWGRMCQGVTVKLEGTEQMDIGDSAQNMK

SEQ ID NO: 9960 - protein, 81 aa, Xenopus tropicalis
VTHTYQSTPVQFSEEEWGFLNERQKLLYKEVMTENYLIKYKRKIRRRKQNHRRKPARPVVPVNRKPLACSQCGKQYVKKLC

SEQ ID NO: 9961 - protein, 81 aa, Lithobates catesbeianus
EAEHPHFDDIAVYFTEEEWACLNDKERNLYKKVMMDNYWNLVAVGKVSVTPPLISKIERGEELCIRSLQQADHKQFPDLDS

SEQ ID NO: 9962 - protein, 81 aa, Microcaecilia unicolor
QMQVKFEDVAVSFSQEEWEYLDEEQKELYREVMKENYQILISLGIGSSTSTPKIISHIERGEEPYSRDEPGSEERETGKNS

SEQ ID NO: 9963 - protein, 81 aa, Microcaecilia unicolor
QVPPVTFSDVAAYFWEVEWDILGERQKELYKKVILEIHGILMSRGYSIFNPDAIFKIKKGDGKYFTQHCEWEGKENLNDPS

SEQ ID NO: 9964 - protein, 81 aa, Microcaecilia unicolor
MMVNYQTLISLETDSVTVTPDIISHIERGEAPYIRHELGSEERKTGKSSCSENDNLRNSSKETHHWKLGENPEENKMLSEA

SEQ ID NO: 9965 - protein, 81 aa, Microcaecilia unicolor
MKENYETLISLGYERIEPDILSKTEEKEEPNIQNLQESRERDATHSYTAEKIKQKQTKEKKLVLKMQQMIHRERPKKKPCM

SEQ ID NO: 9966 - protein, 81 aa, Microcaecilia unicolor
QQMRVTFEDIAVSFSQEEWEYLDEGQKELYREVMKENYETLISLDYERIDPDILSKIKQEEEPFVQELLESEKKEDYHSFT

SEQ ID NO: 9967 - protein, 81 aa, Microcaecilia unicolor
MRVTFEDIAVSFSQEEWEYLDEGQKELYREVMKENYEILISLGYEMISPDTLSRIKQEEEPYVWDPHESREREVTHADTAV

SEQ ID NO: 9968 - protein, 81 aa, Microcaecilia unicolor
AQVPVTFEDIAVYFCEGEWETLAEWQKELYKETMKENYETLTSLDSSSEKPSLISKIEREEDPCVRDQQDPRDRRRLRSCW

SEQ ID NO: 9969 - protein, 81 aa, Microcaecilia unicolor
QMRVTFEDIAVSFSQEEWRYLDEGQKELYREVMEENYETLLFLETNHQFIDPDVLSKIKQHSRKPGKREVGGSYSADNEAK

SEQ ID NO: 9970 - protein, 81 aa, Microcaecilia unicolor
VPVTFEDISVDFSQEQWEYLNEGQKELYREVMKENYETLISLEDDRRNSNTERHQWKLSVETEEEKMLSESDKEGTTSDLG

SEQ ID NO: 9971 - protein, 81 aa, Microcaecilia unicolor
QVPVTFEDIAIYFSQAEWEDLEEWQKELYMDVMKENYEILNSLGTGSPTVTPDIISHIEREEELYIRNELRSEERETGKSS

SEQ ID NO: 9972 - protein, 81 aa, Microcaecilia unicolor
QLPVMFEDVTVYFSQEQWNYLDESQKELYREVMKENYEILISLGVDHESINSEVLSRIKQEEEPRVWDPKEPGRKEVPQSC

SEQ ID NO: 9973 - protein, 81 aa, Xenopus tropicalis
TTTSIGFNEVAVYFSEEEWRNLELWQKELYSNVMREIHTTLISLGYTIAHPDVLCRIRKDQDPYISSLEEERKTSCFPSTS

SEQ ID NO: 9974 - protein, 81 aa, Xenopus tropicalis
EVHIKSGDAAVYFSTEEWEYIERHKESYKDVMMETLGTLGIPTSKTSGKIVTEVASDKEQKEESFAIRRLDTEVQEIKENS

SEQ ID NO: 9975 - protein, 81 aa, Xenopus tropicalis
VTFDDVAAYFSEDEWKDLEECQKELYKDMMKENYEALISLGNFTPYSNNTLLLDDGPISDKEKSKYNDKLESIEAPPLPML

SEQ ID NO: 9976 - protein, 81 aa, Bambusicola thoracicus
KVPITFDDIAVYFNEQEWERLDSWQKDLYKAVMRGNYETLISLGKAQALLLPPDILSRIERGEELCVKDCWEPPQTLNQDG

SEQ ID NO: 9977 - protein, 81 aa, Microcaecilia unicolor
QVPVTFEDITVYFSQEQWGYLDEGQKKLYREVLKDNYEILISLGTDHGSINPEVLSRIKQGDEPHVWDTKESGEREVTHSC

SEQ ID NO: 9978 - protein, 81 aa, Microcaecilia unicolor
AQVPVTFEDIAVYFSQEEWGYLEEEQKEVYREVMKDNYETLISLGCPILKPAVISSIERGEEPCIGKLQERAELSLTAGDE

SEQ ID NO: 9979 - protein, 81 aa, Microcaecilia unicolor
TQVPVTFEDIAIYFSQAEWEDLEEWQKELYMDVMKENYEILNSLGSPTVTPDIISHIEREEELYIRNELRSEERETGKSSC

SEQ ID NO: 9980 - protein, 81 aa, Microcaecilia unicolor
QIPVTFEDIAIHFSQEEWETLEEWQKELYKDVMKENYETLILLENDDPRNNNTKIPHWGLGENPAGKKILSERGKEGISSC

SEQ ID NO: 9981 - protein, 81 aa, Microcaecilia unicolor
QMQVKFEDIAVSFSQEEWEYLDEEQKELYREVMKENYQILISLGTGSSTFTPEIISHIERGEEPYSRDEPGSEEREPGKSS

SEQ ID NO: 9982 - protein, 81 aa, Microcaecilia unicolor
AQVPVTFEDVAVYFSEDEWEMLAEWQKELYKETMKENYETLLAMSSSSEKPSLLAKIEQEEDPCVSNQQDLRDRIRPKRSW

SEQ ID NO: 9983 - protein, 81 aa, Microcaecilia unicolor
AQASVTFHDVAVYFSEEDWQQLEERQKELYRSVMKEIHGALISLGYTILNSDVYFRIREENGRYFRADDLERSKGIKECTT

SEQ ID NO: 9984 - protein, 81 aa, Xenopus tropicalis
PKICVTFRNLAACIATEDLAALTERDINMYKDAMQEIHKTLLSMGHRILNPEILMFTEETENCQATKKQKLNACIHKLDST

SEQ ID NO: 9985 - protein, 81 aa, Lithobates catesbeianus
TGEVPIRCHDVTVYFSMEEWEYLEGHKDLYKDVMMENQPPLTSLDGSSNGNPPERCPHPLYSRDSTQEDHTISFIFMCILI

SEQ ID NO: 9986 - protein, 81 aa, Terrapene carolina
MWHLPQAQNNGVLLSSGDTPGWGLERKLQVAFEDVALYFTQEEWELLSQPEKQLYRDQMLRNYRALVSLGKDQFPFFYSQL

SEQ ID NO: 9987 - protein, 80 aa, Terrapene carolina
VSLSLGLRGLQRCDVAVYFSPEEWAALAEWQRELYRDVMRENYALVASLGEDPFRPSHGTNVRLRSLQIWPIYCPVIEHS

SEQ ID NO: 9988 - protein, 81 aa, Terrapene carolina
MRENYDAMIALGSPVAKPEIVPRVEQAEEPRAKAPGEAEQREAPGSASPGSVVPKPEIVPQGEREQQQQHGGGEQMGLEGQ

SEQ ID NO: 9989 - protein, 81 aa, Terrapene carolina
NFWILRLPSGTKGEVPKGWESAAKWQKELCENVMKGNFETLISLDSAISKPSILSRLERGEEPCVEDGPEETEIPMEPSMD

SEQ ID NO: 9990 - protein, 81 aa, Microcaecilia unicolor
DQASFTFKDVAAYFLEVEWDILGEWQKELYKKVIKEIHDILRSRGYSIVNPDVIFKIKKEDEKYFTRHVEQEGKENLNDPT

SEQ ID NO: 9991 - protein, 81 aa, Microcaecilia unicolor
MKENYQILISLGTPALTPEIISHIERGEEPYIRDEPGSEERETGKSSCSDKSIKKQGEYLVEMEQIQRQAENVSENISRGI

SEQ ID NO: 9992 - protein, 81 aa, Microcaecilia unicolor
KVPVTFEDIAVSFSQEEWGYLDETQKKLYREVMKESYDNLMSLAGKEIKLEKVKEEIKEEAEEEWTVELDLTQTPSGNACE

SEQ ID NO: 9993 - protein, 81 aa, Microcaecilia unicolor
QVSVTFEDIVIYFSQEEWEDLEEWQKELYKDVMKENYQTLLSLGTGCLTVTPDIISHIERGEEPYIRNDLGSEERETGKSR

SEQ ID NO: 9994 - protein, 81 aa, Microcaecilia unicolor
QVPVTFDDVAAYFSEEEWKDLEECQKELYKDMMKENYEPLISLDDGPMNEKEKHHLKYNEKIEPNEPLPVTVLEDTTQCSD

SEQ ID NO: 9995 - protein, 81 aa, Microcaecilia unicolor
QSLVTFKDVAAYFSEVEWNVLGEWKKELFKKVIKEIHDILVSRGSHTVKPDILIRFEQEGFKTEPLGFEERGNLTTTGTYI

SEQ ID NO: 9996 - protein, 81 aa, Microcaecilia unicolor
DQALVTFKDVSAYFLEADWDILGEWQKELYKKIIKEIHDILISRGYSIVNPDVIFKIKKEDEKYFTQYFEWEVKENPDDFM

SEQ ID NO: 9997 - protein, 81 aa, Microcaecilia unicolor
KMQVTFEDIAISFTQEEWEYLDEGQKELYREVMKENYETLMFLAENEMTVKEAKESNREEHSLKWTLHPRHVCVSQGTERG

SEQ ID NO: 9998 - protein, 81 aa, Microcaecilia unicolor
MSDQALFKDVAAYFLEVDWDILGEWQKELYKKVIKEVHDILISQGYSVVNPDVIFKIKNKDENYFPQHFEWEEKKTQMISL

SEQ ID NO: 9999 - protein, 81 aa, Microcaecilia unicolor
DQALVTFRDVAAYFWEEEWHVLGEWQKELYKEIIKEIHSFLMSRGYSIFNPDVIFKIKKDDGKYFPHHCKQEEKENLDDPS

SEQ ID NO: 10000 - protein, 81 aa, Microcaecilia unicolor
VTFEDITVCFSQEQWEYLDEGQKELYREVMKENYENLISLGKGDPRNSTTELHHWKLSEEIEEENTLFVRDKEDTSSCSDW

SEQ ID NO: 10001 - protein, 81 aa, Microcaecilia unicolor
DQASVMFSDVAAFFLEVEWDILGEWQKELYKKVIKEIHIFLISKGHSVLNPAVIFKIKNEDEKHFTQYCEWEGEKNVKNPT

SEQ ID NO: 10002 - protein, 81 aa, Microcaecilia unicolor
DEALFIFRDVAAYFLEVDWDILGEGQKELYKKVIKEIHDILMSRGYSIVSPDVVFKIKKEDEKYFTQPFEWEGKENPYDST

SEQ ID NO: 10003 - protein, 81 aa, Microcaecilia unicolor
FQVSVIFKDVAAYFLEVEWNILGESQKELYKMVIKEIHGILMSRGYSIVSPDVIFKIQKEDEKYFTHHFEWEGKENPNDPT

SEQ ID NO: 10004 - protein, 81 aa, Terrapene carolina
MPVTFEEVAVYFTEGQGPLLDPSQRALYRDVMQENYKMVTSLGFPIPKPDLIARLERGEEPWVPDIQTSEESEIPRGSHTG

SEQ ID NO: 10005 - protein, 81 aa, Lithobates catesbeianus
IRCQDVTVYFSMEEWEYLEGHKDLYKNVMMDHHRSLNSEKFEKNAFFLNEILFNLILEIIYLLTAEDFSVVMKKPLNITKR

SEQ ID NO: 10006 - protein, 81 aa, Lithobates catesbeianus
PIRCQDVTVYFSMEEWEYLEGHKELYKDVMMENHQKLKCGKSFTTKGGLLRHHRSHTGERPYSCSEVWEMFYYKRRASATP

SEQ ID NO: 10007 - protein, 81 aa, Microcaecilia unicolor
DQVPLTFDDVAVYFTLDEWRKLEDWQKELYKTTMQENYDSLESMGFPIKKPEVVSRIEQGEEPWVMENAGSSILGTNTILA

SEQ ID NO: 10008 - protein, 81 aa, Microcaecilia unicolor
NEALVTFKDVAASFLEADWDLLGEWQKELYKKVIKEIHDILMSRGYSILNPEVIFKIKNEDEKYIIQQSEWEWKNPSNDST

SEQ ID NO: 10009 - protein, 81 aa, Microcaecilia unicolor
EPASVTFSDVAAYFWEAEWDVLGEWQKDLYRKVIKEIHGILMSLGYSIVNPDVIFRIKQREEKYFSQHYDWKEKENNDNPS

SEQ ID NO: 10010 - protein, 81 aa, Microcaecilia unicolor
VPDQALFKDVAACFLEVDWDILGEWQKELYKKVIMEVHDILISLGYSIVNPDVIFKIKNEDEKYFTQHFEWEEKENPDHLI

SEQ ID NO: 10011 - protein, 81 aa, Microcaecilia unicolor
MLLTFHDVAVTFSEEEWQLLEDWQKDLYRNVMKETYDNLLSLMPVTFHDIAICFSEEEWQLLGEHQKALYRNVMKENYDIL

SEQ ID NO: 10012 - protein, 81 aa, Microcaecilia unicolor
QVPVIFEDVAVYFWEEEWEMLEEWQKELYKETMKENYKTLVSLGMELPTEKPDLIVRIEREENPCVKAQWDSRDKTRWRNS

SEQ ID NO: 10013 - protein, 81 aa, Microcaecilia unicolor
QKWVTFEDIAVSFSQEEWGYLDEEQKELYREVMKENYQTLISLGHQITQGRKREKKKGEHLVEIEQIQRKTENVCKNVSQA

SEQ ID NO: 10014 - protein, 81 aa, Microcaecilia unicolor
NVPVTFEDIAVYFSEEEWEDLKEWQKELYKDVMKENYQTLISLGAGSLTVTPDIISHIEEGEEPYIKDELESEERETGKSS

SEQ ID NO: 10015 - protein, 81 aa, Microcaecilia unicolor
VIFNKVAIYFSEEEWQLLEEWQKELYRNVMKEIHGTLISLGHKVLNRGVLFRIKNEDMLHHGREEKQLLGLARALVTFHDV

SEQ ID NO: 10016 - protein, 81 aa, Microcaecilia unicolor
MKENYETLISLGFERKGSDILSRIKQEEEPYALDPQETREREVTHPYTDNEAILELKREQNQEKTPVKMEQIPGQPKTFCE

SEQ ID NO: 10017 - protein, 81 aa, Microcaecilia unicolor
TLKKATFDDVAIYFSSEEWSQLDEDQKTIYRHVMEDNYQIMISLGYDIPKPEVLLLMEQGRDPCIQDHIDSARESIDGMVI

SEQ ID NO: 10018 - protein, 81 aa, Microcaecilia unicolor
QVPVTFEDITVYFSREQWEYLDEGQKELYREVMKENYETLISLGTGPEGFNPEVLSRIKLEEESRVWDPKEPGQKEVTRSY

SEQ ID NO: 10019 - protein, 81 aa, Microcaecilia unicolor
QVPVTFEDIVIYFSRGEWEELEDWQKELYKDVMKENYQTLISLGRGSRTETPDIISHIERGEEPYIRDELGSEERITGKGG

SEQ ID NO: 10020 - protein, 81 aa, Microcaecilia unicolor
VTFEDIAVSFSQEEWEYLDEGQKELYREVMKENYETLISLVNEAEQEELKREQNQEESVIQTEQNGDRNISQRMERRHPRN

SEQ ID NO: 10021 - protein, 81 aa, Microcaecilia unicolor
DQTLVTFRNVAAYFLEVEWNILGEWQKELYKKVIKEIHGILMSRGYSIVNPDVIFKIKKEDGKYFAQDCELKGKENLNDPT

SEQ ID NO: 10022 - protein, 81 aa, Microcaecilia unicolor
AAAQVLVTFDNAANYFSEDEWKGLDEGQKTTYREMKEDAPEAPVLLGVDSEVLSKIKEENEPLCNDYCAFDGKENNPSPST

SEQ ID NO: 10023 - protein, 81 aa, Microcaecilia unicolor
MRVTFEDIAVSFSQEEWEYLDEEQKELYREVMKENYQTLISLGAGSLTFTPEIISHIERGEEPYSRDEPGSGEREPGKSRC

SEQ ID NO: 10024 - protein, 81 aa, Microcaecilia unicolor
QEPVTFEDITVYFSQEQWEYLDEGQKELYREVMKENYETLISLGIDHESINPEVLSRIKQEEKLHNRDPKDSGEIEVKHSY

SEQ ID NO: 10025 - protein, 81 aa, Microcaecilia unicolor
QMWVTFEDIAVFFSQEEWEYLDEGQKELHREVMKENYEILMFLEKEEPENSNTEKVSEKPEGEKMLSERENEQTYSCSDWG

SEQ ID NO: 10026 - protein, 81 aa, Microcaecilia unicolor
DQASVVFKDVAAYFLDTEWNILGEWQKELYKKVIKEIHDILKSRGYSIANPDVIFKVIKEDEKYFTHHFEWEGNQNPNDPT

SEQ ID NO: 10027 - protein, 81 aa, Xenopus tropicalis
VSPKVIFRDVAVYFSEKEWDLLEGWQRDLYTGVIKEIHGILISLGFIILNPNNFLRIQPEDEPCLKSRNVLERNESINITE

SEQ ID NO: 10028 - protein, 81 aa, Xenopus tropicalis
QQVSVTFHDVAACFSAKEWARLEDWQKELYRNVIREIHATLEAMGCTIANSDVLLKIKEDDAGGSRKDSDKTDTGTAPSGT

SEQ ID NO: 10029 - protein, 81 aa, Terrapene carolina
MPVTFEEVAVYFTQGQGALLDPSQRALYRDVMQENYEMVTSLGKGFPSPQILEAVGSARRQGFKSRAVCESAMLPEITHPG

SEQ ID NO: 10030 - protein, 81 aa, Lithobates catesbeianus
GEVPIRCQDIAVHFSMKEWEYLEGHRDLYRDDDMEKSQPFISLDGGLPAYEPDGYPLPAHHLEDRNKDLFVMKFTQSRASS

SEQ ID NO: 10031 - protein, 81 aa, Lithobates catesbeianus
PIRCQDVTVYFSMEEWEYLEGHKDLYKDVMMDNRTYNVQHDQSGNLGDDNLVKEEHIEGGEKYGVMTEFLEGHMDVAFEPP

SEQ ID NO: 10032 - protein, 81 aa, Microcaecilia unicolor
TGNLTTTGRCEELPEACDEATIKASNEALVTFKDVAAYFLDVDWDLLGERQKELYKKVIKEIHDILISRGYSILNPDTFQL

SEQ ID NO: 10033 - protein, 81 aa, Microcaecilia unicolor
DQASVSFKDVAAYFLEAEWDILREWQKELYKKIIEEIHDILRSRGYSIVNPDVIFKIKKEDEKHFTQHVEQEGKENLNDPT

SEQ ID NO: 10034 - protein, 81 aa, Microcaecilia unicolor
DQALVTFKDVSAYFLEAEWDILGEWQKELYKKAVKEIHDILTSKGYSIVNPDVMFKIKKEDEKYFTQHFEWEGKENPNDPM

SEQ ID NO: 10035 - protein, 81 aa, Microcaecilia unicolor
DQSLVTFNDVAAYFSEVEWNVLGEWKKELYKKVIKEIHDILVSRGYSIVNPNTIFKIKKEDEKYFTQQFEWEGKENPNDST

SEQ ID NO: 10036 - protein, 81 aa, Microcaecilia unicolor
MSDQALFKDVAAYFLEVDWDILGEWQKELYKKVIKEVHDILISQGYSIDNPDVIFKIRNEDKKYFTPHFEWEEKENPDDLI

SEQ ID NO: 10037 - protein, 81 aa, Microcaecilia unicolor
DRVKFTFSDVAVYFSEEEWQLLEEQQKELYRNVMKENYTTLTSLGYTTVKPDVISKIEQGKQPSVSSPSGSKGRRAVGRPT

SEQ ID NO: 10038 - protein, 81 aa, Microcaecilia unicolor
MPVTFEDIAVSFSQEEWEYLDEGQKELYREVMKENYEILISLAGYERISPDTLSRIKQEEEPYVWDPHESREREVTHSDTV

SEQ ID NO: 10039 - protein, 81 aa, Microcaecilia unicolor
AKAAVTFDDVAVYFSEEEWEKLEEGQKELYKETMKDNYEALISLGVPVFKHEIISRIETGEEPCVQGSQNLEQREMPESDF

SEQ ID NO: 10040 - protein, 81 aa, Microcaecilia unicolor
NEALVTFKDVAAYFLEVDWDLLGERQKELYKKVIKEIHDILTSRGYSIVNPDVIFKIKKEDEKYFIQQFQREGNENPNDST

SEQ ID NO: 10041 - protein, 81 aa, Microcaecilia unicolor
DQASVTFNDVAAYFWEAEWDILGERQKELYKKVIKEIHNFLMSRGYSIVKPEVIFRIKKDEDKHFTQHGEWEEEENLKDST

SEQ ID NO: 10042 - protein, 81 aa, Microcaecilia unicolor
VSKTMRVTFEDIAVSFSQEEWEYLDEGQKELYREVMKENYETLISLVNEAEQELKREQNQEESVIQTEGNDDRNISQRMER

SEQ ID NO: 10043 - protein, 81 aa, Microcaecilia unicolor
QMQVTFEDIVISFSQEEWGYLDERQKVLYTEVMKENYQTLISLGTGSLTFTPKIISCIERGEEPYIRDEPRSEEKETGNSS

SEQ ID NO: 10044 - protein, 81 aa, Microcaecilia unicolor
QMRVTFEDIAVSFSQEEWEYLDEEQKELYREVMKENYQTLISLGTGSTTVIPDIISHIEQGEEPYIRDEPGPEERETGKSN

SEQ ID NO: 10045 - protein, 81 aa, Microcaecilia unicolor
DQALVSFIDVAAYFLEVEWDILGERQKELYEKVIKAIHNFLISQGYSILNPDVIFKIKYEDEKYFTQHCEWEAKENKNEPS

SEQ ID NO: 10046 - protein, 81 aa, Microcaecilia unicolor
QMQVKFEDIAVSFSQEEWEYLDEEQKELYREVMKENYQILISLGTGSSTFNPKIISLIERGEEPYIRDEPGSEEREPGKSS

SEQ ID NO: 10047 - protein, 81 aa, Microcaecilia unicolor
QKQVTFEDIAVSFSQDEWEYLDEEQKELYREVMKENHQTLMSLGTGSPTVIPDIISHIERGEELYVRDEPGSEERETGKSS

SEQ ID NO: 10048 - protein, 81 aa, Microcaecilia unicolor
QQVPVTFEDITVHFSREQWKYLNEGQKELYKEVMKENYETLISLEKVDPTNHNTEPHHWKPEGEETLSERDKEGTSSCCNW

SEQ ID NO: 10049 - protein, 81 aa, Microcaecilia unicolor
DQASVAFSDVAAFFLEAEWDILEEQQKELYKKVIKEIHIFLISRGHSILNPAVIFKIKNDNEKQFTQYCEWEGKENMKNPT

SEQ ID NO: 10050 - protein, 81 aa, Microcaecilia unicolor
DQASVTFKDVAAYFLEMEWDILGEWQKELYRKIIKEIHDILTSRGYSIVNPDVIFKIKKEDEKYFTQHFEQDGKENLNDPP

SEQ ID NO: 10051 - protein, 81 aa, Microcaecilia unicolor
QKWFTFEDIAVSFSQEEWEYLDEGQKELYREVMKENYQTLISLGTGSPTVIPDIISHIERGEEPYVREEPGSEEREAGTSR

SEQ ID NO: 10052 - protein, 81 aa, Microcaecilia unicolor
GRAKVVFSDVAIYFSEGEWQLLEDRQKELYTNVMKEIHGALVSLGYTIVNSDTVFKIKPEEEPSLRNHIDSKEGGGGGKAS

SEQ ID NO: 10053 - protein, 81 aa, Microcaecilia unicolor
MPADAADQVQMKLEEEWKGLEEGQRKLNIGTMRDNYENYDSLISLGCTAATPDVLSRIKEENKVQSCSDQFVSETRESTAS

SEQ ID NO: 10054 - protein, 81 aa, Microcaecilia unicolor
MKDNYEALISLGVPVFKHEIISRIETGEEPCVQGSQNLEQREMPESDFMDDGLIKEIKVEEERLDECASVPDVQITSSEKL

SEQ ID NO: 10055 - protein, 81 aa, Microcaecilia unicolor
FQTLVTFKDVAAYFLEVEWNILEEWQKELYKKVIKEIHGILISRGYSIVNPDVTLKIKKENEKYFAQHCELEGKEDLNDPT

SEQ ID NO: 10056 - protein, 81 aa, Microcaecilia unicolor
QRGSVMFSDVVACFTEEEWEVLKERQKKVYRAVMMEIHEALISLGYEITNRDVLFRVQEEKNACRRDGFERRDDICALTTG

SEQ ID NO: 10057 - protein, 81 aa, Microcaecilia unicolor
QKRFTFEDIAVSFSQEEWEYLDEEQKELYREVMKENYQTLISLGTGTPTVIPDIISHIEGGEEPYVRVEPGSEEREAGTSC

SEQ ID NO: 10058 - protein, 81 aa, Microcaecilia unicolor
QEPVTFEDITVYLSQEHWEYLNERQKELYREVMKENYKTLISLGADHKNINSEVLARIKQEEDPNVWDPKESEKRDVTHSY

SEQ ID NO: 10059 - protein, 81 aa, Microcaecilia unicolor
SEAPVSFEEVAVYFSQEEWQTLQGWQKELYRGVMRENYEIMLSLGYQFSKPEILLMMERGEEPFVEDSQRRVPEPFREKHL

SEQ ID NO: 10060 - protein, 81 aa, Microcaecilia unicolor
EQMWVSFEDITVSFSQEEWGYLDEGQKELYREVMKENYETLISLGYENINPDILSCTRQEEEANIQDPQESDKREVKNSHT

SEQ ID NO: 10061 - protein, 81 aa, Microcaecilia unicolor
LQMRVTFEDVAVSFSQEEWEYLDEGQKELYMEVMEENLELLTSVNSLVAQPEQMQELYVTDQHDMGLRGTLLSPYVEGGAG

SEQ ID NO: 10062 - protein, 81 aa, Microcaecilia unicolor
DQAPVTFSDVAAYFLEVEWDILGAWQKELYKKVIKEIQSFLIAQGYSILNPEVIFKIKKEDEKYFTQYSVLEGKENMDDPT

SEQ ID NO: 10063 - protein, 81 aa, Microcaecilia unicolor
GNLTTTGRCEELPEACDEATIKASNESLVTFKDVAASFLEADWDLLGEWQKELYKKVIKEIHDILISRGKYVFSVIYHTST

SEQ ID NO: 10064 - protein, 81 aa, Microcaecilia unicolor
MKENYETLISLGCDEESPDILSRMKQEEEPYVWDPHESREREVTHSDTAVNEAIQKLKQEQNHEETPVEMEQIPGQSKNVC

SEQ ID NO: 10065 - protein, 81 aa, Xenopus tropicalis
MQDNYQNLTALGLVITKPEIVLKIEKGEDPIIGVCLAPAHKRPTHMDGAPKAALGPKHSKYPLRSHRAPPGSAERVGSLGQ

SEQ ID NO: 10066 - protein, 81 aa, Xenopus tropicalis
VTFHDVAACFSAEEWAGLQDWQKELYRNVMREIHTALQAMGKGAVTGYGGDPHCPAGHGIRGRSTLPCWPWVRGQLRDTGE

SEQ ID NO: 10067 - protein, 81 aa, Microcaecilia unicolor
QIPVIFEDIAIYFSQKEWEDLEECQKKLYKDVMKENYQILTSLGADFLTVTPDIISYIERGEELYIRNESGSEERETGKSS

SEQ ID NO: 10068 - protein, 81 aa, Microcaecilia unicolor
MKENYEILISLGFEKVSRDALSRIKQEEEPYVWDPHESREREVTHSDTVDEALQKLKQEQNHEETPVETEQIPGQSKNVCE

SEQ ID NO: 10069 - protein, 81 aa, Microcaecilia unicolor
SRTMRVTFEDIAVSFSQEEWGYLDERQKALYREVMKDNYETLISLGYERINHDIFSRIKEEEPYIQDPHYSRERKVIHSDT

SEQ ID NO: 10070 - protein, 81 aa, Microcaecilia unicolor
QKWCTFEDIAVSFSQEEWEYLDEEQKELYREVMKENYQTLISLGTGSPTVLPDIISHIERGEEPYVREEPGSEEREAVTSR

SEQ ID NO: 10071 - protein, 81 aa, Microcaecilia unicolor
DQASVAFGDVAAYFWEVEWDILGEWQKELYKKIIKEIHSFLISQGYSILNPDVIFKIKKEDDKYFTQHCELEGEKTMNDPS

SEQ ID NO: 10072 - protein, 81 aa, Microcaecilia unicolor
QVPVTFEDITVYFSQEQWEYLNEGQKELYREVMKENYETLISLGTDNESINPEVLARIKQEEEPHVWDPKESGEKEVTHSC

SEQ ID NO: 10073 - protein, 81 aa, Microcaecilia unicolor
DQALVTFKDVAAYFLKADWDILEEWQKELYKKVIKKIHDILTLKGYSIVNPDVIFKIKKDDDKYFTQHFEWEGKENPNDPM

SEQ ID NO: 10074 - protein, 81 aa, Microcaecilia unicolor
KMRVTFEDIAISFTQEEWEYLNEGQKELYREVMKENYETLMFLAENEVTEEEVKETNREGRPLKWKLRPRRVSISQGTERG

SEQ ID NO: 10075 - protein, 81 aa, Microcaecilia unicolor
ISKTMWVTFEDITVSFSQEEWEYLDEGQKELYREVMKENYETLISLVNEAEQELKREQNQEESVIQTEGNDDRNISQRMER

SEQ ID NO: 10076 - protein, 81 aa, Microcaecilia unicolor
QGPVTFEDIAVYFTQEEWEDLEEWQKKLYKEVMKENYQMLRCLETGFQTVTPDIISHIERGEEPYIRVGLKSEERETGKSS

SEQ ID NO: 10077 - protein, 81 aa, Microcaecilia unicolor
AQVPVTFEDVAVYFSEDEWGMLAEWQKELYKETMKENYETLTALGSLSEKPLLLSKLEQEEDLFVREPQDPRDRIRLKSCW

SEQ ID NO: 10078 - protein, 81 aa, Terrapene carolina
EMDFAALPVTELVGLWLGQQVLRGGLWLFQGLVTFEEVAVYFTEEQWALLDPSQRALYRDIMQQNYENVTSLGKDSCPLGY

SEQ ID NO: 10079 - protein, 81 aa, Terrapene carolina
RRPVTFEEVAVYFTREEWALLDPTQRALYRDVMQENYETVVLLGKENFDKFPCPPFLLHLPPTSIIFGHPPPDITSPSLCT

SEQ ID NO: 10080 - protein, 81 aa, Microcaecilia unicolor
QVPVTFEDIAIYFCQEEWEVLEEWQKDLYKDVMKENYQALISLGTGSLIVSPDIISRIERGEDPYIRDERGSKKRETENSS

SEQ ID NO: 10081 - protein, 81 aa, Microcaecilia unicolor
QVPVTFEDVAIHFSQEEWECLEEWQKNLYKDVMKENYQTLISLEAGCPTFTPDIISHIERGEEPYIRDELGSEERETGKSS

SEQ ID NO: 10082 - protein, 81 aa, Microcaecilia unicolor
MFEDIAVSFSQEEWEYLDEGQRELYREVMKENYETLVSLGDEVTQEKERKEKSVLIKNQIVNYKEKPFPCTECKRSFTCRD

SEQ ID NO: 10083 - protein, 81 aa, Microcaecilia unicolor
QVSVTFEDITVYFSQEQWRYLDEGQKKLYREVMMENYETLISLGADCESIDSEVLSRIKQAEYLHVWDLKKSEEREVTHSY

SEQ ID NO: 10084 - protein, 81 aa, Microcaecilia unicolor
CRALVTFKDVSAYFLEVEWDVLGEWQKELYKKVVKEIHDILISRGYSIVNPDIIFKIKNEDEKNFTPHFEWDEKENPDDPT

SEQ ID NO: 10085 - protein, 81 aa, Microcaecilia unicolor
DQASIAFSDVAAYFLEVDWVSLGEWQKELYKKVIKEIHNFLISRGYSILNPDVIFKIKKEEKHLTQHYELEGRENMNDPSM

SEQ ID NO: 10086 - protein, 81 aa, Microcaecilia unicolor
QMQVTFEDIAVSFSQEEWEYLDEGQKELYKEVMTENYQTLISLGTGSTTVIPDIMSHIEQGEEPYIRDEPGPEERETGKSN

SEQ ID NO: 10087 - protein, 81 aa, Microcaecilia unicolor
QMQVKFEDIAVSFSQEEWEYLDEEQKELYREVMKENYQILISLGTGSSTSTPKIISQIERGEEPYSRDEPGSEEREPGKSS

SEQ ID NO: 10088 - protein, 81 aa, Microcaecilia unicolor
DQTLVTFKDVAAYFLEVEWNILEEWQKELYKKVIKEIHGILISRGYSIVNPDVMLKIKKENEKYFAQHCELEGKEDLNDPT

SEQ ID NO: 10089 - protein, 81 aa, Microcaecilia unicolor
QKPMITFNAVAAYFSEAVWEALEEWQKELYRSVVQEIHGALLSLGYSIIHPDVLLRIKGQEEPYKEESGKIYKHHMTSDSS

SEQ ID NO: 10090 - protein, 81 aa, Microcaecilia unicolor
VSDQVFFKHVAAYFLKVDWEILGEWQKELYKKVIKEVHGILISQSYSIVNSDVIFKIKNEDEKYFTQHFEWEEKENPYDLM

SEQ ID NO: 10091 - protein, 81 aa, Microcaecilia unicolor
DQVLVTFKDVAAYFLDVDWDILGEWQKELYKKVIKEIHDILISRGYSVVNPDVMFKIKKEDEKYFTQHFEWEGKENPDDPM

SEQ ID NO: 10092 - protein, 81 aa, Microcaecilia unicolor
DQASVTFSDVADYFLEVDWDSLGEWQKELYKKIVKEIHNFLISRGYSILNPDVIFKIKKEEKHLTQHYELEGKENMNDPSM

SEQ ID NO: 10093 - protein, 81 aa, Microcaecilia unicolor
DQGSVTFKDVAAYFLEVEWDILGEWQKELYKKVIKEIHDVLMSRGYSIVNPDVIFKIKKEDEKYFTRHLEQEGKENLNDPT

SEQ ID NO: 10094 - protein, 81 aa, Microcaecilia unicolor
AQVPVTFEDVAVYFCEDEWEMLAEWQKELYKETMKENYETLTSLDSSSEKPSLISKIEQDEDLCVWDQQDVRERLNSSRRA

SEQ ID NO: 10095 - protein, 81 aa, Microcaecilia unicolor
DRASVAFSDVAAFFLEADWDLLGERQKELYKKVIKEIHIFLISRGHSILNPAVIFKIKNEDEKHVTQYYEWEGKKSMKNPT

SEQ ID NO: 10096 - protein, 81 aa, Microcaecilia unicolor
DQASITFKDVAAYFLEVEWDILGEWQKELYKKVIKEIHDILTSRGYSIVNPDVIFKIKKEDKKYFTQHFEQAEKENLNEPT

SEQ ID NO: 10097 - protein, 81 aa, Microcaecilia unicolor
VQVPVTFEDVAVYFSEDEWGMLAGWQKELYKETMKENYETLTLLGCLSEKPSLISKIEREEDPCVRDQQDPRDRRKLRSSW

SEQ ID NO: 10098 - protein, 81 aa, Microcaecilia unicolor
TQMQVKFDDIAVSFSQEEWKYLDEEQKELYREVMKENYQILISLGTGSSTTPKIISHIERGEEPYIRDEPVLVERKTGKSS

SEQ ID NO: 10099 - protein, 81 aa, Microcaecilia unicolor
QEPVTFEDITVHFSQEQWEYLDEGQKELYREVMKENYETLISLGTDHESINPEALARIKQEEEPRVWDPKESGERGVTRTC

SEQ ID NO: 10100 - protein, 81 aa, Microcaecilia unicolor
DQALVTFKDVSAYFLEADWDILGEWQKELYKKVIKEIHDILTSQGYSIVNPDAIFKIKNEDEKYFTQHFEWEEKENPDDLM

SEQ ID NO: 10101 - protein, 81 aa, Microcaecilia unicolor
DQASIMFKDVAAYFLEVEWDILGEWQKELYKRIIKEIHDILMSRGYSIANPDVIFKIKKEDEKYFTQHFEWEGKENLNDPT

SEQ ID NO: 10102 - protein, 81 aa, Xenopus tropicalis
EVHIKSGDAAVYFSTEEWEYIERHKESYKDVMMETLGTLGIPTSKTSGKIVKEVASDKEQKEESYAIRRQDTEVQEVNGNA

SEQ ID NO: 10103 - protein, 81 aa, Microcaecilia unicolor
VQVPVTFDDIAVYFSQEEWEELDEEQKDLYQEVMRENLELLTSLGYPKAAPDITLKIKEWEESFVWEQQNTQGDQILLSFP

SEQ ID NO: 10104 - protein, 81 aa, Microcaecilia unicolor
QMQVTFEDIAVNFSQEEWEYLNEGQKELYREVMKENYQTLISLGTGSPTVTPEIISYIERGKEPYIRDEPGSEERETGKSI

SEQ ID NO: 10105 - protein, 81 aa, Microcaecilia unicolor
LLVTFEDIAVYFSQEQWEYLDEGQKELYREVMKENYETLISLEKDYSRNSDTEPHHKKLSEKPEGEKSLSERDKEETSSFS

SEQ ID NO: 10106 - protein, 81 aa, Microcaecilia unicolor
EIMRVTFEDIAVSFSQDEWEYLDEGQKALYREVMKENYQTLISLGYGRISPDTLSRIKQEEEPYVWDPHESREREVTHSDT

SEQ ID NO: 10107 - protein, 81 aa, Microcaecilia unicolor
QKRVTFEDIAVSFSQEEWEYLDEQQKELYREVMKENYQTLISLGTGSPTVIPDIISHIERGEEPYVREEPGSEEREAGTSR

SEQ ID NO: 10108 - protein, 81 aa, Microcaecilia unicolor
DQAAVTFNDVAMCFTEEEWNVLNDWQKELYRNVMREIHHALISLGHVIVNSEILFRFRRDKGPFFGGHCELEGKASIGATV

SEQ ID NO: 10109 - protein, 81 aa, Terrapene carolina
PLTSLCLGFPVQLTFEDVTISFSREEWEVLSVWQKELYREVMKENYASLISLGKDQCSVSGMELWDLWRGFLRAIDSGLIS

SEQ ID NO: 10110 - protein, 81 aa, Microcaecilia unicolor
MKENYEALISLGYESINPDIVSCTKQEEEANIQDPQESGERDVKNSYTDHQITQGKKREKKQGEHPVETEQIQRQSENICD

SEQ ID NO: 10111 - protein, 81 aa, Microcaecilia unicolor
DQAMVAFKDVAAYFLEVEWNILEEWQKELYKKAIKEIHGILMLRGYSIVNPDVIFKIKKEDKKYFTHHFECEGKENPNDPM

SEQ ID NO: 10112 - protein, 81 aa, Microcaecilia unicolor
EPVTFEDITVHFSQEQWEYLDEGQKELYRKVMKENYETLISLEKEDPSTSNTEIHHWKLCEKLEEEKLLSERDKEETSSCS

SEQ ID NO: 10113 - protein, 81 aa, Terrapene carolina
GPVTFEEVAVYFTREEWALLDLTQRALYRDVMQENYETVVFLGFPISKPDVISQLERGEEPWVLDLQGYEKEVLPRAKPEE

SEQ ID NO: 10114 - protein, 81 aa, Terrapene carolina
LQVPVSFEDVAVYFSPEEWAELAKWQRELYRDVMKENYALVASLGHPGVKPEIICQMERGEEPCVEDPWGWEERSTAQNPC

SEQ ID NO: 10115 - protein, 81 aa, Terrapene carolina
FQMPVTFEEVAVYFTQAQGALLDPSQRALYRDVMQENYETVTSLGFAVPKPDLISRLEQGEEPWVPDLQASEERESQRGTR

SEQ ID NO: 10116 - protein, 81 aa, Lithobates catesbeianus
EVTQKIIDLLTGEVPIRCQDITVYFSMEEWEYLEGHKDLYKDIVKENQQLLSCFNVGKNNFLSNEIILNCTLEIICLLIGE

SEQ ID NO: 10117 - protein, 81 aa, Lithobates catesbeianus
IRCQDVTVYFSMEEWEYLEGHKDTYKNVMTENQPSLTSPERCPRPLYSRDSTQEDHTIPHHHQHKEQMYVKNYVKAEEEET

SEQ ID NO: 10118 - protein, 81 aa, Terrapene carolina
QPFVCLQVPVTFEDVAVRFSAEEWEILEGWQKELHKEVMEENYQLLISLGKEQHVSCLHGGLWTIPWHCSYKCVSFQLCLH

SEQ ID NO: 10119 - protein, 81 aa, Microcaecilia unicolor
MRVTFEDIAVSFSQEELEYLDEGQKELHREVMKENYEILMSLEKDDPRRSNTKTHDWKLSEKPERENMLPEREKAETPSCS

SEQ ID NO: 10120 - protein, 81 aa, Microcaecilia unicolor
EQITVTFNDVAAYFSEQEWQALEEWQKELYRGVMKEIHRALFSLGYSIANPDVLFRIKQEEGPYFRDPFDSEGSNNIGGKD

SEQ ID NO: 10121 - protein, 81 aa, Terrapene carolina
PVTFEEVAVYFTAGQGALLDPAQRALYRDVMQENYENVTSLGKDSFQIHVIPTMPPLLCPVSALPNLVLLAGAPTWSHPLP

SEQ ID NO: 10122 - protein, 81 aa, Terrapene carolina
LGVGEPWTAGAVSGAAGTGIGHFLFQGPVTFEEVAVYFTRDEWALLDPRQRALCRDVIQENYENVTSLGKDSCPLGSWKGK

SEQ ID NO: 10123 - protein, 81 aa, Lithobates catesbeianus
EVPIRCQDVTVYFSMEEWEYLEGHKDLYKNVMTEDQPPLTLPEGPKIENILEGDLILSSDYYVENDDIALNAPEVNDMSHI

SEQ ID NO: 10124 - protein, 81 aa, Lithobates catesbeianus
VPIRCQDVTVYFSMEEWEYLEGHKDLYKDVMMDNQPPLTSPVKDKEEIIEDDEDGVMEGFPKGHKDLYQDTMSGNLRDPEV

SEQ ID NO: 10125 - protein, 81 aa, Terrapene carolina
GSCVAFEDVALYFSQEEWELLSPPEKQLYRDQMLRNYWPPLQGEAPVQKTLSPAGLGILGGTRTQSECGESTAGRQDSTSH

SEQ ID NO: 10126 - protein, 81 aa, Microcaecilia unicolor
VPDQDLFKDVSAYFLEADWDILEERQKELYEKVIKEVHDILISRGYSIVNPDVMFKIQKEDKKYFTPHFEWEGKENPNDPM

SEQ ID NO: 10127 - protein, 81 aa, Microcaecilia unicolor
FHVPVSFEDIAVYFSQEEWEALEEGQKELYKDVMKENYETLSSLGFLIVTPDIISLIEHGEEPYIKDEPGSEERCHGERNW

SEQ ID NO: 10128 - protein, 81 aa, Microcaecilia unicolor
PVTFEDITVHFSQEQWEYLDDGQKELYREVMKENYETLISLEDDRRNSDTEIPHWKQHQRVHTGMKPVMCTECGKSFSDKG

SEQ ID NO: 10129 - protein, 81 aa, Microcaecilia unicolor
DQASVMFSDVAAYFLEAEWNILGEWQKELYKKVIMEIHRFLISQGYSILNPDVIFKIKKEDEKYFTQHCEWERKENMNDLR

SEQ ID NO: 10130 - protein, 81 aa, Microcaecilia unicolor
LQVPVIFADMAICFTQEQPMDLEEQQKELYKDMMENYQTLISLGTGSVTVAPDIISHTEQREEQYIRDELGSEERDTEESG

SEQ ID NO: 10131 - protein, 81 aa, Microcaecilia unicolor
DQVLVAFKDVTAYFLKVDWDILGEWQKELYKKVVKEIHDILISRGYSIVNPDVIFKIKKEDEKYFSPHFEWEEKESPDDLM

SEQ ID NO: 10132 - protein, 81 aa, Microcaecilia unicolor
MKENYQTLISLGCERINPDILSRIKQEEEPSVQEMQEPEDCRSYTDQPITEEQNREKNQGNDHVKIGQMQRQSENVCENIS

SEQ ID NO: 10133 - protein, 81 aa, Microcaecilia unicolor
MAASIPEVEWNLLEDWQKQLYRDVMKESYKTILSLGYSVAKQNIMTEPAAEEKACNSAVRDPESGDIAGSSSAEPCGRKRK

SEQ ID NO: 10134 - protein, 81 aa, Terrapene carolina
DGLFQKPEPGFAELEKRLSDFSLKSAILQEVLLGFKETLRLELENNTGFPVSKPDGVSQLEQGEEPWVLGLQGSEEREIQG

SEQ ID NO: 10135 - protein, 81 aa, Terrapene carolina
VLSEELLLFQGSIAFGEVAVYFTEEEWALLDPAQRALYRDVMQENYENVTLLGKDSYSHAPLFFHSPSSVKLLQLFPPLFM

SEQ ID NO: 10136 - protein, 81 aa, Lithobates catesbeianus
PVRCQDVTVYFSMEEWEYLEGHKDLYKDVMMENQQLLNYVNMKKNHLLNGILILTLEIICLLTGEDCTVVMKSSIENIIKR

SEQ ID NO: 10137 - protein, 81 aa, Lithobates catesbeianus
WSVPITFDEVAVYFLEEEWRHLEAWQRELYQEVMRDNLEAVLSLGYEYRQPPPPPRVFTEDDKWIVRYSEDPLEADEEKGP

SEQ ID NO: 10138 - protein, 81 aa, Lithobates catesbeianus
VPIRCQDVTVYFSMEEWEYLEGHKDLYKDVMMDNQPPLTSLDGSSNGYPPERCPRPLYSWDSTQEGHTIPHHHQRGNLRDS

SEQ ID NO: 10139 - protein, 81 aa, Terrapene carolina
MPMTFEEVAIYFTKGQGALLDPAQRVLYRDVMQENYETVTLLGKGFPSPQLLEAVESACRSRMQLVCLCFGFFLGAIPLSP

SEQ ID NO: 10140 - protein, 81 aa, Microcaecilia unicolor
RTMPMTFEDIAVSFSQEEWEYLDEGQKELYRDVMKENYETLISLGYDRKSPDILTRIKQEEEPYVWDPHESREKEVTLSDT

SEQ ID NO: 10141 - protein, 81 aa, Microcaecilia unicolor
NEVLVSLKDVAAYFLEVEWNTLEEWQKQLFKKVIKEIHDILMSQGYPIVNRDVVFKIKKEDETYIIQPFEWEGKENPNDST

SEQ ID NO: 10142 - protein, 81 aa, Microcaecilia unicolor
NEALVTFKDVAAYFLDVDWDLLGERQKELYKKLIKEIHNILISRGYSILNLDVIIKIKNEDEKYLIQQSEWEWKKPQNDST

SEQ ID NO: 10143 - protein, 81 aa, Microcaecilia unicolor
CMLVTFEDITVSFSQEEWEYLDEAQKELYREVMKENYQTLISLDHHITREKKRVKKQGEHPVEMEQIQKQSENVCENISPR

SEQ ID NO: 10144 - protein, 81 aa, Microcaecilia unicolor
MRVTFEDVAVSFSQEEWEYLDEGQKELYREVMKENYETLISLEDACRNSSTEMHHWKLSEETGEEKISENDKKGTASFSDW

SEQ ID NO: 10145 - protein, 81 aa, Terrapene carolina
MLADWQKELYRAVMLENYENLFLLGHADAKPEIITKLERGEELCVGDQQAWEGREILPSASRGNWSRKKTKRESDLQECGG

SEQ ID NO: 10146 - protein, 81 aa, Terrapene carolina
LIFEEVAVYFTREEWALLDPTQRALYRDVMQENYENVTSLGDAMICEKEEQNSQPENVEQVDKHRELSQRLKRNMSSSHEQ

SEQ ID NO: 10147 - protein, 81 aa, Terrapene carolina
QGPVTFEEVAVYFTREEWALLDPRQRALCRDVIQENYENVTSLAGDAMVCDKEEQNSQKENVEQVDKHRALSQRSKRHVSR

SEQ ID NO: 10148 - protein, 81 aa, Lithobates catesbeianus
NMEKILELTTMMVHLLTGEVPIRCQDVTVYFSMEEWEYLEGHKDLYKDVMMDNQPPLTSPGKRRLYCKAESSTEGPPRSPI

SEQ ID NO: 10149 - protein, 81 aa, Terrapene carolina
FQVPVTFKEVAVYFTQGQGALLDPAQRALYRDVMQENYEMVTSLGKGFPSPRLLETMGDRFHPWNVLSDRHSLNPPHTLIW

SEQ ID NO: 10150 - protein, 81 aa, Microcaecilia unicolor
DQALVTFKDVSAYFLEADWDLLGERQKELYKKVIKEIHDILTSRGYSIVNPDVIVKIKKEDEKYFTQHFEWEGEENPDDLM

SEQ ID NO: 10151 - protein, 81 aa, Microcaecilia unicolor
QIPVTFEDIAIYFCQEEWEDLEECQKELYKDVMKENYDNLNSVGIASQTVAPDIISRIEQGEEPYIRDEPQSEKREIGNSS

SEQ ID NO: 10152 - protein, 81 aa, Microcaecilia unicolor
QMRVTFEDIAVSFSQEEWEYLDEEQKELYREVMKENYQILISLGTGSTTVIPDIISHIEQGEEPYIRDEPGPEERETGKSN

SEQ ID NO: 10153 - protein, 80 aa, Microcaecilia unicolor
MRVTFEDVAVSFSQEEWEYLDEGQKELYREVMKENYQTLISLGYERNDPDMLLRIEEEEEFYIKIQRRQMKEGYLLAPRY

SEQ ID NO: 10154 - protein, 81 aa, Terrapene carolina
LVFQMPVTFEEVAVYFTQGQGALLDPAQRALYRDVMQDNYEMVTSLGKGFPSPQILEAVGSVCLNLVRFFPCQLYQRRVVP

SEQ ID NO: 10155 - protein, 81 aa, Terrapene carolina
MSFPCAEFPVFTPDEISHLEQDKEPWVPDLHDSEEREILRGTCTREESFSQFKTCPCLKETAAVPDRDLVSSPSSGFSPAG

SEQ ID NO: 10156 - protein, 81 aa, Lithobates catesbeianus
IRCQDVTVYFSMEEWEYLEGHKDLYKDVMMENQPPLTSPGGQGVWNTLEADSEAEDHGITQCSPGENPDVRNMRCTLSCVD

SEQ ID NO: 10157 - protein, 81 aa, Terrapene carolina
MNKINACFLAPQTGFPISKPDVSSQLELGEEPWVPDLQIYEEREILKDVHRGSLSPGTGTDSCLDSLSVPAVEEMVNENKE

SEQ ID NO: 10158 - protein, 81 aa, Terrapene carolina
AGFPVSKPDVISQLERGEEPWVPDLQGSEKEVLPRVACTGSDLCLDPLSLPSGDGRVSENEEKPQQEDAEQIEAHGTLSGR

SEQ ID NO: 10159 - protein, 81 aa, Terrapene carolina
PVTFEDVAVYFTQGQGALLDPAQRAIYRDVMWENYETVTSLGKGFLAPWLLEAGGVSVAGLQSADITDIAFHVSCYLQEFP

SEQ ID NO: 10160 - protein, 81 aa, Microcaecilia unicolor
KLRVAFEDVAASFSQEKWEYLKGDPKELHREAVKDNYETPISPDTDQKKNNPDILLRIKEEEEPYVWVPQESGMKEMTHSD

SEQ ID NO: 10161 - protein, 81 aa, Microcaecilia unicolor
VPDQALFKDVAAYFLEVDWDLLGEWQKELYKKVIKEIHDILISQGYSIVNPDVLFKIKNEDEKYFTQHFEWEEKENPDGLM

SEQ ID NO: 10162 - protein, 81 aa, Microcaecilia unicolor
EVPISFEDIFIYFSQEEWENLQEEQRELYKDVMKENYEMLISLGAGFLTVTLDIISLIERGEEPYIRDEPGSEEGEIGKSS

SEQ ID NO: 10163 - protein, 81 aa, Microcaecilia unicolor
QQMRVAFEDIAVSFSQEEWEYLDEGQKELYREVMKENYETLISLGYESVNPDILSRIKQEEGPSEEKEDCHSYTANQLIPQ

SEQ ID NO: 10164 - protein, 81 aa, Microcaecilia unicolor
MKENYEILISLGYERISPDTLSRIKQEEEPYVWDPHESREREFTHSDTAVNEALQKLKQEQNCKETPVEMEQIPGQSKNVC

SEQ ID NO: 10165 - protein, 81 aa, Terrapene carolina
MTKTQRPKRAEFPIKKPDIISLIEREEEPWVPDLQGYEEKEMLSGTYAGDGIVSENGKENLHQDSHEPMEPHGTLSGASQR

SEQ ID NO: 10166 - protein, 81 aa, Terrapene carolina
MPVTFEEVAVYFTQAQGALLDPAQRALYRDVMQENYEAVTSLGKRFPSPQLVEAVQRFNRTVWSHANTGTELVNHLHEQVS

SEQ ID NO: 10167 - protein, 81 aa, Microcaecilia unicolor
GQVSVIFKDVAAYFLEVEWNILGEWQKELYKMVIKEIHGILMSRGYSIVSPDVIFKIKKEDEKYFTQQFEWEGKENPNDPN

SEQ ID NO: 10168 - protein, 81 aa, Microcaecilia unicolor
MRVTFEDITVFFSQEEWEYLDEGQKELYGEVVKENYEILMSLENDPKPSNTEKHNWKLLEKPEGEKMLPEREKEKTRSCSD

SEQ ID NO: 10169 - protein, 81 aa, Microcaecilia unicolor
TQVPVTFEDVAVYFCEGEWETLAEWQKELYRETMKENYETLTSLGFSSKKPSLISKIEREEDPCVRDKQDSRDRRRLRSCW

SEQ ID NO: 10170 - protein, 81 aa, Microcaecilia unicolor
MQENYDSLESMGFPIKKPEVVSRIEQGEEPWVMENAGSSILGTNTILAILERLEKRIARMEHHQIFFLTHLFKHLKPATLE

SEQ ID NO: 10171 - protein, 81 aa, Microcaecilia unicolor
AQFPVTFEDIAIYFSQEEWEELEESQKELYKDVMKENYEILRSLGCPAVTPEIISHIEQGEEPCIRNEPGSEERETGKSSC

SEQ ID NO: 10172 - protein, 81 aa, Terrapene carolina
MPVTFEEVAVYFTQGQGALLDPAQRALYRDVMQENYETVTSLGKGFLSPQILEAGMEEQVENPKIWYCTTSQDESINGGGR

SEQ ID NO: 10173 - protein, 81 aa, Terrapene carolina
FHSRNVLSDKYSTLIWSDFTLCAGFPIPKPELIARLERGEEPWVPDLQACKERRLPRCTRTGAERGSENEEGNHHKEVPGE

SEQ ID NO: 10174 - protein, 81 aa, Terrapene carolina
LRVRLNSGNALCDSRYSTNATCTLIWSDFTSCSGFPIPKPELIARLEGGKEPWVPDLQAAKERESPRGTRTAGDRTVSETK

SEQ ID NO: 10175 - protein, 81 aa, Terrapene carolina
PHNGPTFEEVAVYFTREEGALLDPAQRALYRDVMQENYENVTSLGFQVSQPQVISQLEQGEEPWVPDLQSSEKEVFLSLSQ

SEQ ID NO: 10176 - protein, 81 aa, Terrapene carolina
MELGKLTRLVAVYFTREEWALLDPAQRALYRDVMQENYENVTSLGKGYSPQCHLYSAQFQHHPNMPVTHITRDPPPLQNTW

SEQ ID NO: 10177 - protein, 81 aa, Terrapene carolina
VCGWKFPNWSSRKQPPRTGLGKRIKLQYWSLNLLGPVTFEEVAVYFTEEEWALLDPAQRALYRDVMQENYENVTSLLGYLV

SEQ ID NO: 10178 - protein, 81 aa, Terrapene carolina
MLRNYWALVSLGYSGSTPDLIQRIELGEAELWIRDAEDSRKNSGPDSPSSAGHEILGGTRTWSGCGRSFSQSSVLKIHPRT

SEQ ID NO: 10179 - protein, 81 aa, Lithobates catesbeianus
AGPAVLSCMRGCRGSAHISEHRRKEQATFDDIAVYFSKDEWDYLNDEEKDLYREVMIENYQTLQSLDWCRSLQTKFTHHIL

SEQ ID NO: 10180 - protein, 81 aa, Terrapene carolina
AGPPIPKPDLIARLEAGEEPWVPDLQVSEERKIPRGTCTADETKRENKEGNPQQEGPKEVELQGTFLRRAEGNFSKCLEQR

SEQ ID NO: 10181 - protein, 81 aa, Terrapene carolina
YVINGPVTFEEVAVYFTREEGALLDPTQRALYRDVMQENYETVVFLVGFPISKPDVISQLERGEKPNSSHLIRHKRIHTGE

SEQ ID NO: 10182 - protein, 81 aa, Terrapene carolina
LQRRLENMENLLKNRNFWILRLPPGTNGEVPKEWEKLDEWQKELYKNVMKGNYESLISLGKDQSWKSRNLSEWPSPAPLEL

SEQ ID NO: 10183 - protein, 81 aa, Microcaecilia unicolor
VTFEDIAIYFCQEEWEDLEECQKELYKDVMKENYDNLNSVEMDDPKNNNTETHHWKLSVNLEENKMLMKRDREDPPGSDWR

SEQ ID NO: 10184 - protein, 81 aa, Microcaecilia unicolor
QVPVTFEDITVYFSQEHWKYLNEGQKKLYREVMKENYETLISLGADHKNINSEVLTRIKQEEELYIWDPRESEEREVTHSY

SEQ ID NO: 10185 - protein, 81 aa, Microcaecilia unicolor
DQASVTFSDVAAYFLEVDWDSLGEWQKELYKKIVKEIHNFLISRGYSILNPDVIFKIKKEEKHLTQHYELEGKENMNDPSM

SEQ ID NO: 10186 - protein, 81 aa, Microcaecilia unicolor
MRVTFEDIAVSFSQEEWEYLDEEQKELYREVMKENYQTLISLGTGSTTVIPDIMSHIEQGEEPYIRDEPGPEESETGKSKC

SEQ ID NO: 10187 - protein, 81 aa, Microcaecilia unicolor
QQMQVTFEDITISFSQEEWEYLDEGQKELYREVMKENYETLISLGYEKVNPDIISRIKQEEDLYVLDPQESEVTQSYSDKE

SEQ ID NO: 10188 - protein, 81 aa, Microcaecilia unicolor
QKWVTFEDIAVSFSQEEWGYLDEEQKELYREVMKENYQTLISLGTGSTTVTPDIISHIEQGEETYIRDKLGSDGHQITQGR

SEQ ID NO: 10189 - protein, 81 aa, Microcaecilia unicolor
DQALVTFKDVAAYFLEVEWNILGDWKKELYKKVIKEIHDILMSRGYSIVNPDVIFKIIKEDEKYFPQPFEWERKENLTDST

SEQ ID NO: 10190 - protein, 81 aa, Microcaecilia unicolor
QVPVTFEDIAVYFSQEQWEYLDEGQKELYREVMKENYETLISLGTDHESINPEVLSRMKQEQEPHVWDSEKSGKRYTEKDD

SEQ ID NO: 10191 - protein, 81 aa, Microcaecilia unicolor
MKENYQTLISLGYEKINPEILSNIKQEEESYVQDPQESGEREVTHLYPTDNEAVQEQKKEENKAESPVEMEQIPRQLRSIC

SEQ ID NO: 10192 - protein, 81 aa, Microcaecilia unicolor
TVVPVTFSDVAACFLEEEWKVLEEWQKKNYQKVMKEIHAALISLGHRITNPSVLVKIAEEEPCWKVAGASRGNKHQNAAGR

SEQ ID NO: 10193 - protein, 81 aa, Microcaecilia unicolor
QIPVTFEDISIYFSQKEWEELEEWQKELYSDVMKESYDTLISLGVGSPAVTPDIISLIERGEEPYIRDEPGSEENDTGKSS

SEQ ID NO: 10194 - protein, 81 aa, Microcaecilia unicolor
EQMRVTFEDIAVSFSQEEWEYLDEGQKELYWEVMMENYETLISLGDEVLWEKENEENEECTMELVLIPIESKHGCENIFQG

SEQ ID NO: 10195 - protein, 81 aa, Terrapene carolina
PVTFDDVAVYFSEEEWEILAEWQRDLYKEVMKENLETVLSLGLHPLPKPPCSLSPDCPILRPSPHPNWPPRTLSPTCPLTA

SEQ ID NO: 10196 - protein, 81 aa, Terrapene carolina
MMSQGFPVSKPDVISQLERGEEPWVPDLQGSGEKLLSRAACTGVGMVSENKEKPHQEDAEQVEPHGMLSGRSKGNDSGSCA

SEQ ID NO: 10197 - protein, 81 aa, Lithobates catesbeianus
TPIMEPPPPSLNLERSNDKKILNVTQKIIELLTREVPIRCQDVTVYFSMEEWEYIEGHKDLYKDVMMENQPPLTSPGKRRL

SEQ ID NO: 10198 - protein, 81 aa, Lithobates catesbeianus
LLTGEDVTVYFSMEEWEYLERHKDLYKDVMMDNQQILSCVKKKIHLNKKIHKLSLEIIYLLIGENFPPVKSGDQVTITVPP

SEQ ID NO: 10199 - protein, 81 aa, Microcaecilia unicolor
QVPVTFEDIVIYLSQEEWKNLQEEQRELYKDVMKENYEMLISLGAGSLTVTPDIISHIERGEEPYIRNEPVSEERDIGKSN

SEQ ID NO: 10200 - protein, 81 aa, Microcaecilia unicolor
DQVPVTFKDVAAYFLEVEWDIIGEWQKELYKKAIREIHSILTSRGHSILNPDVVFKIKKEDEKYFIQHLEREGKENPNDPR

SEQ ID NO: 10201 - protein, 81 aa, Microcaecilia unicolor
DQALVTFSDVAAYFLEVEWNILGEWQKELYKKVIKEIHSFLISQGYSILNPNVIFKIKNEDEKYFTQHCEWAGNESKNEPS

SEQ ID NO: 10202 - protein, 81 aa, Microcaecilia unicolor
VQMRVTFEEIAVSFSQEEWEYLDEEQKELYREVMKENYQTLISLGSLNVTPKIISHIERGEEPYVRDEPGSEKRETGPSSG

SEQ ID NO: 10203 - protein, 81 aa, Microcaecilia unicolor
QKRIKFEDIAVSFSQEEWEYLDEEQKELYREVMKENYQTLISLGTGSPTVIPDIISHIERGEEPYVREEPGSEEREAGTSR

SEQ ID NO: 10204 - protein, 81 aa, Microcaecilia unicolor
EQVPVTFEDIAVSFSQEEWEYLDEGQREFYWEVMKENYETLTSLGFERINPDTLLRIKQEEEIYDWDPQHSGERESAHSYL

SEQ ID NO: 10205 - protein, 81 aa, Microcaecilia unicolor
MPVTFEDIAVSFSQEEWEYLDKGQKELYREVMKENYEILISLGYERISPDTLSRIKQEEEPYVWDPHESREREVTHSDTVD

SEQ ID NO: 10206 - protein, 81 aa, Microcaecilia unicolor
MRVTFEDIAVSFSQEEWEYLDEEQKELYREVMKENYQTLISLGTGSMTVIPDIMSHIEQGEEPYIRDEPGPEERETGKSNC

SEQ ID NO: 10207 - protein, 81 aa, Microcaecilia unicolor
DQASVTFNNVAAYFLEVEWDILREWQKELYKKVIKEIHSFLILQGCSILNPDVIFKIKKEDEKYFTQHCELVGKESMNDLS

SEQ ID NO: 10208 - protein, 81 aa, Microcaecilia unicolor
LPVTFEDIAVYFSQEQWEYLDEGQKELCREVMKENFETLISLEKDYSRNSDTEPHHKKLSEKPEGEKSLSERDKEETSSFS

SEQ ID NO: 10209 - protein, 81 aa, Microcaecilia unicolor
MSDQALFKDVAAYFLEVDWDILGEWQKELYKKVIKEVHDILISQGYSVVNPDVIFKIKNKDENYFPQHFEWEEKENPDDLI

SEQ ID NO: 10210 - protein, 81 aa, Microcaecilia unicolor
VSDQDLFKGISAYFLEADWDILEEWQKELYKKVIKEVHDILISRGYSIVNPDVVFKIQKEDEKYFTPHFEWEGKENPDDPM

SEQ ID NO: 10211 - protein, 81 aa, Microcaecilia unicolor
EPVTLEDITVYFSQEQWEYLNEAQKKLYVEVMKENYETLISLEKDTPKNSDAETHCWKLSENPEGEMMLPERDKEETSFCS

SEQ ID NO: 10212 - protein, 81 aa, Microcaecilia unicolor
AQVSVTFDDATGYSSEDEWKGLEEGQKMLHMDTMKDNYEVLTSLDSAVANPEVLSRIKEEDELHFSDHSASEGKEDNGAPS

SEQ ID NO: 10213 - protein, 81 aa, Corvus brachyrhynchos
LKNRNFWILRLPPGAKGEVPKVPVTFDDVSVYFNDKEWEKLEEWQKELYKNVMKGNYESLISLDYAISKPGVLSQIEQGEE

SEQ ID NO: 10214 - protein, 81 aa, Lithobates catesbeianus
VPIRCQDVTVCFSMEEWEYLEGHKDLYKDVMMENQQTWSDGKFRNAEAILDLTLEIIYLLTGEDCAVVMKTSLKDISKKKS

SEQ ID NO: 10215 - protein, 81 aa, Microcaecilia unicolor
AQALVTFRDVAAYFLDVEWDILGERQKELYKKVIKEIHDILMSQGYSIVNPDVIFKIEKEDEKYFTQQFEWEGKENPNDST

SEQ ID NO: 10216 - protein, 81 aa, Microcaecilia unicolor
HQASVTFSDVAVYFSEEEWQLLEEWQKELYRNVMMEIHGALISLGYGILNPDVLFRFKKEEEPYYRSQQKSKGKERVVDLN

SEQ ID NO: 10217 - protein, 81 aa, Microcaecilia unicolor
QVPVTFEDITVHFSQEQWDYLDEGQKELYREVMKENCETLISLGTDHESINPKVLSRIKQEKEPQVWDMRKSEDREVNHSY

SEQ ID NO: 10218 - protein, 81 aa, Microcaecilia unicolor
MKENYQILISLGYEKINPDILSRIKQEEEPFVQELQESDEKEGCHSYTDQPIIQERKEERNQGKNPVKVEQSQRQSENICD

SEQ ID NO: 10219 - protein, 81 aa, Microcaecilia unicolor
QQVPMTFEDIAVSFSQEEWEYLDEGQKELYREVMKENYKTLISLGYERINPDILSRIKQEEEPFVQELQESEEREDFHSYT

SEQ ID NO: 10220 - protein, 81 aa, Microcaecilia unicolor
QVPVAFEDIAIYFSQEEWKDLEKWQKELYKDVMKENYQILISIGAGSPAVTPDIISHIEQVEEPYVGDELGSEESKAEKNS

SEQ ID NO: 10221 - protein, 81 aa, Microcaecilia unicolor
QMQVTFEDITVSFSQEEWEYLDEEQKELYREVMKENYQTLISLGTGSPTLIPDIMSCIERGVELYIQHKPGSAERETGKSS

SEQ ID NO: 10222 - protein, 81 aa, Microcaecilia unicolor
ISRTMWVTFEDITVSFSQEEWEYLDEGQKELYREVMKDNYETLISLVNEAEQELKREQNQEESVIQTEGNDDRNISQRMER

SEQ ID NO: 10223 - protein, 81 aa, Microcaecilia unicolor
QQEPVTFQDVTVYFSKEQWEYLDEGQKRLYREVMKENYETLISLGTDHNINSEVLSRIQENEKRHIWDPKESRERDVTHSY

SEQ ID NO: 10224 - protein, 81 aa, Microcaecilia unicolor
DQASITFKDVAAYFLEVEWDILGEWQKELYKRVIKEIHDILMSRGYSIANPDVIFKIKKEDEKYFTQHFEWEGKENLNDPT

SEQ ID NO: 10225 - protein, 81 aa, Microcaecilia unicolor
DQASITFKDVAAYFLEVEWDILGEWQKELYKRVIKEIHDILMSRGYSIVNPDVIFKIKKEDEKYFTQHFEWEGKENLNDPT

SEQ ID NO: 10226 - protein, 81 aa, Corvus brachyrhynchos
EAPAVALENNATGFSTQEWENLEEWQRELYGKVLTGKREALVLLDDVISEPALLSRLQGGEAPCSEEEPAPGEIPAEPADC

SEQ ID NO: 10227 - protein, 81 aa, Lithobates catesbeianus
EVTKKMMELLTGEVPIRCQDVTVYFSMEEWEYLEGHKDLYEVVMMENQQNLSFVKNVRKEFPWNEMILNLTLEILSLLTGE

SEQ ID NO: 10228 - protein, 81 aa, Microcaecilia unicolor
YQASVTFNDVAVYFSQEEWHLLDEWQKRLYKDVMKEIHSVLISLGYTIINPGIFFRIKDGDRPSKEGRRERVHRGREKLNG

SEQ ID NO: 10229 - protein, 81 aa, Microcaecilia unicolor
LLFLSQHFIDPPAVQHNPDLSLEWLQGGSWTGGGGVEKGKRMEQMQVTFENVFVSFSQEEWEYLDEEQKELWREVMHIGSG

SEQ ID NO: 10230 - protein, 81 aa, Microcaecilia unicolor
DQTLVTFKDVAAYFLEVEWNILEEWQKEVYKKVIKEIHGILISRGYSIVNPDVMLKIKKENEKYFAQHCELEGKEDLNDPT

SEQ ID NO: 10231 - protein, 81 aa, Microcaecilia unicolor
MKENYEILISLGYERISPDTLSRIKQEEEPYVWDPHESREREVTHSDTAVNEALQKLKQEQNREETPVEMEQIPGQSKNVC

SEQ ID NO: 10232 - protein, 81 aa, Microcaecilia unicolor
AQASVTFHDVAIYFSEKEWQLLEEWQKELYRNVIKMIHGALTSLGHIIVNPGVVFRIKKEKTPYLWDPCDSEGQERMKDPP

SEQ ID NO: 10233 - protein, 81 aa, Microcaecilia unicolor
MMPLDKTLKGLDKFLEEEWEYLDDGQKELHREVMKENYEILMSLGDEITQEKEREEKREEREKSFTHEEHLSQHLKTHTKE

SEQ ID NO: 10234 - protein, 81 aa, Microcaecilia unicolor
QKQVTFEDIAVSFSQEEWEYLDEGQKELYREVMKENYQTLISLGTGSTTVIPDIMSHIEQGEEPYIRDEPGPEERETGKSN

SEQ ID NO: 10235 - protein, 81 aa, Microcaecilia unicolor
NRALVTFKDVSAYFLEVDWDILGEWQKELYKKVMKEIYDILISRGYSIVNPDVIFKINKEDEKYFTPHFEWERKENPDDPM

SEQ ID NO: 10236 - protein, 81 aa, Microcaecilia unicolor
MKENYETLISLGHERVEPDMLSRIKQEEEAYVKDPQQSREREVIPSYTDHKIRLEQKSEENQEEPPVEMEQIKRQSGDVFE

SEQ ID NO: 10237 - protein, 81 aa, Microcaecilia unicolor
GLPQVTFDDAAIYFSEEQWKNLEEWQREMYKELMKEIYEIMIALGHQIPKPDILSLIERGEEPCALPSKRKKTEESVTETP

SEQ ID NO: 10238 - protein, 81 aa, Microcaecilia unicolor
ALTSVVFSDVAACFWELEWDILKEWQKEIYKKVIKEIHNILMSQGCSIVNPHVIFKIKKEDDKYFTQQYKLEGKENMNDPT

SEQ ID NO: 10239 - protein, 81 aa, Microcaecilia unicolor
QIKTDLFKGVSAYFLEADWDILEEWQKELYEKVIKEVHDILISRGYSILNPDVMFKIQKEDEKYFTPHFEWEGKENPDDPM

SEQ ID NO: 10240 - protein, 81 aa, Microcaecilia unicolor
MRVTFEDIAVSFSQEEWEYLDEEQKELYREVMKENYQTLISLGTGSTTVIPDIISHIEQGEEPYIRDVPGPEERETGKSNC

SEQ ID NO: 10241 - protein, 81 aa, Microcaecilia unicolor
QNPVTFEDIVIYFSQEEWEDLEEWQKELYKDVMKENYKILISLGAGSADVTPDIISHIERGEEPYIRNELGLEKSETRKSS

SEQ ID NO: 10242 - protein, 81 aa, Terrapene carolina
MPVTFEEVAVYFTQGQGALLDPAQRALYRDVMQENYETVTSLGFPIPKPELIARLERGEEPWVPDLQACKERRLPRCTRTG

SEQ ID NO: 10243 - protein, 81 aa, Lithobates catesbeianus
SGCSIQKPEILSRLEDGGEPWLAEDREEREDVAGLGGSIKREAGDGCDNLGLGEMLHYEDPADNIPPSGIKVEEEMLEPPY

SEQ ID NO: 10244 - protein, 81 aa, Terrapene carolina
LQVAFEDVALYFTREEWELLSQPEKQVYRDQMLRNYRVLVSLGKYKISHPLLTPKTLLLVETAPHLPRKKEHHKFNKRNVE

SEQ ID NO: 10245 - protein, 81 aa, Terrapene carolina
PPFFSLPGVGFPISKPDVISQLERGEEPWVPDLQGSEKEVLLRAPCTGSDLYLDSLCLPSGDGLVRENEEEKAHQEDAEQV

SEQ ID NO: 10246 - protein, 81 aa, Lithobates catesbeianus
DPGTVTFNDVAIYFSQRDWQLLADWQRKLYRNIMKEIHGALTALGYEIANPGTLVKIQQHEEPYFRDELSKEEMAASAWVS

SEQ ID NO: 10247 - protein, 81 aa, Xenopus tropicalis
GVGQVTFDDAAIYFSEEQWGNLEEVQKKVYKELIKEIYEIMLSLGYCIPKPEIVSRIERGEDPYGVVSKKQKLQEPQPEGL

SEQ ID NO: 10248 - protein, 81 aa, Terrapene carolina
AAGPVSFEEVAVYFTAGQGALLDPSQRALYRDVMQENYENVTLLGCPVSKPDVISQLERGEEPWILSKWHHMGDYRTAPEG

SEQ ID NO: 10249 - protein, 81 aa, Terrapene carolina
KTKAVTFEEVAVYFTAEEWALLDPTQRALYRDVMWENYENVTWLGKSPWAFPIYSGCKSLLANIRLGSSQHPLCNEETGNP

SEQ ID NO: 10250 - protein, 81 aa, Lithobates catesbeianus
EKKILEVTKKITELLTGEVPIRCQDVTVYFSMEEWEYLEGHKDLYKDVMMEDQPPLTSPGKRRLYCKGESSAEAPPRSPII

SEQ ID NO: 10251 - protein, 81 aa, Lithobates catesbeianus
IRCQDVTVYFSMEEWEYLEGHKDLYKDVMMENQQLLNYVNIEKNNLHNGILILALEIIRCLTGEDCTVIMNSSNENNIGRR

SEQ ID NO: 10252 - protein, 81 aa, Microcaecilia unicolor
MRVMFEDITVSFSQEEWEYLDEGQKELYREVMKENYESLMSLENDYPRNSKTKTHDWKLIEKSKGEKMLSEREKEETPSCS

SEQ ID NO: 10253 - protein, 81 aa, Microcaecilia unicolor
QQMRVTFEDIAVSFSQEEWGYLDEGQKELYREVMKENYQTLISLAGYERISPEVLSRIKVEEEPYVQDSQESGGKEPTRSH

SEQ ID NO: 10254 - protein, 81 aa, Microcaecilia unicolor
MSALALFKDVAAYFLEVDWNFLREWQKELYKKVIKEVHDILISQGYSVVNPDVIFKIKNKDENYFPQHFEWEEKENPDDLI

SEQ ID NO: 10255 - protein, 81 aa, Microcaecilia unicolor
SQALVEFRDVAICFTKEEWMQLEEWQKQLYRNVIQEIHQTLISLGYTILKSDILIRIRDEDEHYISDQDEPQKHECHNGPT

SEQ ID NO: 10256 - protein, 81 aa, Microcaecilia unicolor
DPASVTFSDVAAYFWEMEWDRLMEWQKEVYKLVIKEIHGILMSRGYSIVHPNVIFKIKKEDENYFTQEYDCEAEENINSSI

SEQ ID NO: 10257 - protein, 81 aa, Microcaecilia unicolor
DQALVIFKDVSAYFLEVDWDILGEWQKELYKKVIKEVHDILTSRGYSIVNPDVIFKIKKEDKKYFTQHFEWEGKENPDDLM

SEQ ID NO: 10258 - protein, 81 aa, Xenopus tropicalis
RHHVTPTVGALHAPGSALQKENAKRILELISNIIQLLTGEVAIRCEDVSLYFSLEEWQYLKGNQTRYREVIKENRQQLRPL

SEQ ID NO: 10259 - protein, 81 aa, Terrapene carolina
VPKVPVMFDDSAVFSQEEWENLEDWQKELYKNVMKGNYEYMISLDYAISKPDILSRIERGEEPCARGQQESEERETSADPS

SEQ ID NO: 10260 - protein, 81 aa, Terrapene carolina
PKVPMAFDDVSIQIPREKWENLEEWQKELYKNVMKGNYDSLISLDHAISKPDILSRIEQGEELCAGEPQDLEVREIPTESA

SEQ ID NO: 10261 - protein, 81 aa, Terrapene carolina
GAMPVTFEDVAVYFTQGQGALLDPAQRALYRDVMQENYEMVISLGKGFLSPRLLEAVGSACRTLVRFFLGELDQRRMGSIM

SEQ ID NO: 10262 - protein, 81 aa, Lithobates catesbeianus
GEVPIRCQDVTVYFSMEEWEYIEGHKDLYKDVMMENQPTLTSPDGSSNRNPPERCPRPLYSRDSTQEHQKVPEEVHFEDLI

SEQ ID NO: 10263 - protein, 81 aa, Microcaecilia unicolor
MRVTFEDIAVSFSQEEWEYLDAGQKELYREVMKENYETLIALGYERIRPDILSRIKEQEEPYVWDPRETRHREDTQSDTDH

SEQ ID NO: 10264 - protein, 81 aa, Microcaecilia unicolor
VSDQDLFKDVSAYFLEADWDILEEWQKELYEKVIKEVHDIFISRGYSIVNPDVMFKIQKEDEKYFTPHFEWEGKENPDDPM

SEQ ID NO: 10265 - protein, 81 aa, Microcaecilia unicolor
QMEVTFEDITVSFSQEEWEYLDEEQKELYREVMKENYQTLISLDHHITQERKREKKQGEHPVEMEQIQKHSENVCENISPR

SEQ ID NO: 10266 - protein, 81 aa, Microcaecilia unicolor
VTFEDIAVSFSQEEWEYLDEGQKELYREVMKDNYETLISLVNEAEQELKREQNQEESVIQMEGNDDRNISQRMERRHPRNH

SEQ ID NO: 10267 - protein, 81 aa, Microcaecilia unicolor
AQMQVTFEDIAVFFCHEEWKYLDDGQKELYKEVMKENYETLISLGFLCEKPSLISKIEREEDPCVRDQQDFRERRRRLKSF

SEQ ID NO: 10268 - protein, 81 aa, Microcaecilia unicolor
QMLVTFEDIAVYFSQEQWEYLDEGQKELYKEVMKENYETLISLGIDHESINPEVLSRIKQEEKLHNRDPKDSGEIEVKHSY

SEQ ID NO: 10269 - protein, 81 aa, Microcaecilia unicolor
QMPVIFEDIIIYFSQEEWEVLEEWQKELYKDVMKENYEILISLGSGSLTVTPDIISHIERGEEPYVRDELRSEERETGKSS

SEQ ID NO: 10270 - protein, 81 aa, Microcaecilia unicolor
VLASVTFSDVAAYFREMEWDILEKWQKELYKKVIKEIHSFLLSQGYSILNPDVIFKIKREDEKYLTQRYEWERKESINDPS

SEQ ID NO: 10271 - protein, 81 aa, Microcaecilia unicolor
QIPVTFEDIAVYFSQEEWKDLEDWQKKLYKDVMKENYEILLSLGSITVTPDIISYVEREIRDEPGSEERETGKSSCSEAVA

SEQ ID NO: 10272 - protein, 81 aa, Microcaecilia unicolor
QQVSVTFKDVAAHFSEEEWEVLEEWQKELYKKVMLEVHEALISLGYGILNSDIIFRVKQRDKLYYRDWRDVDGGRSAKTSS

SEQ ID NO: 10273 - protein, 81 aa, Microcaecilia unicolor
AQASITFSDVAAYFLEADWDLLGEWQKELYKKVIKEIHSFLISQGYSILNPEVMFKIKKEDEKYFAQHCQWEGKESVNDPS

SEQ ID NO: 10274 - protein, 81 aa, Microcaecilia unicolor
RKMRVTFEEIAIYFSQEEWEYLDEGQKELYREVMKENHETLMFLAENEVTEEEVKETNREGRPLKWKLRPRHVSVYEGIER

SEQ ID NO: 10275 - protein, 81 aa, Microcaecilia unicolor
SVTFEDIVIYFSQEEWEDLEEWQKELYKDVMKENYQTLLSLGVEVPKNSKAAIYYWELCVNPGGKRILLKRDSEDTSPSEG

SEQ ID NO: 10276 - protein, 81 aa, Microcaecilia unicolor
DLASVIFNDVVAYFWDAEWDVLEERQKDLYKKVIKEIHGFLMSRGYLIVNPDVLIRVKHEGGKYFTQHHDWEENENVNDPL

SEQ ID NO: 10277 - protein, 81 aa, Microcaecilia unicolor
VSDQALFKDVAAYFLEVDLDILGEWQKELYKKVIKEVHDILISQGYSIVNPHVIFKIKNEDEKYFTQHFEWEEKENPDDLI

SEQ ID NO: 10278 - protein, 81 aa, Microcaecilia unicolor
VPVTFEDITVYFSREEWESLEEWQKELYKDVMKGNYQILNSLEKDELRSNNTETHHWKLSENLEDKVFVDEVGVDRSYYDG

SEQ ID NO: 10279 - protein, 81 aa, Microcaecilia unicolor
QVPVTFEDIAVSFSQEEWKYLDEGQKNLYWEVMKENYETLISLADSEVEQEDKRAKNREECPMLWGLIPRQSRKNSEKVSW

SEQ ID NO: 10280 - protein, 81 aa, Microcaecilia unicolor
MDVMKENYETFSSLETGTSIVTPDVISRMDRGEEPYIKDELESVKKETEKSSCSENDDLRNSNLEMHHWKLSAKPEGENMF

SEQ ID NO: 10281 - protein, 81 aa, Microcaecilia unicolor
QQVRVAFEDIAVSFSQEEWEYLDEGQKELYREVMKENYQTLISLGYERINPDILSRIKRKEEPYVQEVQESEEKEDCHSYT

SEQ ID NO: 10282 - protein, 81 aa, Microcaecilia unicolor
DQVPVTFEDVAIHFSQEEWECLEEWQKNLYKDVMKENYQTLISLAGCPTFTPDIISHIERGEEPYIRDELGSEERETGKSS

SEQ ID NO: 10283 - protein, 81 aa, Microcaecilia unicolor
KMRVTFEDIAISFTQEEWEYLNEGQKELYREVMKENYETLMFLAENEVTEEEAKETNREEHPLKWKLHPRQVCVSQGTERG

SEQ ID NO: 10284 - protein, 81 aa, Microcaecilia unicolor
DQALVTFKDVSAYFLEVDWEILGEWQKELYKKVIGEIHVILISRGYSIVNPDVMFKIKKEDDNLDDPMKSLPIVTSAISLS

SEQ ID NO: 10285 - protein, 81 aa, Microcaecilia unicolor
DQALITFSDVAAYFWEVEWDVLGEWQKELYKKVIKEIHNFLISQGYSIVNPDVIFKIKKEDEKYFTQHCDWEEKENTNNPT

SEQ ID NO: 10286 - protein, 81 aa, Terrapene carolina
MAISMPRITAMAESHRRELVSAGFPISKPDLLSWMERGEEPWVPDLQASEDREIPRSSSPGEGSASEEEEEEEEEEEEEEE

SEQ ID NO: 10287 - protein, 81 aa, Lithobates catesbeianus
MEKILEVTKKMMELLTGEVPIRCQDVTVYFSMEEWEYLEGHKDLYKDVMMDNQPPLTSPGKRRLYCKGESSTEGPPRSPII

SEQ ID NO: 10288 - protein, 81 aa, Lithobates catesbeianus
VRALVTFHDVSACFSAKEWGALEDWQKELYKNVMREIHAALLSMGYAILNPEQLLRVEGVKESSPARGKIPEHKNHNVITA

SEQ ID NO: 10289 - protein, 81 aa, Lithobates catesbeianus
VPIRCQDVTVYFSMEEWEYLEGHKDLYKDVMMDNQPPLTSPDGSSNGNPPERCPRPLYSRDSTQEDHTIPHHHQDVVKEEY

SEQ ID NO: 10290 - protein, 81 aa, Microcaecilia unicolor
DQALVTFKDVCACFLEVEWDILGEWQKELYKKVIKEIHDILTSKGYSIVNRDVIVKIKKEDEKYLTQHFEWEGKENPNKSF

SEQ ID NO: 10291 - protein, 81 aa, Microcaecilia unicolor
QIPVIFEDIVIYFSQEEWKDLEEWQKELYRDVMKENYQTLLSVGTGSLTVTPDIISHIERGEEPYIRDEPESEERETGKSS

SEQ ID NO: 10292 - protein, 81 aa, Microcaecilia unicolor
DPASVIFKDVAAYFLDMEWNILGEWQKEFYKKVIMEIHDILTSRGYSIVNPDVIFKIKKEDEKYFTQHFECEGNKNPNDPT

SEQ ID NO: 10293 - protein, 81 aa, Microcaecilia unicolor
EPVTFEDITVHFSQEQWDYLDEGQKELYREVMKENYETLISLEKDDSRNSNTEVHHWRFSEKTEEEKRLSEREKNETSSCS

SEQ ID NO: 10294 - protein, 81 aa, Microcaecilia unicolor
MKENYQTLISLGYERINPDILSRIKRKEEPYVQEVQESEEKEDCHSYTANQLIPQERRREKNQGEDPVPMEQIQRQSESDC

SEQ ID NO: 10295 - protein, 81 aa, Microcaecilia unicolor
QVPVTFEDITVSFSQEQWGYLDDGQKELYREVMKENYETLISLGTDHGSINPEVLSRIKQEEEPPFWDPEDSEDREVTLLY

SEQ ID NO: 10296 - protein, 81 aa, Microcaecilia unicolor
QMRVTFEDIAVSFSQEEWEYLDEEQKELYREVMKENYQILISLGTGSSTFTPEIISHIERGEEPYSRDEPGSEEREPGKSS

SEQ ID NO: 10297 - protein, 81 aa, Microcaecilia unicolor
LETLVTFKDVAGCFLEVEWNILGEWQKELCKKVIKEIHGILMSQGYSIVNPDVLLKIKKEDEKYFAQHCELEGKENLIDPT

SEQ ID NO: 10298 - protein, 81 aa, Microcaecilia unicolor
DQASVIFKDVAAYFLDVEWNILEEWQKELYKKVIKDIHDFLTSQGYSIVNPDVIFKIKTEDEKYFTQHFECEGNKNPNDPT

SEQ ID NO: 10299 - protein, 81 aa, Microcaecilia unicolor
VQMQVTFEDIAVSFSQAEWTYLDEGQKELYRDVMKENYQTLISLGYEGIDPDILSKIKQEEELNIRDPQDSGEREVTHSYA

SEQ ID NO: 10300 - protein, 81 aa, Microcaecilia unicolor
QMPVTFEDITVYFSQEQWEYLDEGQKELYREVMKENYETLISLGIDHESINPETILRINEEEGLPTWDPKESRDRKVTQLY

SEQ ID NO: 10301 - protein, 81 aa, Microcaecilia unicolor
TQVMVTFRDVAAYFLEMEWDILGERQKELYKKIIKEIHGFLISQGYSIINPDIIFKIKNEDEKYLTQCCKWEGKESQNDPN

SEQ ID NO: 10302 - protein, 81 aa, Notechis scutatus
LDLSQDQMQNQGWQRQKLLESLFLREAEEDQGPVSFEEVAVRFSKGEWGMLDPEQRALYREVMVENYGTVVSLGKNPFHPL

SEQ ID NO: 10303 - protein, 81 aa, Notechis scutatus
LVSFEEVAVYFSEEEWSQLDPDQKALHSEVMLENHRNVVSLGNNGQENQDSCELFQVINAKDGTEKFGIRMEFENHDRNQS

SEQ ID NO: 10304 - protein, 81 aa, Notechis scutatus
MVIGFKDVIVFFPPEEWELLTKEQKQLYWDILKENYQSLVLIGCPVTSTEILAWFKSNKCQDLQVLQRLIEDPLPEIPSIG

SEQ ID NO: 10305 - protein, 81 aa, Pantherophis guttatus
YVPFEEVAVEFTEEEWALLDCGQKALCREVMLDVSRNIASLTDDGDWNGLENKKDKQLRLLKWPRGVSAESHSFSFTIPKI

SEQ ID NO: 10306 - protein, 81 aa, Pantherophis guttatus
VSFEEVAVYFSEEESSVLDPDQKALHWEVMLENYRNVASLGNNEQDHKESRESFKVLRHRDIMKKPAIQMEFQRHERKNPS

SEQ ID NO: 10307 - protein, 81 aa, Pantherophis guttatus
NHMSFEDIAIFFSEEEWALLNPDQKLLYREIMLENARNVTCIGKRWENEDSKKEMIEHLPTVNNEIGERMFRCQWGVQSPE

SEQ ID NO: 10308 - protein, 81 aa, Xenopus laevis
YQGSVTFHDVAASFSAEEWSLLEEWQKELYRNVMRAIHAALQTMGFEIINPDVLFRIKKVKEVYSSLMDRSDSTAAFHEGD

SEQ ID NO: 10309 - protein, 81 aa, Xenopus laevis
AKAPVMFDEVAVYFSEEEWGYLAETQKLLYVNVMLDNYETLCYLGLIHEIPEIITRIWQGLDLYELPLNRAGPGSIGIKEE

SEQ ID NO: 10310 - protein, 81 aa, Xenopus laevis
PNDPVTFEDIAVYFSEEEWKGLQEGHKELYREVIQDNYQNLTDLGLVITKPEIVQKIEKGEDPVISVCLTPAQVQHRAHSR

SEQ ID NO: 10311 - protein, 81 aa, Pantherophis guttatus
AVSFKEVAVYFAEEEWALLDRGQKTLYREVMLETYGIVASLSLVTEDFPAQELRCISSRIAKDEEQEAGDLKGSGGQEGQK

SEQ ID NO: 10312 - protein, 81 aa, Pantherophis guttatus
FLVQGIVSFEEVAVHFSEEEWSQLDPAQKALHGEVMLENSRNLAYLGYNEQVNKNCEEQCQPVHLKEENRNFADQMQRTID

SEQ ID NO: 10313 - protein, 81 aa, Pantherophis guttatus
KMPVTFVDIAVYFSAEEWKNLADWQKDLYNNLLKENYESLLAFGANVNVAKPEVHPRAERGAPEPSVPEPPSAKERDVIPE

SEQ ID NO: 10314 - protein, 81 aa, Xenopus laevis
KVHVSFEEVAVYFSDEEWQQLEVWQKEFYNEVMQDILETLLSLEDNLVEGDGKQNSTGYAVMPQWSNDKGAPVTAKQIYDQ

SEQ ID NO: 10315 - protein, 81 aa, Pipra filicauda
AQVPVTFEDVMVYLSRAEWDSLQAGQRELYRDVVLDTYELLTSLGYPGPKPDILYRLERGEEPWIYPSSGHTGSWQEEPLS

SEQ ID NO: 10316 - protein, 81 aa, Pipra filicauda
RTVPVRFEEVALRFSRQEWDTLDEGQRELYRSVMEGNYEMLVSLYCALSKPHLLLWLERGEELSTMTESEPEAADVSPEPA

SEQ ID NO: 10317 - protein, 81 aa, Pantherophis guttatus
ALVPEAFMEVTVCSSDVQHTHLGRRQKTTYKNSVQGNYLTAAAIGRVHCHPSELLSRLDRGEEAWVPQIQSSDESADEGPI

SEQ ID NO: 10318 - protein, 81 aa, Pantherophis guttatus
SMAISFDDIVIYFSPDEWRLLTKDQKQLYWDMLEENYQSLLFVGGRCPISPEEVVSWVENNEYLKICMLSRFLGDLPPGIL

SEQ ID NO: 10319 - protein, 81 aa, Pantherophis guttatus
DSVSFEDVAVYFTEEEWALLDPSQRALHGEVMLENFRNVATLAYGQEHENYREQMIKSLVDQEPSQGIRKICKVSGGEESP

SEQ ID NO: 10320 - protein, 81 aa, Pantherophis guttatus
IPVSFEDVAVFFSEEEWALLDFDQKSLYREVMLENAKNVESMDDREEPEDYKEPGVNSLERTETTKGIFQNRKKPNVTEEN

SEQ ID NO: 10321 - protein, 81 aa, Xenopus laevis
TFYQELFDEVAVYFCKEEWDYLKEEEKELYKDVMLENYMALRSLGYAVVKPIIISKINQGEEPFIRVPPRSKGKVGADLLL

SEQ ID NO: 10322 - protein, 81 aa, Pantherophis guttatus
VSFEEVAVYFVEEEWEILDSNQKALHTEVMLENSQNVTALAACEQEKENSKEESTAQLQTTQNEADEETFGNQEEINSSEK

SEQ ID NO: 10323 - protein, 81 aa, Pantherophis guttatus
MLKTYENMAFVGLSSSKPDLISCLQQGKILLESDQQREFPFPSCTGPEQVSENEETSMQSIQFWPGDRRQQRKHRRKQKEE

SEQ ID NO: 10324 - protein, 81 aa, Pantherophis guttatus
PKVPLTFDDMSVYFNEKEWEKLEEWQKELYKNLMKGNHQSLVSLDYAISKPGILSQTERMTDSCHGEDQDSEEQGRLPDAT

SEQ ID NO: 10325 - protein, 81 aa, Pantherophis guttatus
NSIFFEDVAVFFSVEEWALLDLGQKNLYREVMLDNARNLSSLSDGWWMEGHGQEAAAAFPKGIKEVVERMFGKKGSKENQL

SEQ ID NO: 10326 - protein, 81 aa, Xenopus laevis
LETFVTFDDVAAYFSEDDWQCLEEWQQELYQNAMQEIHGVLLAMGYTISNPDVLVRIKNVGTSNFSDNPDSSKSKKCCNFT

SEQ ID NO: 10327 - protein, 81 aa, Xenopus laevis
EEGTVTFNDVAVYFSFHQWELLEDWQKLLYKNVMKEIHGALTALGYEIANPGVLVKVQQSDEPSYSRNNKEEIKYKGPSQI

SEQ ID NO: 10328 - protein, 81 aa, Xenopus laevis
GKMLITFDDIAIYFSEEEWKSLEDRQKALYKDVMIENYQTLRLLGFLDFKPEIITVIEEGQEPYIKKNQRSIKTVDTIKNC

SEQ ID NO: 10329 - protein, 81 aa, Xenopus laevis
GMVPVSFDEVAVYFSEDEWGYLSDRQRDLYKEVMLENLEVVLSLGYQYPRSVPQTAPALGCSFILSTGKYSDESSPYIHED

SEQ ID NO: 10330 - protein, 81 aa, Xenopus laevis
KNDMRFEDIEVQFSEEEWGFLNEQQKLLYKEVMSENYLMLLSLVGNPDVWPIKYNTLNLDDKVQLLSDLPSCDILSPTVSS

SEQ ID NO: 10331 - protein, 81 aa, Xenopus laevis
KVHVSFDEVAVYFSEEEWKHLEVWQKELYNEVMQDIMKTLWSLEDNLVRGDGKQNPAGYALMPQWSNDKGAPVRTNHSETA

SEQ ID NO: 10332 - protein, 81 aa, Xenopus laevis
AQVPVTFDDVAAYFSEDEWKDLEECQKELYKDMMKENYEALISLGNFTPYSTNSLLLDDGPVSDKEKSKYNDKLESIATPS

SEQ ID NO: 10333 - protein, 81 aa, Gopherus agassizii
RLVTFEEVAVHFTREEGVLLDPTQRALYRDVMQENYETVVLLFSLPAFFCLISHPLVSFLDMCLFGATSHFKIALNVSLLA

SEQ ID NO: 10334 - protein, 81 aa, Gopherus agassizii
KLTFEEVAVYFTQGQGALLDPAQRALYRDVMQENYEMVTSLGKGFLCPQLLEAVECVCLNLQQESPEQVELQERFLRRAEG

SEQ ID NO: 10335 - protein, 81 aa, Gopherus agassizii
MGFEEVAVYFTREEWALLDPAQRALYRAVMQENYENVTSLGFPVSSPDVSSQPQRGEEPLTEEKVGKSINCWDTHKDVKGS

SEQ ID NO: 10336 - protein, 81 aa, Gopherus agassizii
GAELVTFEDVAVYFTKEEWALLDLGQRALYRDVMQENYETVTSLGFPITKPDVISWMERRKELWTPDLQDSEELELLSDVC

SEQ ID NO: 10337 - protein, 81 aa, Gopherus agassizii
PIMPVTFEAVAVYFTEGQGALLDPAQRALYRDVMQENYEMVASLGFPIPKPDLIAWLERGEEPWVLDIQISEESEIPRGSC

SEQ ID NO: 10338 - protein, 81 aa, Gopherus agassizii
FQGPVTFEVVAVYFTRKEWALLDPTQRALYRDVMQENYDNVTSLGFPVSQPDVISQLEQGEKSWVLDLQGSEEREILRVPC

SEQ ID NO: 10339 - protein, 81 aa, Micrurus lemniscatus
CQDSDPFEEVAVDFTEEEWALLDSNQKALCREVMLEVAMNMAALGDGEGLENEKQQSLFKMQSAVSSKGQSDLLTRHNLTH

SEQ ID NO: 10340 - protein, 81 aa, Gopherus agassizii
VGFEEVAVYFSWEEWGLLDKGQRQLYRDVMQENYQTLISLGEAPLPLGDQELMKQGALNSFGSGLFPGPVDSCGIGPCPKP

SEQ ID NO: 10341 - protein, 81 aa, Gopherus agassizii
MPVTFEEVAVYFTQGQGALLDPTQRALYRDVMQENYETVTSLGKGFPSPQILEAVGSVCLNLVSSSLLRCKDPKQTAAPQT

SEQ ID NO: 10342 - protein, 81 aa, Phasianus colchicus
QGLLFAQVAVYFSREEWALLDPAQRALYRDVMLETYQCVASLGEGFAGMLKKIKDVQSGLEQGERFKKSLGNYPGKRARNP

SEQ ID NO: 10343 - protein, 81 aa, Gopherus agassizii
FQGLVTFEEVAVYFTESEWALLDPAQRALYRDVMEENYENVTSLGKLDLSDDGMMNEVENLQQDDAEQVEAHGTLSEVSRG

SEQ ID NO: 10344 - protein, 81 aa, Gopherus agassizii
MPVTFEEVAVYFTQGQGALLDPAQRALYRDVMLENYETVTSPGVCMSDSAMTPVWILSLPAGDRTVSENKEENQQQEDPEE

SEQ ID NO: 10345 - protein, 81 aa, Gopherus agassizii
VAFEDVAVYFSLEEWAALAKWQRELYRDVMKENYELVASLGEAPFPLFSQGRGSGTELRRISDPGNAVLSSPAPSPRALGP

SEQ ID NO: 10346 - protein, 81 aa, Gopherus agassizii
LFLFQGPVTFEEVAVYFTKDEWALLDSVQRTLHRDVMQENLGFPISKPDVISQLERGEEPWVPELQAAVKHSTTELYPHES

SEQ ID NO: 10347 - protein, 81 aa, Gopherus agassizii
GPVTFEEVAVYFTSEEWALLDPTQRALYWDVMQENYENVTSLGKGYCPLSSWKGKWRGKETTTQQEILMGKRKDTCTECGK

SEQ ID NO: 10348 - protein, 81 aa, Gopherus agassizii
KVMTFDDVSVYFSEKEWGKLDDWQKDLYKNLMKGNYESLISLGKDQACGRALQLETGTEKTGDLGFSACRNGGLLPAPDML

SEQ ID NO: 10349 - protein, 81 aa, Gopherus agassizii
LTAASLPREVAVYFIREEGALLDPTQRALYRDIMQENYDNVTSLGFPVSKPSVISQLEGEEEPWVLDLQGSEENEILRSPC

SEQ ID NO: 10350 - protein, 81 aa, Phasianus colchicus
PVSFAQVAVYFSREEWALLDPAQRALYRDVMLETYQCVASLGEGFPIDARKREVRWKKKRNSSNEHAKSVKRYSRLASNQH

SEQ ID NO: 10351 - protein, 81 aa, Gopherus agassizii
FQGRLTFEEVAVYFTREEWSLLDPAQRALYGDVMQENYETVVLLGFPISKPDVILQLERGEEPWVPDLQASEEEVLLRAAC

SEQ ID NO: 10352 - protein, 81 aa, Gopherus agassizii
GMPVTFEEVAVYFTQGQGALLDPAQRTLYRDVMLENYETVTLLALGSACLTLLSWIRKEWGHIVPWLSTMGPCGAASRFQG

SEQ ID NO: 10353 - protein, 81 aa, Gopherus agassizii
LMKSSIGLTFEEVAVYFTKDEWALLDSVQRTLHRDVMQENLGFPISKPDVISQLERGEEPWVPELQGSEKEVLPRAAFPGE

SEQ ID NO: 10354 - protein, 81 aa, Gopherus agassizii
KWMPVTFEKVAVYFTQGQGALLDPTQRALYKDVMLENYELVTSLGFPIPKPDLIARLEQGEEPWVPDIQNEENQQEEGPGK

SEQ ID NO: 10355 - protein, 81 aa, Gopherus agassizii
GPVSFEEVAVYFTREEWALLDPAQRALYRAVMQENYENVTSLGKNSLSSPDVTLITHQRIHTGERPYECSECGKSFTQSSN

SEQ ID NO: 10356 - protein, 81 aa, Gopherus agassizii
MEPVTFEEVAVYFSKKEWALLGPDQRALYRDVMQENYETAPTACSVCELWGSPTTHGGLDLPHPQWPPGSEPPRAVGGPFS

SEQ ID NO: 10357 - protein, 81 aa, Gopherus agassizii
LVGLLLFQGLVTFEEVAVYFTREEGALLDPTQRNVTLLGFLVSQPDVIFQVEQREEPWVPDLQGSEEREILRAPRTGEETL

SEQ ID NO: 10358 - protein, 81 aa, Gopherus agassizii
LEVAVYFTESEWSLLDPAQRALYRDVMEENYENVTSLGKHSCSDLIIYERLDTGEAPYVCLECGKTFKRKKVFSRHQRVHT

SEQ ID NO: 10359 - protein, 81 aa, Gopherus agassizii
DPVTFEEVAVYFTREEWALLDPVQRALYRDVMQENYETVTSLGKESCPLDDERREAHGMLSGRSKENVSRSCALPEKPKAC

SEQ ID NO: 10360 - protein, 81 aa, Gopherus agassizii
RPVIFEEVAVKLTRKEWTLLDPTQRALYWDVMQENYKDVTSLGKGSCPSVLGRGNEELRLTPAPRCPLCSLPHLAYSSPRK

SEQ ID NO: 10361 - protein, 81 aa, Gopherus agassizii
SAEPVQMCLQDQDLLHWNEGMVELVIFEEVTVHFTKEERTLLVPAQRALYRAVMQENYENVTLLVISPFCASVSLPNFWLF

SEQ ID NO: 10362 - protein, 81 aa, Gopherus agassizii
AAKAVTFEEVAVHFTTEEWALLDPAQRTLYRDVMQENYENVTWLGKSLWAFPIYLGCRSSLANIGLGSSQQLLCNEESGTL

SEQ ID NO: 10363 - protein, 81 aa, Gopherus agassizii
QGPVTFEEVAVYFTSEEWALLDPTQRALYWDVMQENYENVTSLDPIILYVYLGLFSNGLQYVNIPFLFLFDLSQALILFWP

SEQ ID NO: 10364 - protein, 81 aa, Xenopus laevis
RKIPIKFEDVAVYFSEDEWNYLEDRQKNLYRNVMMENYYSVSSIGCAKEKPNIIVKIEQGEKTYLGYTPTERTKYVSMLRN

SEQ ID NO: 10365 - protein, 81 aa, Gopherus agassizii
PVTFEEVAVYFTEEEWALLDPGQRALYRDVMQENYENHEEVNPQLGGLEQVEQHGTLLGRSKGNICWSVGQGKTCESQCST

SEQ ID NO: 10366 - protein, 81 aa, Gopherus agassizii
FQGPVTFEEVAVYFTRGEGALLDPTQRALYRDVMQENYETVVLLGFPISKPDVISQLEQGEEPWVPDLHGSEKEVSPRAAY

SEQ ID NO: 10367 - protein, 81 aa, Gopherus agassizii
MLAPCTLIWSDFTLCTGFPIPKPELIVWLEQGEEPWVPDLQACEEKRLPRCPHRGEDGEKPSQSLECGKCFISKTQIIRDQ

SEQ ID NO: 10368 - protein, 81 aa, Gopherus agassizii
DHKPSGTSVPVTFDDVSVYFNEQEWENLEEWQKELYKNVMKENYDTLISLGRARVLLVYFQLSLTASGTVLSDQIHTLSHL

SEQ ID NO: 10369 - protein, 81 aa, Gopherus agassizii
MGGGLVTFEEVAVYFTESEWALLDPAQRALYRDVMEENYENVTSLVSKPDVISWLEQGEEPWVPDLQNAEEKETLRHTCTD

SEQ ID NO: 10370 - protein, 81 aa, Gopherus agassizii
SSPPSPPPPGEEWALLDPVQRALYRDVMQENYETVTSLGKESCPLDDERREAHGMLSGRSKENVSRSCALPEKPKACETLH

SEQ ID NO: 10371 - protein, 81 aa, Gopherus agassizii
FLFQDLVTFEEVAVYFTKEEWALLDPTQRVLYRDVMQENYETKLWGLLKTLSSNNFTPSFISQVLTSFLAQLFCLISHPLV

SEQ ID NO: 10372 - protein, 81 aa, Gopherus agassizii
APTTYTHVFPLRLPISKSDVISQLEKGEEPWVPDLQESEEQEILRGACPGEELLNELKSCQCLKEGAEISYKDLVSSLSLG

SEQ ID NO: 10373 - protein, 81 aa, Gopherus agassizii
NYMPVTFEEVAVYFTQGEWALLDPGQRALYRDVMQENYRNVTSLGFPIPKPSVISQLDRGEEPWGLGSHCCTLGLFQKLPP

SEQ ID NO: 10374 - protein, 81 aa, Gopherus agassizii
NFWILRLPPGTKGLVPQEWGSLEEWQKELYKNVMKGNYETLISLDYAISKPDILARIEQGEEPCIRDQQDSERVEIPVEPC

SEQ ID NO: 10375 - protein, 81 aa, Micrurus lemniscatus
QDLVSFEDVAVFFSVEEWALLDCEQKALYQEVMLENKRNVASLDPLMAFSSSPGTSVLCNGGSTAAELPTQDLVSFEDVAV

SEQ ID NO: 10376 - protein, 81 aa, Gopherus agassizii
IPELLFTWCCCSVNSGVVSGAAGTECWTLFLFQGPMTFEEVAVYFTREEWALLDPGQRAVHRDLSPCPDLNSITFPSLNKP

SEQ ID NO: 10377 - protein, 81 aa, Gopherus agassizii
FQGPVTFEEVAVYFTREEWALLDPVQRALYRDVMQENYETVVLLGKESFSKPDVISQLERGEEPWVPDLQGSEKEVLPRAA

SEQ ID NO: 10378 - protein, 81 aa, Taeniopygia guttata
EQEPVTFKDVMVFLSRAEWDALTAGQRELYRDVVSDTYELLISLGYPGPKPDILHRLERGEEPWICSSPGHARGWLEEPSS

SEQ ID NO: 10379 - protein, 81 aa, Gallirallus okinawae
PKVPVTFDDVSVYFNNKEWEKLEEWQKELYKNVMKGNYESLISLDYAISKPGVLSQIEQGEEPRVRNEQDLEESEIITDAT

SEQ ID NO: 10380 - protein, 81 aa, Xenopus laevis
PQMVPTFDDVAVYFSRSEWKSLSASQREMYKSVMTENYQCVLSLGYPIRKPEIVSMMEVGEELWSKNDSARPGQKEVEGET

SEQ ID NO: 10381 - protein, 81 aa, Gallirallus okinawae
PKVPVTFVDIAVYFSAEEWKNLEEWQKELYNNLVKENYESLISLDGALSRSEAQPRSERGEGPCVPEQRELDQRELPPDAC

SEQ ID NO: 10382 - protein, 81 aa, Xenopus laevis
AKAQVKFDEVAVYFSKQEWGYLTERQKMLYANVMLDNYETLCYLGLIHEIPDIITRIWQGQDHNDLPLNIVGWGSIRIKEE

SEQ ID NO: 10383 - protein, 81 aa, Gopherus agassizii
SQRNLTFEEVAVYFTKEEWALLDPAQRALYRDVMQENYENVTSLGFPVSKPDVISQLERGEESWASDLQVFGCKLDAKLIP

SEQ ID NO: 10384 - protein, 81 aa, Gopherus agassizii
FQGPVTFEEVAVYFTREEAALLDPTQRALYRDVMQENYETVVLLGFPISKPDVILQLERGEEPWVLDLQGSEKEVLPRAAF

SEQ ID NO: 10385 - protein, 81 aa, Gopherus agassizii
GQQVLNIGLSLFQGPVTFEEVAVYFTREEWALLDPTQRALYRDVMQENYENVTSVKNSHTGSDQRFLKSSITGQCQVPQRE

SEQ ID NO: 10386 - protein, 81 aa, Gopherus agassizii
RLHPIPGPVTFEEVAVYFIREEWALLYPAQRALYRDVMQENYETVVLLGKESCLLGEEPWVPDLQDAQKKMLLRAAFTGEE

SEQ ID NO: 10387 - protein, 81 aa, Gopherus agassizii
RGPVTFEEVAVYFTREEWALLDPAQRALYRDVMQENYENMTLLGKNSFYVIQFLIFPHLSSTYFGFLSHFPFLFVVSLCIP

SEQ ID NO: 10388 - protein, 81 aa, Gopherus agassizii
YIGPVTFEEVAVYFSREEWALLDPVQRALYRDVMQENYETVTSLGSPVSEPDVISQLERGEEPWVPDRQSSEKEVPPRATC

SEQ ID NO: 10389 - protein, 81 aa, Gopherus agassizii
MFSIPCAGFPISKPDMISQLERGEEPWVLDLQGSEEGDTQRAACTGSPGGLVSYGQLWLMASYGSCLRPGSSAIPDGYNSV

SEQ ID NO: 10390 - protein, 81 aa, Gopherus agassizii
MELPLFEVAVYFSREEGTLLDPTQRALYRDVMQENYETVVLLGYLVFQRDVISQLEQGEEPWVPDLQGSEEREILRSSCTV

SEQ ID NO: 10391 - protein, 81 aa, Gopherus agassizii
PVTFEEVAVYFTQGQGALLDPAQRALYRDVMQENYKMVICLGKGFPSPQILEARSHTIQCLECGKCFSSKSALNSHKKSHR

SEQ ID NO: 10392 - protein, 81 aa, Gopherus agassizii
SAHGSVRNYISQEEWALLDPTQRALYRDVMQENYENVTLLDKGSCPLCSWKGKRREMVHASHTMPPLLCPVSASPQYAKPF

SEQ ID NO: 10393 - protein, 81 aa, Phasianus colchicus
SSSVSVDRTSCDVATYFSREEWALLDPVQRVLYQDVMLETYECGSLAPNALHGATNSNNLPTLWLFISLFYSFPLSSRKPL

SEQ ID NO: 10394 - protein, 81 aa, Gopherus agassizii
MPVTFEDVAVYFTQGQGALLDPTQRALYRDVMQENYETVTSLGKSVKGFPLAKPDLITRLERGEEPWVSDLQATGDERMSE

SEQ ID NO: 10395 - protein, 81 aa, Gopherus agassizii
SPPPPPRRSPCHCGRPQAGPMTFEDVAVYFTKEEWKKLAGWQRELYRHVMLENYELLASLGELLGLGGRVWGEILSGPCGN

SEQ ID NO: 10396 - protein, 81 aa, Gopherus agassizii
PVFQEVPVTFEEVAVYFTQRQGALLDPAQTALYRDVMLENYETVTSLGKGFPSPRTDTETIWLMKEKQTNPNEENPYQCLK

SEQ ID NO: 10397 - protein, 81 aa, Gopherus agassizii
VTFEDVAVYFTQGQGALLDPAQRALYRDVMQENYETVTSLGKGFLSPQILEAVGWHRSESNGGGGDEDPRAQQTTVKEEAP

SEQ ID NO: 10398 - protein, 81 aa, Gopherus agassizii
FQGPVTFEEVAVYFTREERALLDLSQRDLYRDVMQENYETVVLLGFPVSEPDVISQLEQGEEPWVPDVLGSEKEVPPRAAC

SEQ ID NO: 10399 - protein, 81 aa, Gopherus agassizii
MDLLGEIRGCLFVAVYFTSEEWALLDPTQRALYWDVMQENYENVTSLGKGYRPLSSWKGKWRVKVYAGPAMPPLLCPVSAS

SEQ ID NO: 10400 - protein, 81 aa, Gopherus agassizii
QGQVTFEEVAVYFSREEGTLLDPTQRALYRDVMQENYENVTSLGKGFPVSKPDVISQLERGEEPWVLDLQAGAGMVSENEE

SEQ ID NO: 10401 - protein, 81 aa, Taeniopygia guttata
PKVPVTFVDIAVYFSAEEWKNLEEWQKELYNNLVKENYEALLSLDGAISRSEAQPRSERGDGPCVPEQRELEQRELPPDTC

SEQ ID NO: 10402 - protein, 81 aa, Phasianus colchicus
MMEMMFNVCITEMSLPASKPVLISLLEEGKDPWLPDVHGLEDMAGDLSPASIQDRMTALEEVLQKCDVARWQRGSGSVGKA

SEQ ID NO: 10403 - protein, 81 aa, Gopherus agassizii
RKGNTGKNQQGPTGRGLLLFQGPVTFEEVAVYFTREEWALLDPRQRALCRDVMQENYENVTLVKVHATPTMPPLGWGVVAL

SEQ ID NO: 10404 - protein, 81 aa, Gopherus agassizii
GRMPVTFEEVAVYFTQGQGALLDPAQRALYRDVMQENYKMVICLEFSIPKPELITLLERGEEPWVPDLQDCEERNGGGDED

SEQ ID NO: 10405 - protein, 81 aa, Gopherus agassizii
LGRVTFEEVAVYFTREEGALLDPAQRALYWDVMQENYEMVYNFWTCAFLLSCLFLIVRGKYVEKPLQEDAEQVEPHGTLSG

SEQ ID NO: 10406 - protein, 81 aa, Gopherus agassizii
RNICPEWGLWLFQGAVTFEEVAVYFTEEEWAVLDPGQRLLYRDVMQENYESVTSLGKGFLVPLDIRRFSPQISGSVLNPSE

SEQ ID NO: 10407 - protein, 81 aa, Gopherus agassizii
FQGLVTFEEVAVYFTREEWALLDPTQRALYRDVMQENYETVVLLVSDKFHSPPLFSFSEKKVLPGAACTGEELIKPAQKLF

SEQ ID NO: 10408 - protein, 81 aa, Gopherus agassizii
HGKKQSLEEVAVYFTQGQGALLDPAQRALYRDVMQENYVMVTSRGKGFPSPRLLEAAVGRSVMWPVHLLKFFPDPLNFRGL

SEQ ID NO: 10409 - protein, 81 aa, Gopherus agassizii
GPVTFEEVAVYFTREEGALLDPTQRALYRDDMQEHYENALSSFLGKGVTWPQPPSWLRLHPSSEVTPFYPIPNAANPSETP

SEQ ID NO: 10410 - protein, 81 aa, Gopherus agassizii
VTFEEVAVYFTREEWALLDPAQRALYRDVMQENYENMTLLEELRNPIPSSHLIRHVRIHTIHTGERPYECSECGETFAQRS

SEQ ID NO: 10411 - protein, 81 aa, Micrurus lemniscatus
EEVAVYFSEEEWSQLDPDQKALHSEVMLENHRNVVSLGNNGQENQDSCELFQVISAKDGTEKFGIRMEFESHERNQSKNWN

SEQ ID NO: 10412 - protein, 81 aa, Gopherus agassizii
FQGPVTFEEVAVYFTSEEWALLDPTQRALYWDVMQENYENVTSLGFPVSKPHIISQLEQGAEPWKEEQNSQQGNVEQVAKH

SEQ ID NO: 10413 - protein, 81 aa, Gopherus agassizii
QPEPESWLQVAVYFTSEEWALLDPTQRALYWDVMQENYENVTSLGFPVSKPRIISQLEQGEEPWVPDLQGSEEREILRDPC

SEQ ID NO: 10414 - protein, 81 aa, Gopherus agassizii
FQGPVIFEEVAVYFTSEEWALLDPTQRALYWDVMQENYENVTSLGFPVSKPHIISQLEQGEEPWVPDLQGSEEREILSFSC

SEQ ID NO: 10415 - protein, 80 aa, Gopherus agassizii
LSFLREPVTFKEVAVYFTVEEWALLDPGPRALYWDVMQENYETMTSLGKDSCPLGYEKHLGQILCRDLHWSPRIQGDQAM

SEQ ID NO: 10416 - protein, 81 aa, Gopherus agassizii
VTFEEVAVYFTREEWALLDPTQRALHRNVMQENYENVTSLGDVTVHEKEEQNSQPENVEQVDKHRELSQRSKRNVSRSHEQ

SEQ ID NO: 10417 - protein, 81 aa, Gopherus agassizii
QGPVTFEEVAVYFTREEGALLDPAQRALYRDVMQENYENVASLGSISGIGKASESQQSPEGNQPREKVGKSTDCQRIHQDF

SEQ ID NO: 10418 - protein, 81 aa, Gopherus agassizii
FQGPVTFEEVAVYFSREEGTLLDPTQRALYRDVMQGNYETMVLLAEFLVFQRDMISQLEQGEEPWVPELQGSEEREILRSP

SEQ ID NO: 10419 - protein, 81 aa, Gopherus agassizii
MLLLLLDSFSFRGWEEWALLDPVQRALYRDVMQENYKTVVLLGKKACPLVIRSCGVSKEPDNGKKRRGVLRKGTQEVGWVD

SEQ ID NO: 10420 - protein, 81 aa, Gopherus agassizii
LTFEEVAVYFTREEWSLLDPAQRALYGDVMQENYETVVLLGFPISKPDVILQLERGEEPWVPDLQASEEEGVTSVWILSVS

SEQ ID NO: 10421 - protein, 81 aa, Gopherus agassizii
LGNSEWCRELAVYFTEGEWALLNPAQRALYREVTQENYATVASLGFPVSKPDVISQLERGEEPWVPDLQGSEERELQKGAQ

SEQ ID NO: 10422 - protein, 81 aa, Gopherus agassizii
DEGPVTFEEVAVYFTREEWALLDPTQRALHRNVMQENYENVTSLGFPVSQPDVIFQLEQEEEPGPENVEQVDKHRELSQRS

SEQ ID NO: 10423 - protein, 81 aa, Gopherus agassizii
LNGRVTFEEVAVYFTREEWALLDPAQRALYWDVMQENYEMVVLLVGFPVSKPDVILQLERGEEPWVLDLQGSEKEVLPRAA

SEQ ID NO: 10424 - protein, 81 aa, Gopherus agassizii
LEGLVTFEEVAVYFTESEWSLLDPAQRALYRDVMEENYENVTSLGFPVSKPDVISWLERGEDPWVPDLQDPEKRETLREAC

SEQ ID NO: 10425 - protein, 81 aa, Gopherus agassizii
QPVTFEEVAVYFSEEEWALLDLGQRALYRDVMQENYETLLIVQSPQLLFGFVLPFLIPLSEVPGTGTDSCLDLLSVPSLTL

SEQ ID NO: 10426 - protein, 81 aa, Gopherus agassizii
QMPVTFEDVAVYFTQGQGALLDPTQRALYRDVMQENYETVTSLGKRFPLAKPDLITRLERGEEPWVSDLQAIHTGERPHKC

SEQ ID NO: 10427 - protein, 81 aa, Gopherus agassizii
PHLVPVTFEEVAVYFTQRQGALLDPAQTALYRDVMLENYETVTSLGKGFPSPRLLESVGPAMGGPNDSTVQQTNPNEENPY

SEQ ID NO: 10428 - protein, 81 aa, Gopherus agassizii
MPVTFEDVAVYFTEEEWALLDPTQQAFYRDVMQENYENVTSLGFLISKPDVISQLEQGEEPWVPDIQDQGRRWLLQPLLIA

SEQ ID NO: 10429 - protein, 81 aa, Gopherus agassizii
MGSSPYKYEEWALLDPTQRALYWDVMQENYENVTSLGKEFGGVQFLFLFDLSQALVLVWPSPLYLCLRFLSLITAGDAMLC

SEQ ID NO: 10430 - protein, 81 aa, Gopherus agassizii
SSMPVTFEEVAVYFTHGQGALLDPTQRALYRDVMQGNYEMVTSLGKGFPSPRLLEAMGSVCLTLVRFFPGQLDQRGMFCVM

SEQ ID NO: 10431 - protein, 81 aa, Gopherus agassizii
FQMLVTFEEVVVYFTQGQGALLDPAQRRALYRDVMQENYETVTSLGKGFLFPRLLEAMGSSCLTLIRFFPRQLDQRKMFCV

SEQ ID NO: 10432 - protein, 81 aa, Gopherus agassizii
LTTNFGSMSGFPVSKPHIISQLEQGEEPWVPDLHGSEERRILRAPRTGEETINELRICKCLKETSGMPCRALGRSLSSLLS

SEQ ID NO: 10433 - protein, 81 aa, Xenopus laevis
QKELVKFEDVAVYFSEDEWECLAEGQKELYEEVMMHNFELVTSLGLLIQRDNWTDLESDSFDAPEKQSAGGPELHIIIKEE

SEQ ID NO: 10434 - protein, 81 aa, Gopherus agassizii
VSFEEVAVYFTQGQGALLDPAQRALYRDVMQENYEMVTSLAMGSMCLYLVLFFPSDKSQGRDTLALPSVWERIHCEITACD

SEQ ID NO: 10435 - protein, 81 aa, Gopherus agassizii
GPVTFEEVAVYFTREEWARLDPRQRALCRDVMQENYENVTSLGKDSQEQNSQQGNVEQVDKDRELWQRSKRNVSRSHEQRN

SEQ ID NO: 10436 - protein, 81 aa, Gopherus agassizii
VTFEEVAVYFTREEGALLDPTQRALYRDVMQENYENVTALGKGSCPLISWKGKRRDMVHAKKPGGLRTVNGTQSFQGTKYI

SEQ ID NO: 10437 - protein, 81 aa, Gopherus agassizii
VSFEEVAVYFTQGQGALLDPAQRALYRDVMQENYEMVTSLGVYFPAFVLCECLGGIWRRSPIAQSLCWVFPLCYSSFSPAQ

SEQ ID NO: 10438 - protein, 81 aa, Gopherus agassizii
ARDDGPVTFEEVAVYFTREEWALLDPVQRALYRDMMQAVITLYLYSSSKEEVMRDEEGTQEAPKAPGGGAGKFTFPPPSFS

SEQ ID NO: 10439 - protein, 81 aa, Gopherus agassizii
MPLEELLEEWALLDPAQRALYRDVMQENYENMTLLGLPISKSDVISQLEKGEEPWVPDLQESEEQEILRGACPGEELLNEL

SEQ ID NO: 10440 - protein, 81 aa, Gopherus agassizii
MNSGLEVAVYFTEGQGVLLDPGQIALYRDVMQENYETVTSLGLPIPKPDLVARLEAGEEPWVPDLQASEERKIPRDTHTGE

SEQ ID NO: 10441 - protein, 81 aa, Gopherus agassizii
LVTFEEVAVYFTEGQGALLDPSQRALYRDVMQENYETVTSLVELQGTFFRRAEENFSQCLEQRKAWSNWHKSERKLGNCQR

SEQ ID NO: 10442 - protein, 81 aa, Gopherus agassizii
SGIMPVTFEEVAVYFTQGQGALLDPAQRALYRDVMQENYETVTSLGKGFLAPCMLDFPSVLFLLILPQHNDSCLDCLSPSR

SEQ ID NO: 10443 - protein, 81 aa, Gopherus agassizii
FQGPVTFEEVAVYFTREEWALLDPTQRALYRDVMQENYENVTSLGKDSCPLGSWKGKCGVKVHATPTKHPALFFGITPTCQ

SEQ ID NO: 10444 - protein, 81 aa, Gopherus agassizii
MLVTFEEVAVYFTQGQGALLDPAQRALYRDVMQENYEIVTSLGFPLPKPELIARLEQGEEPWVPDLEASEERDISRGTRTD

SEQ ID NO: 10445 - protein, 81 aa, Gopherus agassizii
LTKVAFEEVAVYFTQGQGALLDPAQRALYRDVMQENYETVTSLGNPVPKPELITQLERGEELWVPDLQTSEEGEIPRGSHT

SEQ ID NO: 10446 - protein, 81 aa, Gopherus agassizii
FQMPVTFEEVAVYFTQGQGALLDPAQRALYRDVMQENYEILTSLGKGFPSPRLLLGSVCRTLVRFFPDHLDQRGMFCVMHS

SEQ ID NO: 10447 - protein, 81 aa, Gopherus agassizii
KHGSARFRDIAIYFSREEWEMLAEWQKELYRDVMKEHYDNLNSLGHADTKPDVLSRIEQGEEPWVVDQQEERERLECTSLG

SEQ ID NO: 10448 - protein, 81 aa, Gopherus agassizii
KHGPVTFEEVAVYFTREEWALLDPTQRALYRDVMQENYEMVVLLGFLNSKPDVISQLEQGEEPCIVDLQGSEKEVLPRAAC

SEQ ID NO: 10449 - protein, 81 aa, Micrurus lemniscatus
DVVCFEEVAVYFSEEEWSQLDADQEELYREVMVENSRNLLSLGFNGQQKKNCKEECQAIHSKGGNRKCVDQMQLKSDETKQ

SEQ ID NO: 10450 - protein, 81 aa, Gopherus agassizii
AALRLPSSEGNTGQLTFEEVAVWFSREEWEMLADWQKELYRAVMLENYENLFLLGNKPGHRFMFRRVQNPFDKHLKYPGMA

SEQ ID NO: 10451 - protein, 81 aa, Xenopus laevis
LKAPARFEEVAVYFTESEWRCLEEGQKEIYKEVMLENYLAFHSLGYRHKKPDIISKIENEKDPCLSDKKNTQKSFHSVPSF

SEQ ID NO: 10452 - protein, 81 aa, Gopherus agassizii
FQVPVTFEEVAVYFTEEEWALLDLCQRNLYIDVMQENYENVTSLGFPIPKLEVISQLEQGKELWVTELQGSGDGLVCENEE

SEQ ID NO: 10453 - protein, 81 aa, Gopherus agassizii
INTVGLLLFQMPVSFEEVAVYFTQGQGALLDPAQRALYRDVMVENYEMVTSLGKGFPSILLLEAVGPTYLNVFRFFLSQLY

SEQ ID NO: 10454 - protein, 81 aa, Gopherus agassizii
FQMPVTFEEVAVYFTQGQEALLDPAQRALYRDVMQENYKTVTSLGKGFPFPQLLEAVGSGTSLERTEGNFSQCWDQREASG

SEQ ID NO: 10455 - protein, 81 aa, Gopherus agassizii
MMPVTFEEVAVYFTKGQGALLDPAQRALYRDVMLETYETVTLLALGSACLTLLSWIRKEWGHIVPWLSTRGSCGKTHTGEK

SEQ ID NO: 10456 - protein, 81 aa, Gopherus agassizii
FQELVTFEEVAVYFTREEGALPNPAQRALYRDVMQENYENVTSLGFPVSKPYIISQLGKGEEPWVPDLQSSEKREILRAPC

SEQ ID NO: 10457 - protein, 81 aa, Gopherus agassizii
EKKSIMPVTFEEVAVYFTQGQGALLDPAQRALYRDVMQENYEMVTSLGNFSQRLEQGNAWGDRHRSEMQLENYPRKKQDEF

SEQ ID NO: 10458 - protein, 81 aa, Gopherus agassizii
LFQQPVTFKEVPVYFLGQWALLEPSQRAFYRDVMQENSETVTLLGFPIPKPSITSWPEQGEELWVLAVQNSEERELPGVVQ

SEQ ID NO: 10459 - protein, 81 aa, Gopherus agassizii
FQMPVTFEEVAVYFTKGQGALLDPAQRALYRDVMLETYETVTLLGFPIPKPDLIVRLEQGEEPWVPDLQADEERKSLRGNF

SEQ ID NO: 10460 - protein, 81 aa, Gopherus agassizii
NFWILRLPPGTKGEVPKEWGKLDDWQKDLYKNLMKGNYESLISLDYAISKPDLLSRIERGEEPCGGAQEDSEESALLADVR

SEQ ID NO: 10461 - protein, 81 aa, Gopherus agassizii
ELQQVTFEEVAVYFSREEGTLLDPTQRALYRDVMQENYENVTSLGFPVSKPDVISQLERGEEPWVLDLQGSEEGEILRAAC

SEQ ID NO: 10462 - protein, 81 aa, Gopherus agassizii
ERKLQVAFEDVALYFTREEWELLSQPEKQLYRDQMLRNYRALVFLGKDQFPLFYSQLFDLNVKLIMDRKGKTKMRFHTHNC

SEQ ID NO: 10463 - protein, 81 aa, Gopherus agassizii
VTLKDVAVYFTKKDWGRLDKRQREFYTNVMQKNLKSSLWVKINFPSLLKSCVVSQEFVKLCPQKLCERYSHCHATTIFLNC

SEQ ID NO: 10464 - protein, 81 aa, Pantherophis guttatus
SVSFREVAIHFTSEEWLLLDPSQKVLYQEVMLETSRMVASLVLQENDQETNLVPLQIIKIEIPEEASTDKRGRRKHEKKNN

SEQ ID NO: 10465 - protein, 81 aa, Pantherophis guttatus
FVSFEEVAVYFSEEEWSQLDPDQKALYSEVMLENYRNVVSLGNNGQENQDSCELFKVINAKDGTEKFGIQMELETHNRKQS

SEQ ID NO: 10466 - protein, 81 aa, Xenopus laevis
VTASVHFSEVAIYFSEEEWQCLRKGEKELYKTVTMDSYYMLLSLDLLNVKPEIVQRIEQGRDPSVSCHQEMLWRKKCMGTQ

SEQ ID NO: 10467 - protein, 81 aa, Gopherus agassizii
FQMPVTFEEVAVYFTQGQGALLDPAQRALYRDVMQENYKMVTSLGFPLPKPELISRLEQGEEPWVPDLQACEERESLSGNH

SEQ ID NO: 10468 - protein, 81 aa, Xenopus laevis
YQMPVTFFDVAASFTEEQWSRLATWQKELYQNVMKELHGAITTLGHKIENPEILFKIKYSDETCVCIDFNSKERENIDSKD

SEQ ID NO: 10469 - protein, 81 aa, Xenopus laevis
SLTQVAFEDVAVYFSELEWALLKDCQKDLYKTVMRDNYEVVASLGFPVLRSKALGRMRHGVTVELEGTEEIDIGDSAQNMK

SEQ ID NO: 10470 - protein, 81 aa, Gopherus agassizii
SLGPVTFEEVAVYFTREEWALLDPTQRALHRNVMQENYENVTSLGFPVSQPDVIFQLEQEEEPGVPDLQGSEEREILRAPC

SEQ ID NO: 10471 - protein, 81 aa, Gopherus agassizii
PVTFEEVAVYFSEEEWALLDLGQRALYRDVMQENYETVTSLGTDSCLDLLSVPAGDGMMSENKEENPQQEGSEQREPQGTV

SEQ ID NO: 10472 - protein, 81 aa, Gopherus agassizii
MGPVTFEEVAVYFTREEWALLDPVQRALYRDVMQENYEMVVLLVGFPISKPDVISQLERGEEPWVADLQGKKYLCFTSTRS

SEQ ID NO: 10473 - protein, 81 aa, Gopherus agassizii
FQGLVTFAEVAVYFTREEGALLDPTQRALYRGVMQENYETVTSLGKGSFSKPYVISQLEGGEEPWVLDLPGSEESEILRSP

SEQ ID NO: 10474 - protein, 81 aa, Gopherus agassizii
EMPVTFEEVAVYFTKGQGALLDPAQRALYRDVMLETYETVTLLALGSACLTLLSWIRKEWGHIVPWLSTRDRHRSEMQLEN

SEQ ID NO: 10475 - protein, 81 aa, Gopherus agassizii
LKTFTSSSEVALYFTREEGALLDLTQRALYRDVMQENYESVVLLGFPVSKPDVISKLERGEEPWVPDLQGRCHSWLPTCPD

SEQ ID NO: 10476 - protein, 81 aa, Micrurus lemniscatus
RRLGIPPENIMKSLVFMGLSPFSGEPKKPPRRPVQDFVTFEDVAVYFSADEWSQLDPDQKALHKEVMLENYRNVASLVALQ

SEQ ID NO: 10477 - protein, 81 aa, Gopherus agassizii
FWILRLPPGSRGEVPKPEWGSLEEWQKELYKNMMKGNYEALISLDYAISKPDLLSRIERGEEPCVGDQGRSEESEIPADPS

SEQ ID NO: 10478 - protein, 81 aa, Gopherus agassizii
VFGLVTFEEVAVYFTQGQGALLDPAQRALYRDVMQENYKMVTSLGFPIPKPELIARLERGEEPWVSVWVRSGSRIQLLSLD

SEQ ID NO: 10479 - protein, 81 aa, Gopherus agassizii
SVEPVSFEEVAVYFSKEEWALLDPGQRALYRDIMQESYETVTCLGKDSCPLRGRLPEETAGNPVSRGLENRSAADPAGDRP

SEQ ID NO: 10480 - protein, 81 aa, Gopherus agassizii
PKVPVTFDDVSVYFSEKEWGKLDDWQKDLYKNLMKGNYESLISLDYAISKPDLLSRIERGEEPCGGAQEDSEESALLADVR

SEQ ID NO: 10481 - protein, 81 aa, Gopherus agassizii
VTFEEVALYFTREEWALLDSAQRALYRDVMQENYENAELIPSSLLFGGRIWGSSVPDFCLTFLQIQTGERRPYECSECGKS

SEQ ID NO: 10482 - protein, 81 aa, Xenopus laevis
DPGTVTFNDVAVYFSLHQWELLEDWQQLLYKNVMKEIHGALTALGYEIANPGILVKVQQSDEPCYSTRNEEQEEIKSKGPS

SEQ ID NO: 10483 - protein, 81 aa, Xenopus laevis
MQTFVTFDDVAAYFSEDDWQCLEEWQKELYQNAVQEIHGDLLAMGYTISNPDVLVRIQNVGTSDFSENQDSTLSKNCCNFT

SEQ ID NO: 10484 - protein, 81 aa, Gopherus agassizii
MEREGEVAVYFTREEWALLDPTQRALYWDVMQESYENVTSLAGFPVSKPPIISQLEQGEEPWVPDLQGSEEREIQRVPCTT

SEQ ID NO: 10485 - protein, 81 aa, Gopherus agassizii
PVTFEEVAVYFTEEEWALLDPGQRALYRDVMQENYENVTLLENDSSLDFLFILTADGIKIEHEEVNPQLGGLEQVEQHGTL

SEQ ID NO: 10486 - protein, 81 aa, Gopherus agassizii
NSPEGCFGEVAVYFTQGQGALLDPAQRALYRDVMQENYETVTSLGFPIPKPELITQLECGEEPWVPDLQACKERRAQQTNP

SEQ ID NO: 10487 - protein, 81 aa, Gopherus agassizii
VYMLVTFEEVAVYFTEGQGALLDPSQRALYRDVMQENYETVTSLGDKTKSENEEGDPQQKCPEQVELQGTFFRRAEENFSQ

SEQ ID NO: 10488 - protein, 81 aa, Gopherus agassizii
VSFEEVAVYFTPGQGALLDPTQRALYRDVMQENYKTVTSLGPEQVETHEMFSERSRENISQNREQEKTWKSPCMSERQLGI

SEQ ID NO: 10489 - protein, 81 aa, Gopherus agassizii
VTFEEVAVYFSREEGTLLDPTQRALYRDVMQGNYETMVLLGKDSCPFSEFLVFQRDMISQLEQGEEPWVPELQGSEEREIL

SEQ ID NO: 10490 - protein, 81 aa, Gopherus agassizii
FQVPVTFADVAVHFTAAEWALLGDSQRELYRDTMLENYGNMASLGIPIHKPDIISCLERGEEPFVPAAQGLEEPEILRGIY

SEQ ID NO: 10491 - protein, 81 aa, Micrurus lemniscatus
FDHVEEVALDFTEEEWRLLDSGQKALCWEVMQEVFRNMAALDDGPANENDMSAKLNLQQLEKNEVEVMFGTQGDITRQERS

SEQ ID NO: 10492 - protein, 81 aa, Xenopus laevis
EEDSIKTDNVAVCFSVEELESFEERQKEPCKNIMREIHQTPTVVGYIYVKPETVSLIRRGEELCVSSNLYSRKRDLRISPA

SEQ ID NO: 10493 - protein, 81 aa, Podarcis muralis
DGECSGEDVAVCFTDKAWTLLDPDQRAQHKEVKEENGGIVDSLDGDDLEGKNKGEHNRIHIAEKSYKYSECGENIRQSSQS

SEQ ID NO: 10494 - protein, 81 aa, Alligator sinensis
MEPWVMLDSRQKALYRDVMQESYETLMSLALFPISKPDLISWMERGEEPSAQDFQGWESPRGVHTADGLVSDNEEEEEDAD

SEQ ID NO: 10495 - protein, 81 aa, Alligator sinensis
MLENYETVASLGFLTSKPDVVSQLEEGDAPWVPDCQECEERRSLRHTSAVGEGVNEEENLQQKRLQAVEQCGTLLGSLRGN

SEQ ID NO: 10496 - protein, 81 aa, Alligator sinensis
LELPAVFEAVAVYFTREEWELLDDEGKELYRDQMLRNYQALVSLGYRGPTPDLICRLQQGQGELWGCAGQEPGESSQREDL

SEQ ID NO: 10497 - protein, 81 aa, Alligator sinensis
TELPEAFEDVAVYFTREEWELLEDAQKGLYRDQMLRNWRALVSLGYRGPTPDLICCIVRGQKELWVCDDEDREDISKSKDL

SEQ ID NO: 10498 - protein, 81 aa, Alligator sinensis
WELPEVFEDVAVYFSRKEWELLEDEDKVLYRDQMLKNYQALVSLGYGGLTPDVICRIQRGEVELWVCDDEDGGETSRLEDL

SEQ ID NO: 10499 - protein, 81 aa, Alligator sinensis
PFLREAFEDVAVYFTRKEWELLGDEDKELYRDQMLKNYRALVSLGYQGLTPDLICCIERGEVELRVSDEEDHGESSRSEDL

SEQ ID NO: 10500 - protein, 81 aa, Paroedura picta
IEGPVSFEEVAVYFPEEEWALLDPGQRALYREVMLENYRSLVSMGSGICKPDLISWLEDLDEMFPLDSGEAKNLTDSLSCW

SEQ ID NO: 10501 - protein, 81 aa, Paroedura picta
AQVPVAFEEVTVYFSGEEWAELADWQKELYQDVMVENYQLVSSLECLLSIPELLSRLAPGGVPCAADPPPPSGSSDPPASG

SEQ ID NO: 10502 - protein, 81 aa, Paroedura picta
PKVPVAFDEVSVYFSEQEWGNLDESQKALYRNVTKGNYESLVSLDYATAKPDLLSQTDHEGGPGCPGEGENDPGIIRREIP

SEQ ID NO: 10503 - protein, 81 aa, Paroedura picta
AAPSAQGLPSFSLEDVSVSFSPAEWALLDPAQRALWREVMRENAENVAFLGRFLRSGVRTCPGATGASVVAISRARESVPA

SEQ ID NO: 10504 - protein, 81 aa, Alligator sinensis
TPEVMTFEEVAVYFTTEEWALLDPGQKALYSAVMQENYETVASLGFPVPRLDVVSQMEEGEEPWVLDLQYSTESEMLRSIL

SEQ ID NO: 10505 - protein, 81 aa, Paroedura picta
EAYQEVIAASAKGQRAFLAPDHGSLYQDVMQESYKTLLSMAPPLQLQPEFPIQKSELLARLEQDQQAWTPEAQKSDENTEE

SEQ ID NO: 10506 - protein, 81 aa, Paroedura picta
PARCLISFEDVAVRFTKAEWGLLNPDQRALYREVMVENYTNVAWLAIPKPSLISWLQESEAPFPAEPKEEERWTGNGQEYE

SEQ ID NO: 10507 - protein, 81 aa, Paroedura picta
AVQSPVSFEEVVVDFSEAEWALLDPGQRALYREVMLENWGSVVFLEEAGKFSHSQRTNTEEILVMFSSIKESMEGRNVLNA

SEQ ID NO: 10508 - protein, 81 aa, Paroedura picta
WDDKVRFEDVAVYFSTAEWAELAGWQRDLYRAVMVENYEAVASLGYPSRKPEVVCRIEREEDPCIEEPLEAPRWRRPPSPW

SEQ ID NO: 10509 - protein, 81 aa, Paroedura picta
APFEGVAACDSEAEWALLDPGQRALCREVMLESYGSVAALAGDDPESEELHQLLPDEVKDEDLKENFQNQRQKESQGENFQ

SEQ ID NO: 10510 - protein, 81 aa, Podarcis muralis
GPVCFEDVTIRFTDEEWAFLDPDQRALHKDVMEETRGIMASLDYDEIKNKGDHDKIPREEKPRENLECGESCSQRSHSTSH

SEQ ID NO: 10511 - protein, 81 aa, Aptenodytes forsteri
DLFLQFALEQRALPRPPGYPGPKPDILYRMERGEEPWVCTSQSPVRWDGPDSPSPGHDGDVGWLGQPPSGWWPGAGRRRGL

SEQ ID NO: 10512 - protein, 81 aa, Alligator sinensis
MELQQIFEDMAVYFTRKEWELLGDEDKVLYRDQMLRNFHALVSLGYGGPTPDVICRIQRGEADLWICDDENHGGILRPEDL

SEQ ID NO: 10513 - protein, 81 aa, Alligator sinensis
LELREVFEDVAVYFTRKEWELLEEHDKVLYQDQMLRNYEALVSLGYGGPTPDLIYRIQQGQVELWVWDDEDGGEISRSEDL

SEQ ID NO: 10514 - protein, 81 aa, Alligator sinensis
SKLREAFEDVAVYFTQEEWALLEAGDKGLYRDQMLRTYQALVSLGYQGPTPDLICRIQQGEMELWVCDGDEEAGESSLSED

SEQ ID NO: 10515 - protein, 81 aa, Alligator sinensis
MAQDLDSDHREEMAISLPRITALAESHRRGLVSAGFPISKPDLLSWMDRGDEPWVPDLQASEGTEIPRDASPAGDGSASEN

SEQ ID NO: 10516 - protein, 81 aa, Alligator sinensis
QKLREAFEDMAVYFTRKEWELLEEEDKELYRDLMLRNYQALLSLGYQGPTPDLICRIEQGEVDLWVCDDENHGENSKAEDL

SEQ ID NO: 10517 - protein, 81 aa, Alligator sinensis
VQEVFEYVAVYFTRREWELLDDDDKVLYQDQMLKNFNTLVSLGYRGPAPDLICSIQQGQVELWVCDDEDCGEISGSDDLLA

SEQ ID NO: 10518 - protein, 81 aa, Alligator sinensis
LQLREVFEDVAVYFTREEWELLDDEDKVLYRDQMLKNHQALVSVGYRGPTPDLICSIQRGQVELWVCEDEDCGEISRWEDL

SEQ ID NO: 10519 - protein, 81 aa, Alligator sinensis
SKLSEAFEDVAVYFTWKEWALLEAADKMLYRDQMLKNYQALFSLGYRGPTPDLICRIQRGEMELWVSDLEEAGESSLSEDS

SEQ ID NO: 10520 - protein, 81 aa, Alligator sinensis
MLAEWQRELYWDVMVESYQTLVSLGCDAPKPKILLLMEEKGKPYAEDAAERAGRDLDCASAVAERLHRSRKVKLEDHEVEI

SEQ ID NO: 10521 - protein, 81 aa, Alligator sinensis
MEPRDAFEDVAVYFTREEWALLDDGDKGLYRDQMLRNYQALVSLGYRGPTPDLICCIQRGKVELWVRDGEDHGEISGSEDL

SEQ ID NO: 10522 - protein, 81 aa, Paroedura picta
RKGAIPFEEVAVYFTEEEWALLDPGQRTLYREVMLETYDSVVSLESWICKPDLISRLEDTDELFFPDAEDVRSSAGSVSCQ

SEQ ID NO: 10523 - protein, 81 aa, Paroedura picta
VGPFSFEEVAVSFTEAEWALLDPGQRALHREVMLENYGSVASLEEHERNEEGKEFVQQLSSDHKNENLKENIRNQSRTKRK

SEQ ID NO: 10524 - protein, 81 aa, Paroedura picta
YAAVEPAAGQPNQGPVSFEEVAVYFTVEEWALLDLCQRLLYREVMLENYGMVSSVGKNPFNAFPRGRISFVMVVREKVGKG

SEQ ID NO: 10525 - protein, 81 aa, Paroedura picta
LQGHASFEDVAVIFTESRWTLLDPQEKGFYRDTMQEKFENVASLGFLSGKPDIISQLEQEEDPWIPDQPALERGEVVLEFS

SEQ ID NO: 10526 - protein, 81 aa, Paroedura picta
VSFEEVAVFFTREEWALLDPAQRALYGEVMQENYELVTSLAGDAAENERQGELGEVSSEGDKDPEEEPWDRDGPLRQLKRK

SEQ ID NO: 10527 - protein, 81 aa, Paroedura picta
PSFSLEDVSVSFSSAEWALLDPAQRALWREVMWENAENVAFVAGKDQRTQEREELHQEMEDRAKNEDLKVKTRNRVRQRFE

SEQ ID NO: 10528 - protein, 81 aa, Phasianus colchicus
PKVPVTFDDIAVYFNEQEWERLDSWQKDLYKAVMKGNYETLISLDYAVSKPDILSRIERGEELCVRDCWEPPQMLNRGGPD

SEQ ID NO: 10529 - protein, 81 aa, Podarcis muralis
HPFSFEDVAVLFTAEEWALLDPAQRALHKEVMEETWRTMISLGKVPCWVIISVLEFSRYFSGTNLPYLDGSQRCHLECQGF

SEQ ID NO: 10530 - protein, 81 aa, Crotalus adamanteus
EEGLVSFEEVAVYFSEEEWSWLDPDQKALHWEVMMENYRNVASLVQDSCELFQVIKVEDGMEESAIQTELENHERNQSENW

SEQ ID NO: 10531 - protein, 81 aa, Paroedura picta
QGRVSFEEVVVCFTEEEWALLDPAQRALHREVMVENYGIVASLAGDGWKSESEEDLLRVSWGRSRAEQTKKQRRKTILPRK

SEQ ID NO: 10532 - protein, 81 aa, Paroedura picta
CPRPHNEGNRRQPGLPSFEEVAVDFTEEEWALLDQGQRALYVEVMLENCGSVATLSDERETKKEGRPPAASVEGVRCKEED

SEQ ID NO: 10533 - protein, 81 aa, Paroedura picta
PQKAETLPPESSYAAVETTGRRPAQGPVSFEEVAVFFTGEEWALLDPCQRALYRQVMLENYGMVVSVGKNPFDDIFKANKE

SEQ ID NO: 10534 - protein, 81 aa, Paroedura picta
AEGRVSFEEVAVYFTPGEWALLHPAQRALYKKVMLENFGIVASLGPGIAKPDLISWLEEEDERLSLTLEDEEGPAAGGVWE

SEQ ID NO: 10535 - protein, 81 aa, Streptomyces griseoruber
SHVDWSAGAVELLTEQRAWPELDRPRRAAVSSFGLSGTNAHVILEQVTAPEPEAVSREPHGPLPWVLSGRTETALRAQAER

SEQ ID NO: 10536 - protein, 81 aa, Deltaproteobacteria bacterium RBG_19FT_COMBO_52_11
KVWLILDEAFIDFTEEESMKEEAGASSRLVILRSLTTFFALPGLRVGYMISNPQVIKKFHQAKEPWRVNALAQVAAVESLK

SEQ ID NO: 10537 - protein, 81 aa, Platysternon megacephalum
DSPFQKPEPGFAELEKRLSDFSLKSAILQEVLLGFKETLRLELENSTGFPVSKPDVVSQLERGEEPWVLGLQGSEEREIQG

SEQ ID NO: 10538 - protein, 81 aa, Platysternon megacephalum
FQVPEAFEEVTVCATEEQWAVLDPAQRALFRDAMPKHCRTVLTTESPSPKPDSICHMDQEEEPCVLDSEDSSEKETPKGPQ

SEQ ID NO: 10539 - protein, 81 aa, Chelonia mydas
EKVPVTFDDVSVYFSKQEWGKLDDWQKDLYKNVMKGNYESLISLDYAISKPDLLSRIERGEEPCGGAQEDSEERVIPMEPS

SEQ ID NO: 10540 - protein, 81 aa, Chelonia mydas
MQENYETVTSLGFPIPKPDLISQLEQGEEPLRNHIHISLQVGPSSRRQRREMAVMEPAQMPVTFEEVAVYFTPGQGALLDP

SEQ ID NO: 10541 - protein, 81 aa, Chelonia mydas
NKQKGLKPPLALYFTEGKWALLGLGQRALYWGVMRENYETVASLGDGPASGNVEEKAQQAGLERVEPRGAVSGSSPGNGFQ

SEQ ID NO: 10542 - protein, 81 aa, Platysternon megacephalum
MPVQFKDVAVTLTEAEWSLLDEEQRQLYGTVMQENYRSISSLGCPVRKPALISQLERGEEPCIPDPPAPEEQETQRDVPTD

SEQ ID NO: 10543 - protein, 81 aa, Dryobates pubescens
EVSKALVESKVTSFSPEEWESLESWQRELYTNVLRGKNEALISLDDAISKPDLLAQLQRVEAPCNEIETASREALAEPTAH

SEQ ID NO: 10544 - protein, 81 aa, Ficedula albicollis
KVPVTFVDIAVYFSAEEWKNLEEWQKELYNNLVKENYEALLSLGKYGALSRSEAQPRSERGDGPCVPEQRELEQRELPPDA

SEQ ID NO: 10545 - protein, 81 aa, Platysternon megacephalum
MARGLNDAWGDVRPRRFLIPKPDVISRLERGEEPWVSDPQGSEERGSLGGACIGFPVSKPDVISPLKGEGEPWIPDLHGSE

SEQ ID NO: 10546 - protein, 81 aa, Ficedula albicollis
MEPCVVLDPRQRALYRDVMQHGYEILVALEFSVPKPDLLSYLDCEEEVTALDLHVSRDTPAAGEVPGGIKRRRVPPLLSFS

SEQ ID NO: 10547 - protein, 81 aa, Chelonia mydas
VTFEEVAVYFTKGEWALLDPGQRALYRDVMRENYETVTSLGDVSQRPEWGEARTSQRWSERQQGNHQKERQDKSMQNVRGV

SEQ ID NO: 10548 - protein, 81 aa, Chelonia mydas
VQGLVTFDDVAIYFCKEEWEELAEWQKELYRDVMRDNYETLIFLANELVSRNNDKESPERLGKHRTLPRARASAFPDCDGG

SEQ ID NO: 10549 - protein, 81 aa, Chelonia mydas
FQGLVTFKEVAVYFTREERALLAPFQRALYRDVMQENYETVVLLGDGIVSENEEEKPQQEDAEPLEPYGTLSGRSKGNDSR

SEQ ID NO: 10550 - protein, 81 aa, Chelonia mydas
ADMPVTFEEVVVYFSEGEWALLDLGQRALYRDVMQENYRNVTSLGFPIPKPSVISQLDRGEELWVPDLQGSQAREIQRNIP

SEQ ID NO: 10551 - protein, 81 aa, Anolis carolinensis
VRPDQVTFEDVAVHFTEEEWALLDPDQRALHWEVMDENLGLVSSLNFLSLPIMIQDIKTLQMTFILNVKEVFLPPNTTSLL

SEQ ID NO: 10552 - protein, 81 aa, Anolis carolinensis
VQGWVTFEDVAVHFSPEEWDLLDPDQKALHTHIMEETHRIITSLADNWMKSNVRTTSGRYFLDRWKFIGHQKHHTEAEGST

SEQ ID NO: 10553 - protein, 81 aa, Gallus gallus
ATLPKPSGGHPPAASLVLAVPSKEPLCLQEPVSFAEVAVYFSREEWALLDPAQRALYRDVMLETYQCVAWLGEGFAAFPPR

SEQ ID NO: 10554 - protein, 81 aa, Anolis carolinensis
FFFQVMFEDVAVHFSKAEWALLDLDQRALHWEVMEENYRMVASLAHFNSDATIIGQCRDTNVYWAIDHIIIESTTSLMIFS

SEQ ID NO: 10555 - protein, 81 aa, Gallus gallus
LQEPVSFAEVAVYFSREEWALLDPAQRALYRDVMLETYQCVAWLAPLPAPKPGLISLLEGGEDPWIPDVRSPEAVPGDLSP

SEQ ID NO: 10556 - protein, 81 aa, Anolis carolinensis
HGPITFEDVAVHFSPEEWVTLNPDQRVLHLQIMEEIDGILESLDVGVRLLESQILSRSEREKDCETYLQHHLTNQTLCPYF

SEQ ID NO: 10557 - protein, 81 aa, Gallus gallus
CQEPVSFAEVAVYFSREEWALLDPAQRALYRDVMLETYQCVAWLAPLPVPKPTLISLLEGGEDPWIPGVCSPEAVPGDLHP

SEQ ID NO: 10558 - protein, 81 aa, Anolis carolinensis
QIPVTFEDVTVHFTLEEWDSLLEWQQALYLEVMEANFELVASLVQAGSVPHTPELIGKTEQGDEPWAPGPQIPGWHQWMVH

SEQ ID NO: 10559 - protein, 81 aa, Anolis carolinensis
FEVPVSFEEVAVYFREEEWALLTLRQKALYREVMLANYETVASLGKDLFPPQHISKLGMQGNMRTQDKMKKQKRCQQIKNK

SEQ ID NO: 10560 - protein, 81 aa, Anolis carolinensis
PKAPVTVDEVSVYFSKPEWEKLEEWQRELYKNVMKGNYESLVSMDYAIAKPELLSRIERGEEPCAEDRGLSEEEEAVREVG

SEQ ID NO: 10561 - protein, 81 aa, Anolis carolinensis
LVPITFEDVAVHFSLEEWALLNPGQKVLHMQIMEEIHGIVDSLVSPLPSSRWDVIQGMDHHGQVWLLKQQGSLKNLPRDII

SEQ ID NO: 10562 - protein, 81 aa, Anolis carolinensis
KMPVTFVDIAVYFSAEEWKNLADWQKDIYNNLVKENYESLLNSGVDVNISKPESHPRVERGADQHVSEQQITTKEREVPAE

SEQ ID NO: 10563 - protein, 81 aa, Gallus gallus
HPSQEPVTFGDVAVYFSREEWALLDPARRALYWDVMLETYECIASLASKPVVIPLLEGGEDPWIPDVHSLKDMAGDICSAG

SEQ ID NO: 10564 - protein, 81 aa, Gallus gallus
FQEPVSFAEVAVYFSREEWALLDPAQRALYRDVMLETYHCVASLVPLPVHKPLVITLLEGGKEPWIPDVCSPEKMVEELGP

SEQ ID NO: 10565 - protein, 81 aa, Anolis carolinensis
SSSQVNFEDVSVNFTDEEWALLDPGQRALHQQVMEENLGIVSSLGKVKNNMEQFEKLQVTSGFSFSLELSESQVTRFFGHG

SEQ ID NO: 10566 - protein, 81 aa, Anolis carolinensis
GLVTFDEVAVCFTEEEWALLDAGQRALHKEVMEENRGLVASLDPFCSDQFLLSISTVGRRERNEEETQTKTEAKQTLMINS

SEQ ID NO: 10567 - protein, 81 aa, Gallus gallus
AREPVSFVEVAVYFSREEWALLDPAQRALYRDVMLETYESVASLGPFPAPKPVVISLLEGGDDPWIPDVHSPEAVSGDFSP

SEQ ID NO: 10568 - protein, 81 aa, Gallus gallus
LCLQEPVSFADVAVYFSREEWALLDPAQRVLYRDVMLETYECVASLAPKPAMISLLEGGEEPWIPDVRGLEDTAGDLSPAG

SEQ ID NO: 10569 - protein, 81 aa, Anolis carolinensis
VPEAFVEVTVHSNELHCSLVGRCRRALCKKAMQEKYRNMTSFGGFPVHTSDLLSRLKRLNRGEEAWVPDLQSSDESADEGP

SEQ ID NO: 10570 - protein, 81 aa, Gallus gallus
PKVPITFDDIAVYFNEQEWERLDSWQKDLYKAVMRGNYETLISLDYAVSKPDILSRIERGEELCVKDCWEPPQTLNRDGPE

SEQ ID NO: 10571 - protein, 81 aa, Anolis carolinensis
GPDQVTFEDVSVDFSEEEWALLGPSQKTLHQQIMEENLGIVSSLVGFWQAEADASQRTSVCQSSLYRERPFKCLQCEKSFS

SEQ ID NO: 10572 - protein, 81 aa, Anolis carolinensis
SWVPTTFEEVAVSFLPEEWDVLNPNQRALYNEVMEETHSIVSTLGIFPIHSLIIVYILKCNISYLIQEMQFKSNQFKIKNQ

SEQ ID NO: 10573 - protein, 81 aa, Ficedula albicollis
KVPVAFNDASFNFSEEEWKSLNEWQKELYRHIMKGNYEAVISMGADAAISKPELLTRIEQGEDPNTEDQEDSEGGETPTDP

SEQ ID NO: 10574 - protein, 81 aa, Anolis carolinensis
VEQDQVTFEDMAVTFSDAEWALLDPDQQILYKEVMEENYKMVVSFGGDGQESENGQVSFGKKTWIYRHKKPHKSPRKEKPF

SEQ ID NO: 10575 - protein, 81 aa, Anolis carolinensis
MQVAFDEVALPFTEQEWALLDANKRALYWDVMQENYRHVISLVGILVLSWDCRSFLQHKKKDYGMSHYHMTNASSVIFSKG

SEQ ID NO: 10576 - protein, 81 aa, Gallus gallus
MEEPVTFEDIAIYLSRAEWDMVAEEQRELYRSVMLDNYELLASLGYPGPKPDILHRLERGEEPWVNTPQSTVKWDGPDRPL

SEQ ID NO: 10577 - protein, 81 aa, Anolis carolinensis
QVTFGDVALYFTEEEWKLLDQNQKSLYYAVMMKNYENVSFLRDSWWKTKVNMKYRKSLSLELGLATHLHTHECLQCGKHFA

SEQ ID NO: 10578 - protein, 81 aa, Anolis carolinensis
PLPEVTLEEVAVYFSEEEWALLDPNQRALYGEVIEENLAIMASLECWMSEGWIIETTVTGNLAAMMLYFRKLSHPLPIGLV

SEQ ID NO: 10579 - protein, 81 aa, Anolis carolinensis
QVNFEDVSVNFTDEEWALLDPGQRALHQQVMEENLGIVSSLGKVKNNMDAFSLLQLVFHPPQVEHCLPFNRRLRQRKYPIS

SEQ ID NO: 10580 - protein, 81 aa, Anolis carolinensis
CFFVQVTFQEVAVSFSEEEWALLDPDQRALHQQVMKENVETVSSLIFYPWKLAFSLAKEGTDSWKLQQATYAKRKPFKCLE

SEQ ID NO: 10581 - protein, 81 aa, Anolis carolinensis
PKVPVTFEDNSAYFSEQEWSNLEEWQKELYKNVMKSNYESLVSLDYAIAKPDLLSRIEQGKRPYEEGEEEEVSKGREITAE

SEQ ID NO: 10582 - protein, 81 aa, Platysternon megacephalum
RPAQVAFEDVAVRFSPAEWAALAEWQRELYWAVMRENFELVASLGSADPKPESSCEMERGEEPQQGQEREIPEAPGMGEGI

SEQ ID NO: 10583 - protein, 81 aa, Anolis carolinensis
NQGPFAFEDVAVHFSLEEWALLNPDQKVLHVQIMEEIHEIVDSLAHKQSLDSVISKMLCQVNQSLWNSHLQKTSKNCKSPI

SEQ ID NO: 10584 - protein, 81 aa, Gallus gallus
PSVPVTFKDVFVEFSGDEWALLDDEQKELHRSVMQSNCEMLLSLYCDLAKPEDLLQMERGEPCVPAEPDLEGTAVSLKPGA

SEQ ID NO: 10585 - protein, 81 aa, Thamnophis sirtalis
MMQNYQAVVSVDMAVSKPELLARIEQGEDSEQTKSKEEYPREESGLGDQPGSPISALHGSSWIEEEDLSLVKSMGALEDRE

SEQ ID NO: 10586 - protein, 81 aa, Thamnophis sirtalis
IPLIFDDVAVFFSGEEWPLLDFNQKNLYREVMLENARNLATLGDGWENENYKETAFQTVESEIGEKTLQNQQGPQWPEANQ

SEQ ID NO: 10587 - protein, 81 aa, Thamnophis sirtalis
MITFEDVSIHFTEEEWTLLNHKEKNLYWNVMHQNYDNVACLASDQIKGESQEEDPLQEVFEPAVEWLEKSKETVLQHPEEK

SEQ ID NO: 10588 - protein, 81 aa, Micrurus surinamensis
LQGVVSFEDVAVYFSKEEWSQLDADQKALHGEVMLENSRNLLSLGFNGQENKYWKEEYQAINLKEVKRKFVDQLQPKSDET

SEQ ID NO: 10589 - protein, 81 aa, Micrurus surinamensis
VQDFVTFEDVAVYFSAEEWSQLDPEQKALHKEVMLENYRNVASLVALQRLKKEQIVSGRISEKPRSESVVSESALDHIKQS

SEQ ID NO: 10590 - protein, 81 aa, Micrurus surinamensis
ITEHPTRRKDLSDPTQEEWAHLDPHQKSLHREVMLENSRNVASLGTQRTFPHTPRKRTATGGKPYKCLECGKIFSKSSNLT

SEQ ID NO: 10591 - protein, 81 aa, Micrurus surinamensis
ETMIETPIQEGLVSFEEVAVYFSEEEWSQLDPDQKALLWEVMLENYRNVASLGDDEQDHKEPRESFQGFRHGDVMEKRAIQ

SEQ ID NO: 10592 - protein, 81 aa, Chelonia mydas
VPVTFEDVAVRFSAEEWEILEGWQKELHKEVMEENYQLLISLGQPVPTLALLALTAEREAAGGQIRSVSGERELASKGGSS

SEQ ID NO: 10593 - protein, 81 aa, Micrurus surinamensis
WSDPFEEVTVDFTEEEWALLDSDQRALCSEVTLEAFRNIIALGDGMENVNAKQERLMLLQRANNEGEVTSDHQENPKRERN

SEQ ID NO: 10594 - protein, 81 aa, Micrurus surinamensis
MLDSGQKALCREVMLELFRNMAALCDGLVSEKEKQLRLLTLQREVSAKSHSFPFTLSKILNRKYKLHTFAKYERNFHLSKK

SEQ ID NO: 10595 - protein, 81 aa, Chelonia mydas
AQGPVTFEELAVYFTEGEWALLDPAQRALYREVMQENYATVASLGFPVSKPDVISRLERGEEPWVPDLQGSEERELQTGDG

SEQ ID NO: 10596 - protein, 81 aa, Chelonia mydas
MTFEEVAVYFTEGQGALLDPAQRALYWDVMQENYEMVTSLGFPIPKPELIARLERGEELWVPDLQVAKERESPRGTRTGGE

SEQ ID NO: 10597 - protein, 81 aa, Chelonia mydas
AQGLVTFEEVAVYFTREEGALLDPTQRALYRDVMQENYETVVFLGDGRVSENEEEKLQQEDAEQVEPHGTLSGGSKGNGSR

SEQ ID NO: 10598 - protein, 81 aa, Chelonia mydas
VLCDMPVLRCCLDCDLGQLEHRLLPQRDRGWGVTVSKASSVPSQGIPVSKPDVISQLKRGEEPWAPDLWGSEEREVLRGSR

SEQ ID NO: 10599 - protein, 81 aa, Chelonia mydas
PVTFEDIAIYFTREEWEMLAEWQKELYRDVMKEHYDNLISLGHAGTTPDVLSRIERGEEPWVMDQQEERERLECTLHGEQL

SEQ ID NO: 10600 - protein, 81 aa, Micrurus surinamensis
DQSQATSTRDSALIDSSPFSAGDEKVEHPTQVLVSFEEVAVHFSKEEWSRLDPDQKSLYREIMLENSRNLAFLSKDPRSLF

SEQ ID NO: 10601 - protein, 81 aa, Chelonia mydas
ECLLFQGPVTFKEVALYFTDPGQRALYRDAMQENHANGTSQGSPIPKPDAVSQRQQEEEPWVPDLQGSRERENPRGDCPVQ

SEQ ID NO: 10602 - protein, 81 aa, Chelonia mydas
FMMPVTFEEVAVYFSEDEWALLDEKQRELYRDVMQENYKTLISLGFTMAKPDVLSQMERGEEFWIPDIQGSEEREIPRSTT

SEQ ID NO: 10603 - protein, 81 aa, Chelonia mydas
GKDAGDLRGVAVYFTQGQGALLDPAQRALYRDVMQENYETVTSLAGFPLPKPDLITQLERGEEPWVPDLSSPAEREIPRGA

SEQ ID NO: 10604 - protein, 81 aa, Chelonia mydas
TKGPVSFEEVAVYFTQGQGALLDPAQRALYRDVMQENYETVTSLGYPIPKPELITQLEQGEELWVPDLQASEEGEIPRGTH

SEQ ID NO: 10605 - protein, 81 aa, Pogona vitticeps
MENYELVTSLGYPVLKPDLLSRIERAGEQCAGDQLDSSRGIPTDPCPGYRFFKPESLSWIERWEELGVTDRQKLEEGKLCS

SEQ ID NO: 10606 - protein, 81 aa, Pogona vitticeps
GGVTSVTFEDVTLFFTKGQWNLLDQHQRALYKEVMQENYDNMASLGFPLGKPDLISWLEQDPWFPDQLALEEVGTTSQYSP

SEQ ID NO: 10607 - protein, 81 aa, Columba livia
PKVPITFDDISVYFNEQEWERLDRWQKDLYRAVMRGNYETLISLDYAVSKPDILARMERDEELFVRDARKAPLTGAADGLE

SEQ ID NO: 10608 - protein, 81 aa, Columba livia
QDVVTFKDVAIYFSPEEWVRLSAGQRELYQEVMLDNYELVTSLDRESKLLYKMDPEEESCEGVPYSSADSGAPDSSSTSAC

SEQ ID NO: 10609 - protein, 81 aa, Chelonia mydas
PEEPVTFEDVAIYFTQGQGALLDPAQKALYRDVMQENYEMVTSLRFPIPKPELIVRLEGGEEPWVSDLQACEEKEIPRGTH

SEQ ID NO: 10610 - protein, 81 aa, Chelonia mydas
FMMPVMFEEVAVYFSEDEWALLDEKQRELYRDVMQENYETLLSLGFPIAKPDVLSQMEQGEEPWFPDLQGSKERENPRGTS

SEQ ID NO: 10611 - protein, 81 aa, Chelonia mydas
LQMPVTFEEVAVYFTEGQGALLDSSQRALYRDVMQENYETVTSLGLPIPKPDLIAQLEAGEEPWVPDLQVFEERKIPRGTH

SEQ ID NO: 10612 - protein, 81 aa, Chelonia mydas
MAAVGPVQVGIIGELLVGSCWQEKGSKDIGGFPVSKPDVISQLERGEEPWAPDLRGSKEREILRGSRLAGDGMVRETMEQN

SEQ ID NO: 10613 - protein, 81 aa, Chelonia mydas
MEPCVLLDPHQKALYRDVMQESYDTLMSLEFPLLKAEVISRVEPCRRGSKEREIPAASGTGLGCAQQASSSPAGVGTASET

SEQ ID NO: 10614 - protein, 81 aa, Chelonia mydas
PKVPMAFDDVSIQIPREKWENLEEWQKELYKNVMKGNYESLISLDHAISKPDILSRIEQGEELCAGELQDLEVREIPTESS

SEQ ID NO: 10615 - protein, 81 aa, Chelonia mydas
PKVPVTFDDVSVYFNEPEWGSLEEWQKELYKNMMKGNYEALISLDYAISKPDLLSRIERGEEPCVGDRGRSEESEIPADPS

SEQ ID NO: 10616 - protein, 81 aa, Chelonia mydas
AQMPVTFEEVAVYFTQGQGALLDPAQRALYRDIMQENYETVTSLGVPIPKPDLIARLERGEEPWVPDLQDSKERENPRGTR

SEQ ID NO: 10617 - protein, 81 aa, Chelonia mydas
MFAEWQKELYREVMTENYEMLLSLGYPGPKPDLLYRLERGEEPWVHTPQGPVAWESPSPGGDVLSGSGEQQGRLWASILQC

SEQ ID NO: 10618 - protein, 81 aa, Chloebia gouldiae
PKVPLTFDEISVYFNELEWERLERWQKDLYRAVMRGNYETLPDILSQMERDEELSDKESQKSPWTQTGDGQEPLRAAEERG

SEQ ID NO: 10619 - protein, 81 aa, Strigops habroptila
MEPYVLLDPRQRALYRDVMQESYDTLMALEFPVSKPDLLPRLDHGDEPTALDLHVPRDTPAAEDGAGAEQEPPQEEKEPKE

SEQ ID NO: 10620 - protein, 81 aa, Pogona vitticeps
MQNNYATVALLGLPADEPELICKVEPEEEPWIPKEQAARERRILPASKSGAETPEVAVPSYRQYRGTTWTYPEVIDLLVIW

SEQ ID NO: 10621 - protein, 81 aa, Pogona vitticeps
RVSFEDVAMYFTKEEWHLLDWSQRLLYKEVMMENYENVAYLDDWRKTNSCSKCGKLFTHRLELAKHQQMEREEKLYKCPVW

SEQ ID NO: 10622 - protein, 81 aa, Pogona vitticeps
QDPVDFEDVAVYFTKEEWGLLDANQRSLYWEVMLDNYKILSSLDNWRGMNMCTKWPQEADTGEKPYKCHECGECFAHSLDL

SEQ ID NO: 10623 - protein, 81 aa, Pogona vitticeps
VEDEEPVTFEDVAVYFTAEEWDLLDLNEKSLYSEVMMENYENVTSLVPMPELLSHVEVGDDLWVPYSSSLDAMEASGTRSE

SEQ ID NO: 10624 - protein, 81 aa, Pogona vitticeps
VTFEEVAVSFTQEEWALLDPDQRALHQEVMEENWQTISSLGHNWREKYICLKSEKNFRHKLELAKDQRTYIEEESCVQEKP

SEQ ID NO: 10625 - protein, 81 aa, Columba livia
GKMSVTFEDVALYFSPEEWAKLSGCQRQLYQEVMLENYQMVASLGWANVKPEIICKMEREETPCVPDVPGKQQRHQSPVPV

SEQ ID NO: 10626 - protein, 81 aa, Pogona vitticeps
MMEQYVLLDPRQRALYQDVMQESYETLMALGRNTFPFKFPLSKPDLLSHLEQRDEATAFDLQHPRGSPPAVPESKEEVNPV

SEQ ID NO: 10627 - protein, 81 aa, Pogona vitticeps
KMQMAFEEVAVDFTEEEWVFLNANERTLYWDVMQENYEHVISVGVFLVLAERNHSSHLPLASSCSSMKGLSQVTFGEVAVY

SEQ ID NO: 10628 - protein, 81 aa, Pogona vitticeps
VAKALEELAVNFSEEEWALLDPRQKALHTEVMKETFTHAMSLGVGMMLGIYPSPSLLSGGAKTASPQTMGKSRWRAVQCFS

SEQ ID NO: 10629 - protein, 81 aa, Pogona vitticeps
LLSFDEVAVYFTEREWDLLDAGQRALYKDVMLENYGMVTSLVTPLTPSLEEMVKPDLISRLEKGEDGFALDSEEEKRWGGT

SEQ ID NO: 10630 - protein, 81 aa, Pogona vitticeps
VAFEDVAVYFTAEEWDLLGPNQKSLYSEVMMENYENVSYLADNWKKTIAFAHSQKDFIHKLHQRTHKEDEHHTRAEPCEST

SEQ ID NO: 10631 - protein, 81 aa, Pogona vitticeps
PKVPVSFEDNSAYFSEQEWGNLEEWQKELYKNIMKSNYESLVSLDYAIAKPDLLSRLEQGERPCQEEEEEEEGEVSKGREI

SEQ ID NO: 10632 - protein, 81 aa, Pogona vitticeps
DQGPVPFEEVAVSFSQEEWALLDPDQRALHQEIMEENQQMISSLDMSDSSVLSFLPFSFIRDNWREKNAYSKSGKSFAHHF

SEQ ID NO: 10633 - protein, 81 aa, Aythya fuligula
PKVPLTFDDISVYFNEQEWETLDSWQKDLYKAVMRGNYETLISLDYAVAKPDILSRLERDEELCTRGCREAPQTDTQDGQE

SEQ ID NO: 10634 - protein, 81 aa, Pogona vitticeps
DQVTFEEVAVSFTEEEWALLDPDQRALYKEVMEEVYGLVASLGALSSSNYHAAEKPYKCLECGKSFTEKGNLTVHQRKHTG

SEQ ID NO: 10635 - protein, 81 aa, Pogona vitticeps
VMMAFEDIVVHFTEEEWALLDDGQRALHQGVMEENVASLISLATSTREKRSEEEEGTDIDEKQKEFLKGSTALSDRRSLGS

SEQ ID NO: 10636 - protein, 81 aa, Pogona vitticeps
QVAEALEELSVSFSEEEWALLDPDQRALHKEVMEETLTHLVSLGIGMMLESYPCSTLFGEVGTAPAEPDLAGTSCWSSVGC

SEQ ID NO: 10637 - protein, 81 aa, Pogona vitticeps
PVTFEEVAVCFTQEEWALLDPDQRALHREVMEENARIVTSLDNWRKSYLCRNCGGSFMPRLNLARHETTHGKEERNVRENL

SEQ ID NO: 10638 - protein, 81 aa, Columba livia
VTFEDVALYFSPEEWAKLSGCQRQLYREVMLENYQMVASLGWANIKPEIICKMEREETPCMPERPREQQMLQSPVPGGYWG

SEQ ID NO: 10639 - protein, 81 aa, Columba livia
MSVTFEDVALYFSPEEWAKLSGCQRQLYREVMLENYQMVASLGWANVKPEIICRMEQEETLCLPDPRGGQQRHHSVPDAHS

SEQ ID NO: 10640 - protein, 81 aa, Pogona vitticeps
ASEGLVTFEDVAVHFTEEEWLLLDSTQRSLYREVMLNNYEMLSSLVPKPEPISETEEEEGPSWVLDSQEWEGLEKLDTRPG

SEQ ID NO: 10641 - protein, 81 aa, Pogona vitticeps
GNGRTFRNNEMTPSAPPRSLSLCGIKEAAFVKPEQGLVSFEDVSVHFTTEEWALLDQDQKALHKEVMGENCENLAFLGNNP

SEQ ID NO: 10642 - protein, 81 aa, Pogona vitticeps
DEEPVTFEEVAVRFSEGEWGLLDPGQRALYRDVMVENYGNVASLEGAPVLKPDLISWLEEKDERFDEDSEDDRERVPTGEA

SEQ ID NO: 10643 - protein, 81 aa, Pogona vitticeps
MMENYEALLSLGCLPEKPDIIRRIEQQEEVWVGELWRPRPWSKPEVPWPAGDGIRIEDEERGKQIQPGQPRAGRRGPRRKK

SEQ ID NO: 10644 - protein, 81 aa, Pogona vitticeps
KMPVTFVDIAVYFSAEEWENLAEWQKDLYHNLVKENYESLLTLGANVNVSKADPHSRVERRPEPCASEQQATKEQDLAPDP

SEQ ID NO: 10645 - protein, 81 aa, Pogona vitticeps
DQRPVAFKDVAVYFTEGQGALLDPGQKALYKEVMMENYENVASLGFPVPKPNLILCLEQGEDPWLPDPFSFSGTRPGVLRK

SEQ ID NO: 10646 - protein, 81 aa, Pogona vitticeps
PPDQLLVSFEEVAVSFSREEWDRLDPGQRTLYKEVMLENYKNVVSVVPRPVLIFYLEEGDDPFPQDPSVRDGSAGGCSGNT

SEQ ID NO: 10647 - protein, 81 aa, Pogona vitticeps
PDQVTFEEVAVSFMEDKSALLDPCQKPLYQEAMKENVGMAAILGRNGQKNKKEGEKRRTLAEIEEQRTKTEAKNLHKCLEC

SEQ ID NO: 10648 - protein, 81 aa, Pogona vitticeps
PHNQLVSFEEVAMYFTKEEWDLLDPGQRALYKEVMLENYRNILCLGLLKPDLVCQPEVKEEPSDWILEEKKWSKDDEQMGG

SEQ ID NO: 10649 - protein, 81 aa, Columba livia
MLENYQMVASLGWANVKPEIICKMEREETPCVPEPPRKRQRHRTSLPGSVGPRTQRVANGVPEGESQFKCPHLHRLPDFQP

SEQ ID NO: 10650 - protein, 81 aa, Pogona vitticeps
DQLVSFEEVAVYFRKGEWDLLDPSQQDLYKEVMLENYRNVALLGNVMATEGGSGLATGGGGGQDKMSVYLLKQLMSFQEVA

SEQ ID NO: 10651 - protein, 81 aa, Pogona vitticeps
GPMTFEEVAVHFTQEEWVLLEPDQRALHREVMEDNCGIVASLVPDLKHVSEMEPRVDPWILNGNKRSDIGSVTSLVPKLEV

SEQ ID NO: 10652 - protein, 81 aa, Pogona vitticeps
QFHQRVSFKEVAVYFTKREWDLLTPAQKSLYKEVMLENYRIVASLEIAKPDLISWLEKGEDPFVQDPEEERRWEGDDWNSE

SEQ ID NO: 10653 - protein, 81 aa, Pogona vitticeps
QVAEVLQDLMVYFSKEECALLNPGQRALHMEVMEETLVNVVSLGIGMALGTCPPSSLLAGGAETASTQPDLVGTSRWIVVQ

SEQ ID NO: 10654 - protein, 81 aa, Columba livia
LQVPVTFVDIAVYFSAEEWKNLEEWQKELYNNLVKENYESLISLDGAMSRNEAQPRGERGDGPCIPEQRDLEQRELPPDAC

SEQ ID NO: 10655 - protein, 81 aa, Columba livia
GKMSVKFEDVALYFSPEEWAKLSGCQRQLYRGGMLEKYQMVASLGWATEKPEIICKIEREETPCVLDPPGEHQSNQTHVSA

SEQ ID NO: 10656 - protein, 81 aa, Columba livia
PQVPVTFEDVAVQFSAEEWASLDDEQKDLYRTVMEDNYASLVSVYCALSKPELLSRIERGEEPCAPVELDLEGAGVSPEPP

SEQ ID NO: 10657 - protein, 81 aa, Pogona vitticeps
VAFEEVAVFFTQEEWTLLDLDQKALYQEVMEENWKTVLSLEAGRMLATSIPSSVPRDGEKLNQGPVAFKEVAVFFTQKEWT

SEQ ID NO: 10658 - protein, 81 aa, Columba livia
MLENYQMVASLGWATVKPEIICKMEREETACVPKLPGEWQRHQSPVPAVSPGTQKETKHVPEGLPGPTSLLPGMPSPGTRH

SEQ ID NO: 10659 - protein, 81 aa, Meleagris gallopavo
LQEPVSFAEVAVCFSREEWALLDPAQRVLYRDVMLETYQCVASLASLLTPKPVLISLLEGGEEPWIPDVRSPEATPGDLSP

SEQ ID NO: 10660 - protein, 81 aa, Pogona vitticeps
MEDEWLVEDSQQKPVYRQTHRETHESLVALTGPPSSKPNEIFLVEEEEEPCILEPGNRENTRRGNKAGEGLGSEEEELSDE

SEQ ID NO: 10661 - protein, 81 aa, Pogona vitticeps
PVTYEEVAVHFTQEEWALLDPDQRALHQEVMEEIWQMVSSLDKWREKKVCPGYEKTCTHKLEVAGHPRTHRQETCTQEKPY

SEQ ID NO: 10662 - protein, 81 aa, Columba livia
LQMSVTFEDVALYFSPEEWAKLSGCQRQLYREVMLENYQMVASLGWATIKPEIICKIERDETPCVPELPGERPRHQSPVPA

SEQ ID NO: 10663 - protein, 81 aa, Aythya fuligula
AEEPVTFVEVAVYFSREEWELLHPAQQVLYRDVMLETYESITSLGLLPSPKPVVISQLEEGEDPWIPDLHGVEDVTGDLSP

SEQ ID NO: 10664 - protein, 81 aa, Columba livia
GKMSVTFEDVALYFSPEEWAKLSGCQRQLYREVMLENYQMVASLGWATVKPEIICKMEREETPCVLDPPGEQQMHQSPVPA

SEQ ID NO: 10665 - protein, 81 aa, Pogona vitticeps
VTFEEVAVHFTEEEWEWLDPDQKALHREVTEEICWMLYTLDDEQHGENNPGLSVEPFERIDHEAGKQRYGKSRGEKWYRGN

SEQ ID NO: 10666 - protein, 81 aa, Pogona vitticeps
GPLVSFEDLAMYFTEGEWALLTQDQRALYVEVMLENYKNVASLGWVAPKPGIHLLARGKESQPPNPLDLDEDYYFSSSADP

SEQ ID NO: 10667 - protein, 81 aa, Columba livia
PKVQVMFDSGTADVSALEREDLEEWQREPRKNVLRGENEPLVSLDYALSKPDLLSRLPSGETPCDEVTSRGVPAEPSAEYG

SEQ ID NO: 10668 - protein, 81 aa, Columba livia
GKMSVTFEDVALYFSPEEWAKLSGCQRQLYREVMLENYQMVASLGWATVKPEIICKMEREETPCVPELPGEWQRHQSPVPV

SEQ ID NO: 10669 - protein, 81 aa, Pogona vitticeps
MAVSFTEEEWALLDPGQRALLWEVMEENVANVVSLAAGLKKGRFTEEPHQVILEKITKEEEKPQRRKTESKEKWRRSFVSL

SEQ ID NO: 10670 - protein, 81 aa, Pogona vitticeps
APELVTFEDVAVPFSAEEWSLLEGWQKQLHQDVMLQNYTLLLSLGNSLPSAEVSSLIHQLEETTVGQNFSQAGGEEGAHGG

SEQ ID NO: 10671 - protein, 81 aa, Pogona vitticeps
PKVPLLFDDTSCSFSEQEWKSLDEGQRDLYRYIMKSNYKAVVSVDAALSKPDLLSRLEHADVGDAGEGEERGPLRDSTLGS

SEQ ID NO: 10672 - protein, 81 aa, Pogona vitticeps
MLESYGIITSLVAPLIPSLGEMAKPELISLLEKGEDPFIQDSEEERRWEGTCSGDDWDSESCHKALLVCVEIRKHEERNFL

SEQ ID NO: 10673 - protein, 81 aa, Pogona vitticeps
TSQDLVSFDEVAMYFTQREWDRLNLDQRALYKEVMLENFSMVSSLEISKPVLITQLEEGKEPFVGASEEGNLMATQAGSGP

SEQ ID NO: 10674 - protein, 81 aa, Pogona vitticeps
QAPPFSFEEVAVYFTEEEWKLLDAEQRDLYWDVMQENYENVASLAIPIPKPELISRLERGEEPWIPNPQTTEDKKIPVNIY

SEQ ID NO: 10675 - protein, 81 aa, Pogona vitticeps
PKVPLTFGDSSVDFSEREWSSLEEEQKELYKAVMRSNYEMLVSLDDAVSKPKVLSQVERGEDPESLEGREMPVDPSYEESQ

SEQ ID NO: 10676 - protein, 81 aa, Pogona vitticeps
MRENYGASVALGSPVAQPDMVARLEEGGPHPAKDEREAKLREPPDGASAAGPVAQGTEQAAKGEQQHLQPPPPPPPPPGVD

SEQ ID NO: 10677 - protein, 81 aa, Pogona vitticeps
PKVPVTFNDNAVNFSTQEWANLEEWQKELYKNITKGHFEPLISLDAAISRGEVPPQTEPAELPRVADQEFVGEKGFPPEPR

SEQ ID NO: 10678 - protein, 81 aa, Pogona vitticeps
QSPVSFEDVVVYFTGEEWTLLDAGQKLFYREVMLENYGNVATLENEMASLVQSGLSPVPPANQKDIADDLQNPVSLEDVAV

SEQ ID NO: 10679 - protein, 81 aa, Pogona vitticeps
VMTFEDIAVYFTEEEWALLDPGQRALHREVMEENLINLVTLATDRREGRTEEEEGGVSMGTVSDKQWKYYLEHQKSISSRT

SEQ ID NO: 10680 - protein, 81 aa, Pogona vitticeps
EEAQEPVTFEEVAVYFTKEEWDLLDLGQRFLYREVMMENYENVSTLVPKPELLSNMEHGEELWVPELPDFDEAGILAITRP

SEQ ID NO: 10681 - protein, 81 aa, Micrurus surinamensis
GFPIQGPVSFGEVAIHFNSEEWLLLDPSQKALYQEVMLETSRMVASLAFDVQKKENDREPDLVPLQIIKSEIPEETSTNTW

SEQ ID NO: 10682 - protein, 81 aa, Columba livia
MAVTFEDVALYFSPEEWAELAGWQRRLYREVMLDNYELVASLGWAAVKPEIICKLEREEAPCVPDPPGVRRGQQSPGPDVS

SEQ ID NO: 10683 - protein, 81 aa, Micrurus surinamensis
PQELFCRRIPWEDPSQDTSGGGQRMKLSSFYDGDQTTVEPPNQEGLVSFEEVAVYFSEEEWSQLHPDQKALHSEVMIENHR

SEQ ID NO: 10684 - protein, 81 aa, Micrurus surinamensis
EEEWALLNSGQKALCREVMLDGCRNISSLSDGDCNGLENKDTQLGLLKWQKGVSAESHSFSFAIPKILNRDHKPQRSVKHD

SEQ ID NO: 10685 - protein, 81 aa, Micrurus surinamensis
SQELFFKRIQLGPLCQTFDHVEEVALDFTEEEWRLLDSGQKALCWEVMREVFRNMAALGKARICSGLFIEGEQETHLHTIA

SEQ ID NO: 10686 - protein, 81 aa, Pogona vitticeps
KVLLTFQEVTVHFTEEEQALMDPGQKALHREVMKENYGMVLSLHDWKKSDKKNEQRRRKMGEKQKWRKKCFIPHDIGQGTE

SEQ ID NO: 10687 - protein, 81 aa, Pogona vitticeps
QESSVAFEDIAVYFTKSQWTLLEPCEKALYRDVMQENYENVVAIGLSAVKPSLISHLEQEGDPWFPDPLVMEQKEILPGCN

SEQ ID NO: 10688 - protein, 81 aa, Pogona vitticeps
PQDSVTFEEVAVSFSREEWALLTDWQKNLYKDVMRDNYEMLNSLDLAAHKPDIILRIERGQEPCVGRLQRSKARERPNHVF

SEQ ID NO: 10689 - protein, 81 aa, Pogona vitticeps
WPCWLVFFEEVAVSFTRQEWDLLNPGQKALYKEVMLEIHGMITSLAIPEPDLVFSLEEGDDPFVQDPEEQKRLSGTCLGHK

SEQ ID NO: 10690 - protein, 81 aa, Pogona vitticeps
PVTFEEVAVNFTQEEWALLDPDERSLHRDVTAENRQMVASLNCGKSRLAAMGPLEFLATISSCHDHELWEHYVRDQGSYTR

SEQ ID NO: 10691 - protein, 81 aa, Pogona vitticeps
GNLMATQAGSGPSPLYGQVEKAAIKPLRQLVSFEEVAVCFTKGEWDLLEPAQKVLYKEVMLANYGVVASLGEDTFPLIEIN

SEQ ID NO: 10692 - protein, 81 aa, Pogona vitticeps
DQKPVTFEDVAVYFTKSEWTLLDPEQRAMYRDVMLKSYENVASMGFSPSKPALITCLEQGEVLWARIQPEHQKREMLPRPS

SEQ ID NO: 10693 - protein, 81 aa, Pogona vitticeps
VTFEEVAVDFTQEEWALLDPDQRALHKEVMEENWGMVASLAGNERGRKVCVKCGNLFTHNCDLSAEQQTHVAEESLTTERP

SEQ ID NO: 10694 - protein, 81 aa, Pogona vitticeps
MFEDVAVYFTRGEWKALSEWQKDLYRAVMVENYEAVASSGGPSVKPKLICRIERDEDPSVDETPEAPLRKRPQSPWLGDGI

SEQ ID NO: 10695 - protein, 81 aa, Chelonia mydas
AQMLMTFEEVAVYFTQGQGALLDPTQRALYRDVMQENYETVTSLGFPIPKPDLIAQLERGEEPWVPDLQACEEREITRGTC

SEQ ID NO: 10696 - protein, 81 aa, Chelonia mydas
IPKVPVIFDDSAVFSQEEWENLEDWQKELYKNVMKGNYEYMISLDYAISKPDILSRIERGEEPCARGQQESEERETTADPS

SEQ ID NO: 10697 - protein, 81 aa, Chelonia mydas
MLRNYRALVSLGSSGSTPDLIHRIELGEAELWIWDAEGSRESSRCESPSSGHGIPGGTRKWSECGESAAGTQDPTSHRGIH

SEQ ID NO: 10698 - protein, 81 aa, Chelonia mydas
AQMPVTFEEVAVYFTQGQGALLDPAQRALYRDVMQENYETVTSLGFPIPKPELIAQLERGEEPWVPDLQACEEREILRGTR

SEQ ID NO: 10699 - protein, 81 aa, Chelonia mydas
VTFEDVAMYFSPAEWALLGEQQRQLYRHVMWENYQTLVSLDFPDAEETWDWSAIESSLGFFLTQSSSLGAGARNQNRAEGQ

SEQ ID NO: 10700 - protein, 81 aa, Chelonia mydas
QELVTFKEVAVYFTEEQWALLDPHQRALYRDVMQQNYENVTSLEDVSQSPEQREACERQQGNNPGMKLGKSTYQVGGLKDL

SEQ ID NO: 10701 - protein, 81 aa, Chelonia mydas
AQGPVTFEEVAVYFTREEGALLDPPQRALYREVMQENYETVVLLGDGMMSENEEDNPQEKDADQVKPHGTLSGRSKGNICR

SEQ ID NO: 10702 - protein, 81 aa, Chelonia mydas
PKVPVTFDDISVYFNEQQWGNLDEWQKELYKNVMKSNYEMLMSLDYAISKPDILSRIERGEELSVGDQGDAEEREIPTDPS

SEQ ID NO: 10703 - protein, 81 aa, Chelonia mydas
KPHQHRLNGSAIHGVQYIPPLPPVVTESPGDALELLPTKPGRTLGFPVPKPDMISQLERGEEPWVLDLQGSEEGEILSGAC

SEQ ID NO: 10704 - protein, 81 aa, Chelonia mydas
MQENYETVTSLGLPIPKPDLIIRLEAGEEPWVPDLPASKKRKITRDTCTTGDETMSENEDENPLQECPEQVELQGTLLRQG

SEQ ID NO: 10705 - protein, 81 aa, Chelonia mydas
AVELVTFEEVVVYFSEEEWALLDPGQRALYRDVMQENYETVTSLGFPISKPVVISWLERGEEPWVSDIKGYKERESPRDAH

SEQ ID NO: 10706 - protein, 81 aa, Chelonia mydas
MEKWLFLDPRQRALYRDVMQESYETLMSLKYPIPKPDVISRLEQGEEPWVPPDLQGSGGRDLPRDASPGTASETEGEAPQT

SEQ ID NO: 10707 - protein, 81 aa, Chelonia mydas
MPVTFEEVAVYFTEGQGALLDPSQRALYRDVMQENYETVTSLGLHITKPDLIARLEGGEEPWVPDLQASKERKIPRGSRTV

SEQ ID NO: 10708 - protein, 81 aa, Chelonia mydas
MPVTFEEVALYFTQGQGALLDSAQRALYRDVMQENYKTVTSLGFPLPKPDLITRLEQGEEPWVPDLQACEKKEIPRGSHTV

SEQ ID NO: 10709 - protein, 81 aa, Chelonia mydas
MLRNYRTLVSLGYSGSTPDIIHQIELGEPELWTWDAENSRQSSGPESPSSAGLRIPGGTRTQSECGEGAAGKDPTSHRGIR

SEQ ID NO: 10710 - protein, 81 aa, Chelonia mydas
KTAPVTFDDVAVYFSAEEWEELAEWQKELYKDVMRDNYEALISLGHAAAKPDIIQLLEHGEEPCVKGHKDSGNGKAFNFIS

SEQ ID NO: 10711 - protein, 81 aa, Chelonia mydas
VTFDDVAVYFSREEWEMLAEWQKELYQEVMRENYANLISLAGDWPRQRSKKKNEEECAEKLEAPELPTGIGLANGSEKAKI

SEQ ID NO: 10712 - protein, 81 aa, Pogona vitticeps
PVTLEDVAVSFTEEEWTLLDPGQRALLWEVMEENVANMVSLAAGLKKGRFTEEPHQVILEKITKEEEKPQRRKTESKEKGR

SEQ ID NO: 10713 - protein, 81 aa, Pogona vitticeps
EQGPVTFDEVAVNCTEAEWALLDQNQRACHRDVMEETRENVLSLAREVRHSENQEELCWVRLKTVICKESHLQGSRTEENT

SEQ ID NO: 10714 - protein, 81 aa, Pogona vitticeps
VQGPVTFEEVAVYFTQEEWALLDPNQKALHQEVMEENWQMLSSLDLSDSSVDPLQHLSFFLRNNWRKKNLYPKSGKSFTHQ

SEQ ID NO: 10715 - protein, 81 aa, Columba livia
SVTFEDVALYFSPEEWAKLSGCQRQLYREVMLENYQMVASLGEDSLWHCQAGVEPEFTSFIAVSAGTQREAEEVHEEPVAP

SEQ ID NO: 10716 - protein, 81 aa, Pogona vitticeps
GVLVTSEDIVVHFMEEEWALLNEGQRALHRDVMEANVASLISVAMSTREKRSEEEEGAMFFGAVMAKKQKEPLKCSKTVQR

SEQ ID NO: 10717 - protein, 81 aa, Pogona vitticeps
PVAFEEVAVLFTWEEWTLLDPNQRNMHKEVMKENWQTVSSLDNWREKNVSTSEDTFTQKLECARHQRTHTEEESCIRDKSY

SEQ ID NO: 10718 - protein, 81 aa, Columba livia
PKVPVAFNDASFNFEEEDWKSLNEWQKELYRHIMKGNYEAVISMDAAISKPDLLSRIEQGEDPGAEDQDDSEGGESPTEPS

SEQ ID NO: 10719 - protein, 81 aa, Pogona vitticeps
EADLWWIRLGSEGDATSSEGSEMYLQPPSRDSLTREKMGAVQPDQDLMSLDEVAVSFTAEEWALLDPRQKSLYREVMEEIS

SEQ ID NO: 10720 - protein, 81 aa, Pogona vitticeps
DPVAFEEVAVYFSQEEWAELDPNQRALHKEVMKENWQTVSSLKNYCGKSFAYKLELAAHQGTYTEEESYMQEKICESVMCR

SEQ ID NO: 10721 - protein, 81 aa, Pogona vitticeps
MGSITFEDVTVYFTQEEWALLDPGQKALHQEVMEENWQTVSSLADIWREKNVCPKCGKSSRHKFKLPEHQRIHTEDKWCIQ

SEQ ID NO: 10722 - protein, 81 aa, Pogona vitticeps
FQGPVTFDEVAVNFTEAEWALLDQNQRACHRDVMEETHENVVSLAREGRHSENQEELCWIGLEIFLFKESHLQGRRSEANT

SEQ ID NO: 10723 - protein, 81 aa, Pogona vitticeps
QTVTSFKEVAVYFTTEEWDHLDPGQRVLYKDVMLENYRNVTFLGKIMATQEGSGSSPLGNGRERSALQLSKLVSFQEVAIY

SEQ ID NO: 10724 - protein, 81 aa, Pogona vitticeps
VAFEDVAVYFTEEEWALLDRNQKALYWEVMEENLVTVFSLGGEQESEKGGEASKAALLERVTWEEKEEQQTTSETKEKNEG

SEQ ID NO: 10725 - protein, 81 aa, Pogona vitticeps
MEDEWLVEDSQQKPVYRQTHRETHESLVALRPPSSKPNEIFLVEEEEEPCILEPGNRENTRRGNKAGEGLGSEEEELSDEE

SEQ ID NO: 10726 - protein, 81 aa, Pogona vitticeps
MQENYDNMASLGFPLGKPDLISWLEQDPWFPDQLALEEVGTTSQYSPPCTMECPFPPRSKKRESMATVEEAQEPVTFEEVA

SEQ ID NO: 10727 - protein, 81 aa, Columba livia
WQEPVTFEDVAVYLSHAEWDAMAPEQRELYCSVMLDNYQLLASLGYPGPKPDIVYRLERGEEPWGCAPQSPLSWDGPRSPS

SEQ ID NO: 10728 - protein, 81 aa, Pogona vitticeps
TQEPVAFEEVAVYFRAGEWALLGPDQRALYREVMLENFGHMATLGLFVSKPNLISWVEGGEESFFLDPEGIEKEKNTDVAA

SEQ ID NO: 10729 - protein, 81 aa, Pogona vitticeps
PVAFEEVAVLFTWEEWTLLDPNQRNMHKEVMKENWQTVSSLADNWREKNVSTSEDTFTQKLECARHQRTHTEEESCIRDKS

SEQ ID NO: 10730 - protein, 81 aa, Pogona vitticeps
IHCPSSLLPGGMETRSMKPEQVAEALEELAVDFSEEEWALLDPGQRALHTEVMKEILTHAASLSKRNALSSIGSALVNRFL

SEQ ID NO: 10731 - protein, 81 aa, Pogona vitticeps
PRFWGPATFEDSTAAAAASPEEWEKELYKNVMKGKQESLISLDYALSKPDVLSRIEGGEDPWDHEDDDNNNKGQPDLEGRE

SEQ ID NO: 10732 - protein, 81 aa, Pogona vitticeps
LQLVSFEEVAVYFTKGEWDLLDPGQRYLYKEVTLENYSNVILLGSAMATEGGSRLSPEGNGQERMAEHLPQLMAFKEVAVH

SEQ ID NO: 10733 - protein, 81 aa, Pogona vitticeps
DPVTFEDVVVYFTKEEWALLNSGQRALHRQVMEENFANVTSLSPDGRENRTEEELHKVCFGGFIDTKGKRYLEYGKNANGK

SEQ ID NO: 10734 - protein, 81 aa, Pogona vitticeps
YQVTFEEVAVYFSEEEWALLDADQRALHQEVMEQNYGMVASLGGGHWQREDEGESNGLALERARRPEWEEQSPRNQAKQNF

SEQ ID NO: 10735 - protein, 81 aa, Pogona vitticeps
MQENYETLISLAEEMAISLPRITTLAESHRRGLASAGFPVSKPDLLSWMDRGEDPWVPDLQESEGSLLPTDTSSPGEELRR

SEQ ID NO: 10736 - protein, 81 aa, Pogona vitticeps
MMEQYVLLDPRQRALYQDVMQESYETLMALEFPLSKPDLLSHLEQRDEATAFDLQHPRGSPPAVPESKEEVNPVQEDPTGP

SEQ ID NO: 10737 - protein, 81 aa, Pogona vitticeps
DQLVSFEEVAVYFRKGEWDLLDPSQQDLYKEVMLENYRNVALLGNVMATEGGSGLATGGGGGQDKMSVYLLKLMSFQEVAV

SEQ ID NO: 10738 - protein, 81 aa, Columba livia
GKMSVTFEDVALYFSPEEWAKLSGCQRQLYREVMLENYQMVASLGWANIKPEIICKMEREETLCVPAPPREWQRDQSPVPA

SEQ ID NO: 10739 - protein, 81 aa, Micrurus surinamensis
ETEVETPVQEGLVSFEDVAVYFSEEEWTELDPDQKALHWEVMLENYRNVASLGDDEQDHKEPRESFQGFRHGDVMEKRAIQ

SEQ ID NO: 10740 - protein, 81 aa, Aythya fuligula
MEPWVMLDPRQKALYRDVMQESYETLMSLAQGLVSEKAAEEGAAQQIPEELEARPSRSPERAKTLGSNRRKTKRPDKAVPH

SEQ ID NO: 10741 - protein, 81 aa, Columba livia
MLENYQMVASLGWANVKPEIICKMEREETPCVPDGPGEQQRHQSPVPAVSPGMQRETERVPEGLPEPTALLPGMPNPDVRC

SEQ ID NO: 10742 - protein, 81 aa, Platysternon megacephalum
VPVTFEDVAVRFSAEEWEILEGWQKELHKEVMEENYQLLISLGQPVPTLALLPLTAEWEAAGGQIRNVSGERELASGSGSS

SEQ ID NO: 10743 - protein, 81 aa, Platysternon megacephalum
MEQYVLLDPRQRALYRDVMQESYETLMALEFPLSKPDLLSRLDRGDEPTALDLHMPRGGRAGESLSRKERIPATSRMASHQ

SEQ ID NO: 10744 - protein, 81 aa, Chelonia mydas
AQVLVTFEDVAVYFSREQWGLLDDMQRALYRDVMQENYQTLVSLPGSSIPKPDVISQMERGEEPWVPDLQSSQEREIPRGA

SEQ ID NO: 10745 - protein, 81 aa, Chelonia mydas
MQPMGRMFETPDIHWFPVSKPDVISRLEQGEEPWVPDLQGSEEKELQKGAQTGDGMVSENKKYSQQEDAEQVEPHGTLSGR

SEQ ID NO: 10746 - protein, 81 aa, Chelonia mydas
MYFAEIQWALLDPAPRPVYRDMVPENYGTLLSRDSSMINPALQQGGPETTQPHGTLPGMRSEGNVYQAPGHAATCQSQARP

SEQ ID NO: 10747 - protein, 81 aa, Ficedula albicollis
EAPAVALENDATGFSTQEWENLEEWQRELCGKVLTGKREAPVLLDDVITEPALLSRLQGGEAPCSEEEAAPREMPAEPGAA

SEQ ID NO: 10748 - protein, 81 aa, Platysternon megacephalum
FLMPVTFEEVAVYFSEDEWALLDEKQKELYRDVMQENYETLISLGFLIAKPDVLSQMERGEEMWIPDLQGSEEREIPRGTT

SEQ ID NO: 10749 - protein, 81 aa, Terrapene carolina
AEPVTFEEVAVYFTAEEWALLDLGQRALYRDVMQENYEIMTSLGKDSCPLGYEKHLGQILCRGLHWSPRIQADQTLSLGQG

SEQ ID NO: 10750 - protein, 81 aa, Geotrypetes seraphini
DQVPLTFDDVALYFSEEEWHCLEERQKILYRNVMMENFETLTSLGFSTTIPDIILRIERGEDPYVCDPQDANERGITWRHQ

SEQ ID NO: 10751 - protein, 81 aa, Geotrypetes seraphini
AQMQLKFEDVAVSFSQEEWEYLDEGQKELYREVMKENYETLISLGSVRISPDLLSWIKQDGEPNIQDPQESGEREVRRSDT

SEQ ID NO: 10752 - protein, 81 aa, Geotrypetes seraphini
MQVEFEDIAVSFSQEEWEYLDEGQKELYREVMKENYETLISLATGSPTFTPKIISYIERGEEPYIRGEPESEERESGKGSC

SEQ ID NO: 10753 - protein, 81 aa, Geotrypetes seraphini
AQVPVTFEDITIYFCQEEWKYLEEWQKELYKDVVKENYQTLISLGSLTVTPDIISYVEQGEEPYIRHEPGSKERETGRNSS

SEQ ID NO: 10754 - protein, 81 aa, Geotrypetes seraphini
MMENFETLTSLGFSTTIPDIILRIERGEDPYVCDPQDANERGITWRHQRNQPRAGQNKTDFSKAGVVSQHVRVPSGHRLHP

SEQ ID NO: 10755 - protein, 81 aa, Geotrypetes seraphini
MQENYDSLESLGFAMKKPEVVSRIEQGEEPWVMENAGSSISGTNTILTILERLEKRMARIEHHQILFLTHLFKHLKPAATL

SEQ ID NO: 10756 - protein, 81 aa, Geotrypetes seraphini
DQELVTFKNVAAYFLEAEWDILGEWQKELYKKVIKEIHGILTSQGYSIVNPDSLFKIKKEDEKYFIQHFEQEGKENLNDPS

SEQ ID NO: 10757 - protein, 81 aa, Geotrypetes seraphini
MASVTFSDVAAYFWEVEWDILGEWQKELYKKVVKEIHRFLIIQGYSILNPDVIFKIKKEDEKYFTQYSVLEGKENMNDPTM

SEQ ID NO: 10758 - protein, 81 aa, Geotrypetes seraphini
QTSVIFKDVAAYFLEAEWDILGEWQKELYKKVIKEIHDILLSRGYSIVNPDVMFKIKKEDEKYFPWQFEWEGKENSNKPTK

SEQ ID NO: 10759 - protein, 81 aa, Geotrypetes seraphini
GRAKVVFSDVAIYFSEGEWQLLEDWQKELYTNVMKEIHGALVSLGYTIVNSDTVFKIKPKEEPSLRNHIDTKEGGGGGKAS

SEQ ID NO: 10760 - protein, 81 aa, Geotrypetes seraphini
TVVSVTFNDVAICFLEEDWKVLEEWQKESYQKVMEEIHAALFSLGHRITNPSVLVKIIQEDPCKVAGASNGDLVYNPDVSL

SEQ ID NO: 10761 - protein, 81 aa, Terrapene carolina
FQMLVTFEEVAVYFTQGQGALLDPAQRALYRDVMQENYETVTSLGFPIPKPELIARLERGEEPWVPDLQPCKERRLPRCTR

SEQ ID NO: 10762 - protein, 81 aa, Geotrypetes seraphini
DQALVTFKDVAAYFWEVEWNILGELQKELYKKVIKEVHGILLSRGYSIVNPDVIFKIKKEDEKYFTQHFEWEGKENPQDSM

SEQ ID NO: 10763 - protein, 81 aa, Terrapene carolina
MRSVWLCVFPAEIGIVKSLLSRVSCTFEPLGSPGCPVAKPDVISQLERGEEPWVPDLQGSEEGEIPRGACAGEGSLNQFKN

SEQ ID NO: 10764 - protein, 81 aa, Terrapene carolina
FQMPVTFEEVAVYFTQGQGALLDPAQRALYRDVMQENYEMVTSLGFPIPKPELIARLERGEEPWVPDLQACKERRLPRCTR

SEQ ID NO: 10765 - protein, 81 aa, Lithobates catesbeianus
IRCQDVTVYFSMEEWKYIEGHKDLYKDIMMENPWTLKSPDAIDLTHDVTYHYKGDNLIVIKVEDDEESYVRGDEPCDEEEE

SEQ ID NO: 10766 - protein, 81 aa, Notechis scutatus
QWSDPFEAVTVDFTEEEWALLDSDQRALCAEVTLEAFRNIIALGDAIEKEKQEWLMSLPTANYEGEVTFDQTNPKKQESSH

SEQ ID NO: 10767 - protein, 81 aa, Xenopus tropicalis
HRESVSFTDVAATFSEGEWNILSDWQRELYGTVMRQIHSVLMDLGYHIHNSEILFRITKNEEPGRYHRYVAARSKEGHAPD

SEQ ID NO: 10768 - protein, 81 aa, Geotrypetes seraphini
VTFEDITVAFSQEEWEYLDEGQKELHREVMKENYEILKSLEKDDPKNNPWKLSEKPEGVKMLSEGEKENWGEKEKNQNPKY

SEQ ID NO: 10769 - protein, 81 aa, Lithobates catesbeianus
IRCQDVTVYLSMEEWEYLEGHKDLYKDVMMENHQILNYVKLEKRKILLSDIMLNLTLEIIYLLTGENYEVVKLVSGEQITT

SEQ ID NO: 10770 - protein, 81 aa, Meleagris gallopavo
MEPYVLLDPRQRALYRDVMQESYETLMSLEFPISKHNLLSHRDEPTALDLHVPKETLLGDNGAAQEPPQEDPKATKPTEEG

SEQ ID NO: 10771 - protein, 81 aa, Terrapene carolina
MSVTFEDVAMYFSPAEWALLGEEQRQLYRHVMWENYQTLVSLGIQISKPVVISSIERGEELWAQSPTEDEDEDILSGTSPG

SEQ ID NO: 10772 - protein, 81 aa, Geotrypetes seraphini
GEVSVTFSDVVACFTEQEWELLKERQKEVYRAVMMEVHEALISLGYEIANRDVLFRVQEEKSACRRDGFEGKNSLCTPPTG

SEQ ID NO: 10773 - protein, 81 aa, Geotrypetes seraphini
MAAAIPEVEWNLLEDWQKQLYKDVMKESYKTILSLGYSVAKQNIMTEPTAEEKACNSGVRNPESGNIAGSSSAVDQCSRKK

SEQ ID NO: 10774 - protein, 81 aa, Geotrypetes seraphini
MKENYEALSSLGFPIATPDIITLIEHGKEPYIKNEPGLEERYQGESNCLGSDPERRCWYFTENLEADRILSGEQEATLCSG

SEQ ID NO: 10775 - protein, 81 aa, Geotrypetes seraphini
QMWVTFEDVAVSFSQEEWEYLDDGQKELYQEVMKENYETVMSLAGEEFSQEKEKEENAEHSLKTEVHEMNLKAVNLFKCSL

SEQ ID NO: 10776 - protein, 81 aa, Geotrypetes seraphini
DQASVKFKDVAAYFLEKEWDILGEWQKEVYMKVIKEIHDILILRGYSILNPDIIFKIKKEDEKYFAQHCELEGKENLNNPT

SEQ ID NO: 10777 - protein, 81 aa, Geotrypetes seraphini
AQIWVTFDDIAVSFSQEEWEYLDEGQKELYREVMKENYETLISLGSPAVAPEIISYIERGEEPYVRDESRLGERATGESSC

SEQ ID NO: 10778 - protein, 81 aa, Geotrypetes seraphini
MVTFEDIAVSFSEEEWAYLDEEQKKLYREVMEENYQTLVSLAEQELKQERESEKNQGKYRLEMEQIQRQSGNVCANISQRT

SEQ ID NO: 10779 - protein, 81 aa, Xenopus laevis
VRALVTFHDVAACFSAEDWRQLEDWQKELYKNVMREIHSALVAMGYTIQNPEQLLRVHELKETSQDTGKGKERNNLLTAGA

SEQ ID NO: 10780 - protein, 81 aa, Geotrypetes seraphini
AQMQVKFEDVAVSFSQEEWEYLDEGQKELYREVMKENYETLISLGSVRISPDLLSWIKQDGETHIQDPQESGERDVRHSDM

SEQ ID NO: 10781 - protein, 81 aa, Geotrypetes seraphini
MQVSFEDIAVSFSQEEWEYLEEEQRELYREVMKENYQTLISLGTGCPNLTPEIISRIERGEEPYIRGEPGSEERETGKSNC

SEQ ID NO: 10782 - protein, 81 aa, Geotrypetes seraphini
MKQIHRALFSLGYSIANPDVLFRIKQDDEPYFRDPFDSEGSNNIGGKDAGYPFIRPDVLFRIKQEEMEEAYYWDPQEPEGG

SEQ ID NO: 10783 - protein, 81 aa, Geotrypetes seraphini
MKENYETLLLLGCPGLKPVIISSIEQGEEPCVRKLQERAELYPTAGDESFKGEDTKHLDHLEKKSDEEGDVYYTIEHGEHS

SEQ ID NO: 10784 - protein, 81 aa, Geotrypetes seraphini
EQASVTFNDVAAYFWEVEWDVLGEWQKELYKKVIKEIHSLLMSRGYSIVNPDVIFKIKKEDEKYFTQHCEWERKEKANDPS

SEQ ID NO: 10785 - protein, 81 aa, Geotrypetes seraphini
HQASVTFSDVAVYFSEEEWQLLEEWQKELYRNVMMEIHGALISLGYGILNPDVLFRFKKEEDPYYRSQQKSKGKERVVDLN

SEQ ID NO: 10786 - protein, 81 aa, Geotrypetes seraphini
MRVTFEDITVSFSQEEWGYLDEGQKELYREVMKENYETLISLGYEKVNPDILLRIKQEEDHYVLDSQESGATRSYSDKEVV

SEQ ID NO: 10787 - protein, 81 aa, Geotrypetes seraphini
DLVPITFTDVAAYFWEAEWDVLEERQRELYKKVIEEIHEILMSRGYSIVNPDVLFRIKQQDEKYFSQHHDWKEKENINGPA

SEQ ID NO: 10788 - protein, 81 aa, Alligator sinensis
TELREAFEDVAVYFTREEWELLEDAQKGLYRDQMLRNCQALVSLGYQGPTPDLILCIQQGQKELWVSDEEGHQDISRSEDL

SEQ ID NO: 10789 - protein, 81 aa, Xenopus tropicalis
FQAPVKFEEIAVYFSEEEWGCLAEWQKLLYANVMLDNYETLCYLGFIHEIPDIITKIWQGRDLYELPLNTSHGSIRIKEEL

SEQ ID NO: 10790 - protein, 81 aa, Notechis scutatus
MENYELVTSLGYPVLKPDILSRIERVGEPCVGDQLDSTRGIPTDPCPGYRFFKPESLSWIERWEELGVTDRQKLEEGKLCA

SEQ ID NO: 10791 - protein, 81 aa, Geotrypetes seraphini
DQVSVTFSDVAAYFWEMEWDILGEQQKELYEKVIKEIHGILISQGYSIFNPDTIFKIRKEDGKYFTQNCEWKGEENVNESP

SEQ ID NO: 10792 - protein, 81 aa, Microcaecilia unicolor
QQMRVTFEDIAVSFSQEEWEYLDEEQKELYREVMKENYQTLISLGYERINPDILSRIKQEEDPFVRELQESEEKEDCLSYT

SEQ ID NO: 10793 - protein, 81 aa, Pipra filicauda
MEPWAPLDPRQKELYRDVMHESYETLLSLAQGLLSEKAAVEDAGAAEPAEGPGAVSEREKPLGSHRRKAKRPDRAVPPGTP

SEQ ID NO: 10794 - protein, 81 aa, Pogona vitticeps
DQGPVTFEEVAVYFTWEEWTLLDPDQRALHREVMEENWQTVSSLKNIWREKSICPQCGKSFTHKVELDGHQRAHTEEESRI

SEQ ID NO: 10795 - protein, 81 aa, Pogona vitticeps
MQENYENVVAIGLSAVKPSLISHLEQEGDPWFPDPLVMEQKEILPGCNSEFPEVIIKLEQEEQPWVLNSQTFPIIDSGYAD

SEQ ID NO: 10796 - protein, 81 aa, Geotrypetes seraphini
MLAEWQKELYKETMKENYETLTSLGSSPEKPSLISKIEREEDPCIRNQQDSQDRRRPRSCWRGSPVEKPELTVRIKQETDS

SEQ ID NO: 10797 - protein, 81 aa, Geotrypetes seraphini
MRVTFEDIFISFSQEEWKYLKEGQKQLYREVMEENYETLISLDHQITQERKREKKQGEDPGEIEQVQRQSGNICENISQGI

SEQ ID NO: 10798 - protein, 81 aa, Pantherophis guttatus
LQDLVTFEEVAIYFSAKEWETLTDGQKSLYLDVMKDNYEALVSLGLAAQPPSVLLQIEGWEKPCAGRAQFPKSRGESKDNF

SEQ ID NO: 10799 - protein, 81 aa, Terrapene carolina
MRSVWLCVFPAEIGIVKSLLSRVSCTFEPLGSPGCPVAKPDVISQLERGEEPWAPDLQGSEEREIPRGACAGEGSLNQFKN

SEQ ID NO: 10800 - protein, 81 aa, Alligator sinensis
MQEKYETMNSLAGFPLSKPEVISQLEQDGEPSIKDLQGFPGKEIQRNINAGKGTVTVSKDDSPYQEGPEQVHLNRVVPGSP

SEQ ID NO: 10801 - protein, 81 aa, Microcaecilia unicolor
QVPVTFEDIVIYFSQEEWEDLEERQKELYKDVMKENYETLSSLGTGSLTVTPDIISHIERGEEPYIRDGPGSDERETGKSG

SEQ ID NO: 10802 - protein, 81 aa, Microcaecilia unicolor
QMRVTFEDIAVSFSQEEWRYLDEGQKELYREVMEENYETLLFLETNHQFIDPDVLSKIKQHSRKPGKREVGGSYSDNEAKE

SEQ ID NO: 10803 - protein, 81 aa, Micrurus lemniscatus
DADQKALHREVMLENSRNLSSLGFNGQENKNCKQECQAIHPKEGKMNFADQLQPKSNETKQSQIGIKKDFPLVIWLSNHTN

SEQ ID NO: 10804 - protein, 81 aa, Micrurus spixii
CQDSDLFEKVAVDFTEEEWALLDSNQKALCREVMLEVAMNMAALGDGEGLENEKQRSLFKIQSAVSSKGQNDLRTRHNLTH

SEQ ID NO: 10805 - protein, 81 aa, Micrurus spixii
QEGLVFFEDVAVYFSEEEWTELDPDQKALHREVMLENYRNVASLGDDEQDHKEPRESFQGFRHGDVMEKRAIQTKFQRQKR

SEQ ID NO: 10806 - protein, 81 aa, Micrurus spixii
IPVSFEDVIIFFSVEEWALLDFDQKSLYREVMLENAKNVESMGDRGEPEYYKEPGVSSLEKTETTKGIFQNQKKPNVTEEH

SEQ ID NO: 10807 - protein, 81 aa, Pantherophis guttatus
GSVTFEEVAVYFTEEEWALLDPSQRALHEEVMLENSRNVAALAYGQAHENNKEPSLALFQGIQSENGMVGNRGAAPKSAKS

SEQ ID NO: 10808 - protein, 81 aa, Pantherophis guttatus
LVSFEEVAVDFSEEEWSLLDSDQKALHSEVMLENYRNVVSLSNNGQENQHFCELFQVINAKDGTEKFGIRMELETHDRNQS

SEQ ID NO: 10809 - protein, 81 aa, Patagioenas fasciata
QDAVTFKDVAIYFSPEEWVRLSAGQRELYQEVMLDNYELVTSLDRECKLLYKMDPEEEPCEGVPCRGVDSGALDNSSTSAC

SEQ ID NO: 10810 - protein, 81 aa, Micrurus spixii
PKVPMTFEDNAVYFSEQEWGNLEEWQKELYKNVMKSNYESLVSLDYAIAKPDLLSRIEQGERPCAEEEEATMTDRVIPSEP

SEQ ID NO: 10811 - protein, 81 aa, Micrurus spixii
DVVCFEEVAVYFSEEEWSQLDADQKELYREVMVENSRNLLSLGFNGQEKKNCKEECQAIHSKGGKRKFVDQMQLKNDETKQ

SEQ ID NO: 10812 - protein, 81 aa, Micrurus lemniscatus
PKVPLNFSDTSVHFNEQEWKNLEEWQRELYRTIMRSNYDMLVSLDHAISKPDILSQMDQGEEVRMEESEVLENREIPKDPS

SEQ ID NO: 10813 - protein, 81 aa, Micrurus lemniscatus
QGSVSFEDVAVYFTEEEWALLDSSQRALHREVMQENSRNLAALGYGQEHENYQEYNFTLLQSEEKMLGIQRLLQKSMKSCL

SEQ ID NO: 10814 - protein, 81 aa, Aquila chrysaetos
AQEPVTFEEVAVYFTKEQWALLDPVQRTLYLDVMLENYETVMSLGLPTARLDLLTQMQEGGERWGPDLQEMEKKEALSSRR

SEQ ID NO: 10815 - protein, 81 aa, Patagioenas fasciata
PKVPITFDDISVYFNEQEWERLDRWQKDLYRAVMRGNYETLISLDYAVSKPDILARMERDEELFVRDGREPPLTGAADGLE

SEQ ID NO: 10816 - protein, 81 aa, Patagioenas fasciata
WQEPVTFEDVAVYLSHAEWDAMAEEQRELYRSVMLDNYQLLTSLGYPGPKPDIVYRLERGEEPWGCAPQSPLSWDGPRSPS

SEQ ID NO: 10817 - protein, 81 aa, Micrurus spixii
AQRVVELPNQSLKIFFTYGNQNWIQYSKYGLNKENLVSFEEVTVHFSEEEWSQLDSDQKDLYSEVMLENHRNVVSLGKSFL

SEQ ID NO: 10818 - protein, 81 aa, Micrurus spixii
QDLVSFEDVAVFFSMEEWALLDSEQKALYREVMLENKRNMASLDPLMAFSSSPGSSVLCNGGSTAAELPTQDLVSFEDVAV

SEQ ID NO: 10819 - protein, 81 aa, Micrurus lemniscatus
RRIPWEDQSQDTSGEKQRMKLSSFYDGDQTAVEPPNQEGLVSFEEVAVYFSEEEWSQLHPDQKALHSEIMLENHRNVVSLG

SEQ ID NO: 10820 - protein, 81 aa, Patagioenas fasciata
PKVPVAFNDASFNFEEEDWKSLNEWQKELYRHIMKGNYEAVISMDAAISKPDLLSRIEQGEDPNVEDQDDSEGGETPTEPS

SEQ ID NO: 10821 - protein, 81 aa, Patagioenas fasciata
PKVPVTFDDVSVYFNAKEWEKLEEWQKELYKNVMKGNYESLISLDYAISKPGVLSQVEQGEEPRVRTEQDLEESEIMTDAT

SEQ ID NO: 10822 - protein, 81 aa, Patagioenas fasciata
MSVTFDDVALYFSPEEWAKLSGCQRQLYREVMLENYEMVASLAVGPLVQREPEVVLVGLPAPTTPLPGMEHGDSVCDQPGG

SEQ ID NO: 10823 - protein, 81 aa, Micrurus spixii
QDLVSFEDVAVFFSMEEWALLDSEEKALYWEVMLENKRNMASLDPLMAFSSSPGSSVLCNGGSTAAELPTQDLVSFEDVAV

SEQ ID NO: 10824 - protein, 81 aa, Micrurus spixii
FEEVAVYFSEEEWSQLDADQKELYREVTVENSRNLFSMGFNGQANKNCKEEPQAIHPKGGKRKFVHQKQPKNDECGKIFCS

SEQ ID NO: 10825 - protein, 81 aa, Micrurus spixii
FFSVEEWALLDSEQKALYREVMLENKRNVACLGQDTVLFHQLFLRLEVSSQGKQPSSTQAQNGGDGWEMEDSGQEAAAPLH

SEQ ID NO: 10826 - protein, 81 aa, Micrurus lemniscatus
VSFEDVAVYFSKEEWSQLNADQKALHGEVMLENSRNLFSLGFNEQENKNCNEECQAIHLKKEKGKFAGQMQSNSDETKQSQ

SEQ ID NO: 10827 - protein, 81 aa, Micrurus lemniscatus
VQDFVTFEDVAVYFSADEWSQLDPDQKALHKEVMLENYRNVASLVALQRMKKEQIPSVRISEKPRSESVVSELAFDNMKQS

SEQ ID NO: 10828 - protein, 81 aa, Micrurus spixii
QNLVSFEDVAVFFSMEEWALLDSEQKALYRKVMLESKRNLAFLRPLMAFSSSPGTSVLCSGRSTAAELPTQIFNIMSKKRR

SEQ ID NO: 10829 - protein, 81 aa, Micrurus spixii
DDPYQDTTRGKNSRMLTVRDGGAETMVETPIQEGLVSFEEVAVYFSEEEWSELDPDQKALHWEVMLENHRNVASLGDNGQD

SEQ ID NO: 10830 - protein, 81 aa, Anolis carolinensis
MAKTVSAQIEQDLLASDQGSLYREVMQESYNTIFMASPLQTSELLAHLERRQESWDPDLQSSESATAAAEADAAATTTEAT

SEQ ID NO: 10831 - protein, 81 aa, Anolis carolinensis
VQALMGFEEVAVSFSEEEWALLDPDQRALHQDVMKEQHRGTISLRFIVSNSELVKGITQVPNHKKDTRYIHEHTIDKQIHT

SEQ ID NO: 10832 - protein, 81 aa, Gallus gallus
PKVPVTFVDIAVYFSAEEWKNLEEWQKELYNNLVKENYESLISLDAALSRSDAQPRLERGDVPCVPDQQDLEQREMPPDAC

SEQ ID NO: 10833 - protein, 81 aa, Anolis carolinensis
PFSQVSFEDVVVYFSEEEWRLLDEEQIALYKEIMMETYKNVAFLKATPVAPDTHTHTHTHTHTNNLWRKKERKKNEPVSRD

SEQ ID NO: 10834 - protein, 81 aa, Anolis carolinensis
FLQVTFEEVAVFFSEEEWALLDPGQWALHREVMEENLGLVSSLGEILLRETQLEIPNNCEDDIMCELLLRFPPTRQRDFWG

SEQ ID NO: 10835 - protein, 81 aa, Anolis carolinensis
DQSLFIIDEVAVSFSPEEWALLEPDQRALHKQIMAEIHEIMAFLAMVEVECDLLYAAENWRKTYACAKYGMCSRQILDLSS

SEQ ID NO: 10836 - protein, 81 aa, Gallus gallus
MEPYVLLDPRQRALYRDVMQESYQTLISHLERHRRLHRGEKPYWCGLCGKGFAWSSHHDRHRLTHTGEKPFSCAQCGKGFG

SEQ ID NO: 10837 - protein, 81 aa, Anolis carolinensis
NQCLVMFEEVAVNFSPEEWALLDSDQRALHREVMEENHEIVTSLGGHERSLPQDGGNWKKMDLDDKFDLARHQQTHTEENL

SEQ ID NO: 10838 - protein, 81 aa, Anolis carolinensis
RQGPIAFEEVAVHFSPEEWVLLTPDQKGLHVEIMEEIHGIVDSLGKTPSSRGISNRRRQKKKPGWAEQQIGSGAYHTHPSL

SEQ ID NO: 10839 - protein, 81 aa, Gallus gallus
CQEPVSFAEVAVYFSREEWALLDPAQRALYRDVMLETYQCVAWLASLPAPKPGLISLLEGGEDPWIPGVRSPEAMPGDLSP

SEQ ID NO: 10840 - protein, 81 aa, Gallus gallus
QVPASGEDDAACLPEQEWGGVDSRQQELYRMAVKGSYEAVVSLGPGDTNSKPALLLSTEDGEDSASRTHGLLEEGAVLGHS

SEQ ID NO: 10841 - protein, 81 aa, Anolis carolinensis
MQVAFEEVVVFFSEQEWALLNLNRRALYWDVMQENYENVISLGFPVTRPSTTTDLEQDEELWGLQFQGHQEQGIFTDPFGA

SEQ ID NO: 10842 - protein, 81 aa, Anolis carolinensis
VTFEDVAMYFSEDQWTLLDPDKRTLYKEVMMENYANVSALEGILLPKPELISWLEQRKEPWVQDLQELNEIENVSTCSVLI

SEQ ID NO: 10843 - protein, 81 aa, Anolis carolinensis
YGLIAFEDVSVHFSLEEWVLLNPDQIVLHLQIILLLCHHNCSLFIYSHYLVSSQFSQLMPYNPEYQGLENPTISVQSWKWN

SEQ ID NO: 10844 - protein, 81 aa, Gallus gallus
KPSGGHPPGQRPSPAGRPSPTEPGTPLPSRFAEVAVYFSREEWALLDPAQRALYRDVMLETYQCVAWLGEGFAAFPAFPPR

SEQ ID NO: 10845 - protein, 81 aa, Anolis carolinensis
GPIALEDVAVDFSLEEWVLLNPDQKALHKQIMEEIFNNIIYSALSPLRGEKGGIEIEDKDEIMGSWMNEDDQYEITDEEIV

SEQ ID NO: 10846 - protein, 81 aa, Anolis carolinensis
QVTFEEVAVDFTEEEWALLDPGQRALQMEVMEENFRLLFSLGKSTSFLFLMTDASETRDIHNLTDHQSISNEKTLVPFPIW

SEQ ID NO: 10847 - protein, 81 aa, Anolis carolinensis
RNVMFEDVAVHFSEAEWALLNTDQRSLHREVMEENYRMVSSLGDDGQGSENGGAPNKMWLKTGRRKKEAERSPRIEVEGYN

SEQ ID NO: 10848 - protein, 81 aa, Gallus gallus
STYLRSLSFAEVAMYCSREEGALLDAAQQTLYQDVTVETYGSVASLAPKPMVISVLEGEEGPSIPDVHSLKDTAGDLSPAG

SEQ ID NO: 10849 - protein, 81 aa, Anolis carolinensis
HFVQEPVTFEDVAVYFTKEEWNLLDPKQMALYREVMMENYENVSSLVPKPELISQMEQKREPWVPDAQDGGEVENSDIRSG

SEQ ID NO: 10850 - protein, 81 aa, Anolis carolinensis
PQEPLTFEDVAIAFAPKEWAQLVGWQKALYHEVMRDNYETLRSLELVEHKPEILLRMERGEAPWAGGENPAGLPCHAGDQK

SEQ ID NO: 10851 - protein, 81 aa, Anolis carolinensis
LLFQVTFEDVSVYFSEEEWALLDLDQQALHWVVMGENYKTLASFGFCFLMPSYCFSFLQGVAEKESENVGAPCKVWLETNS

SEQ ID NO: 10852 - protein, 81 aa, Thamnophis sirtalis
QAQPISFEEVAVCFSKGEWSLLGPSQRVLYKEVMQENYENVTSLVISLTGLGPNSWMEEEDEAILGLRSQVSEKGNNQVVS

SEQ ID NO: 10853 - protein, 81 aa, Thamnophis sirtalis
NFWILRFPPGTKGEATKVPLLFDDVACNFLEQEWSGLNESEKVLYRHIMMHNYQVVVSVGKSGLASGLGPQRSAAGISETN

SEQ ID NO: 10854 - protein, 81 aa, Thamnophis sirtalis
MYFAEIQWALLDPCQRPVYRDIVQDNFGTLLSLDGGTMNTNSQPGGPEGMQKQVQGRPESSAYGGQPSAGQPSEEAGKGWV

SEQ ID NO: 10855 - protein, 81 aa, Anolis carolinensis
MAVSFSEEWALLDPDQRAFYQQVMKENVETVSSLTTDREGESSQYQDCGEKKELGLSGQQATYAKRKPFKCLVCGKCFCNK

SEQ ID NO: 10856 - protein, 81 aa, Anolis carolinensis
AQNPVTFEDVAVYFTDEEWALLDPSQKTLYRNAMFDNYETVTSLERLLSFKPVLISWLEEDRDKEKLIQSSAEKERFTGDG

SEQ ID NO: 10857 - protein, 81 aa, Anolis carolinensis
LVAFDDIAIYFTQEEWDLLDLEQRSLYEEVMTESYKIVSSLDNQRGANTCAMCWRCFLQRLDHSTHRRIDTEASDAKEQPY

SEQ ID NO: 10858 - protein, 81 aa, Anolis carolinensis
VLQVRVSFAEVAVLFSEAEWGLLGPEQRSLYKEVMMENYGHTTSPGSPKPALISRLEDGGDPFDLGWMDRDGPAVGKLKPG

SEQ ID NO: 10859 - protein, 81 aa, Thamnophis sirtalis
NGGLTAVELPMQDLVSFEDVAVVFSVEEWALLNSKQKALYQEVMLENKRNMASVGDGWEMEDSGQEAAAPLPKDKNNVAEK

SEQ ID NO: 10860 - protein, 81 aa, Thamnophis sirtalis
WKRLVSFKDVAVYFTEGQGALLDPAQRALYKEVMVENYENMASLGFPVPKPNLITRLEQGEPPWRLDFQGVDANNSGALGK

SEQ ID NO: 10861 - protein, 81 aa, Thamnophis sirtalis
VTFEDVVVGFSLEEWSLLEDSQKELHQEVMLETCSLLLSLGHSVPTLGFSSLTCQPDGTTKTLLRSSWRRQLPLVAGGNKT

SEQ ID NO: 10862 - protein, 81 aa, Anolis carolinensis
EDLVTFEEVAVHFTKEEWALLDPGQRALYKEVMEETCRIVASVGFSLIPPYYPRYSLIQASAGPFSLDKERKEEKQQSGAK

SEQ ID NO: 10863 - protein, 81 aa, Anolis carolinensis
EVTFEDVAVNISKEEWDLLDPNQRSLYIDVMMENYETLSSLVFFVSFFLADNWKRMSIRVDGTYEAGFTQKLDPPGAEPLQ

SEQ ID NO: 10864 - protein, 81 aa, Anolis carolinensis
MEPWVYLDPRQRALYRDVMQESYETLMSLAADKLLNSNNNDEEDDDDDDEEEEDEGPEELRPGTSQSTPRRKSLESRCSDC

SEQ ID NO: 10865 - protein, 81 aa, Anolis carolinensis
VTFQEVAVSFSVEEWALLDPDQRALHQQVMKENLETVSSLNMCSHFLYCQETHREGESSQYRDCGEKKELGLSDQEATRKA

SEQ ID NO: 10866 - protein, 81 aa, Anolis carolinensis
FVQVTFQEVAVSFSEEEWALLDPDQRALHQQVMKENVETVSSLSKAPSFISTLLIDSEFKHPSHNLKQHRAIHTGEKPYTC

SEQ ID NO: 10867 - protein, 81 aa, Anolis carolinensis
FQRPLTFKDVAVYFTEGQGSLLDPDQKALYKEVMMENYENVASLGLLLSKPTLIFHLEQGEEPWLPDTRPFRNSYSVVYDH

SEQ ID NO: 10868 - protein, 81 aa, Anolis carolinensis
VNIEDVSVHFSKEEWTLLDRHQQALHWEVMGENYKMLASFVFLYKLHTNTQTIQSFFCSFSMSYHNNSLSPKGPGVAVCGV

SEQ ID NO: 10869 - protein, 81 aa, Anolis carolinensis
VAFQDVSVYFTQEEWDLLEEDQRALYYSVMQENSENVASLVLFCDPELQLSEPEDCEHDTVIQIGQKEKIMESKEEENPKG

SEQ ID NO: 10870 - protein, 81 aa, Cathartes aura
LFLQFVLEQHALLHPPGYPGPKPDILYRMERGEEPWVCTPQSPARWDGPDSPPPGRDGDVSWLEEPPSGWWPGAGGRRVLE

SEQ ID NO: 10871 - protein, 81 aa, Anolis carolinensis
VTFEDVSVHFSEEEWALLDPDQQALHWEVIGENYKTLASFGKDPSSSWSSFSREERERLEEASRKWPVIAAAAVLVGSFQG

SEQ ID NO: 10872 - protein, 81 aa, Anolis carolinensis
LFQSLVTFQDVAVFFTKQQWTLLDQNQRALYWEVMRENYDNVASLAGFPLAKPELISRLEQDPWFPDCLVLEKISPGIWGY

SEQ ID NO: 10873 - protein, 81 aa, Anolis carolinensis
PKVPVTFDDVSVYFNDKEWEKLEAWQKELYKNLMKENHESLISLDYAISKPGVLTQTEPGPDGDEQDSEEQGSPPDPTTAG

SEQ ID NO: 10874 - protein, 81 aa, Anolis carolinensis
MEQYVLLDPRQRALYRDVMQESYEMLMALEFPLPKTDLLSQLERGNEATFDLQAPGNLPPVTALVNENIEDENSVQDVAKE

SEQ ID NO: 10875 - protein, 81 aa, Anolis carolinensis
HKGPVTLQDVAIHFSIEEWALLDPDQRALHAQIMEETRGIMASLETLPRGCPDMLPSGWEASLMSPYDAVDICTHMPPMDP

SEQ ID NO: 10876 - protein, 81 aa, Anolis carolinensis
DQVTFEDVFVHFSEEEWALLDPDQQALHWEVMGENYKMLASFVLEMRSVSEVLLHRIMLDHNPVAWVLFNRTGTFKSELCI

SEQ ID NO: 10877 - protein, 81 aa, Thamnophis sirtalis
PKVPVTFDDMSVYFNEKEWEKLEEWQKELYKNLMKGNHQSLVSLDYAISKPGVLSQTERTTDEQDSEEQGRLPDPTAAGIR

SEQ ID NO: 10878 - protein, 81 aa, Thamnophis sirtalis
NHMSFEDIAIFFSEEEWDLLNPDQKLLYREITLENARNMTSIGERWEDDDSKEEMIEHLPSVKNEIGERMFQCQWGVQSPE

SEQ ID NO: 10879 - protein, 81 aa, Thamnophis sirtalis
NTSGKEKLPFINCSPFSGGVERSAELVTQVLVLFEEVAVHFSKEEWSWLNPDQKALHREVMLENTRNVAFLAGMPLLTKVI

SEQ ID NO: 10880 - protein, 81 aa, Micrurus corallinus
NSISFEDVAVFFSVGEWALLDLEQKDLYQEVMLDNARNLASLSDEWQIEASGQEEAAPLPKGIKEVVERMFGKKASEENQL

SEQ ID NO: 10881 - protein, 81 aa, Micrurus corallinus
TISFKDVVIYFTKEEWALLDPDQKVLHEEIMLETCRNVAFLSNERKNKQETEREPSRVIKVEVGGETFQNQCPSKNQEEIQ

SEQ ID NO: 10882 - protein, 81 aa, Micrurus corallinus
ELPQVAFEEVAVHFTEQEWALLNVGEKVLYKDVMQENFEHVMSLGILLALKESKIAPCLLLVTPYSSSVAFHQVSFEEVAM

SEQ ID NO: 10883 - protein, 81 aa, Micrurus corallinus
FAFVRPSCSGGTEGVAEAPAQVAEQISEDVGNHIPKGLVSFEDVAVYFSEEEWSQMDAHQKALHKEVMLENSQNVASLARE

SEQ ID NO: 10884 - protein, 81 aa, Micrurus corallinus
KNSISFEDVAVFFSVEEWALLDLEQKTLYQEVMLENARNMASLNTSVFLTDDDNQEKEVCTGCGKMLRDKLGLCDCCKSHT

SEQ ID NO: 10885 - protein, 81 aa, Thamnophis sirtalis
MERFSLYGEAETVAVLPIQIPVSFQDVTVFFSEEEWALLDFDQKSLYREVMLENAKNVESLGKRFAFFWVQINGEVYSDER

SEQ ID NO: 10886 - protein, 81 aa, Thamnophis sirtalis
GSVSFEDVVVYFSEEEWALLDSSQRALHREVMLENSRNLAAVGYGQEHKDYQGPSLALFESVEKMFGIQGVLQKRAKSFLK

SEQ ID NO: 10887 - protein, 81 aa, Thamnophis sirtalis
QAPPFSFEEVAVYFTEVEWTLLDAEQRDLYWDVMQENYETVASLAVAIPKPELICRLERGEEPWIPAQAASEEKKIPLNLY

SEQ ID NO: 10888 - protein, 81 aa, Thamnophis sirtalis
AQDSVSFEEVAVYFTEDEWALLDPSQRALHGEVMLENFRSVAALAYGQEHENYRDQMIKSEVDMLVGQEPSQRIKKICKVS

SEQ ID NO: 10889 - protein, 81 aa, Thamnophis sirtalis
VTFDEEQAVHFSTPEWAKLEDWQKELYRNITRGSYEPLVSLDSAIAKADVLPPQAALGVAPHIADQPLAVGKGLPPAAKPA

SEQ ID NO: 10890 - protein, 81 aa, Thamnophis sirtalis
PKVPMTFEDNTVYFSEQEWGNLEEWQKELYKNVMKSNYESLVSLDYAIAKPDLLSRIEQGERPSAKEEEAAVTDRVITSEP

SEQ ID NO: 10891 - protein, 81 aa, Thamnophis sirtalis
ELPQVAFEEVAVHFTEQEWALLNVGEKVLYRDVMKENFEHVMSLGILLALKESKIAPCLLLVTPYSSSVTFRQVSFEEVAM

SEQ ID NO: 10892 - protein, 81 aa, Thamnophis sirtalis
QGSNPFEEVTVDFTEEEWMLMDSDQRVLCREVTLEAFRNIIDLSDAMEKENQEWLMSLPTANYEGEVTFDHQTNPKIQEES

SEQ ID NO: 10893 - protein, 81 aa, Thamnophis sirtalis
LESFVSFEEVAVYFSEEEWSQLDPDQKALHSEAMLENHRNMVCFAHFLHQMKTECRFFNGTQRVRFVDRQMYNRQEFVRFD

SEQ ID NO: 10894 - protein, 81 aa, Thamnophis sirtalis
LVSFEEVAMYFSEEEWSQLDPDQKALHLEVMLENHRNVVSLGINGQKNQDSRELFQVISAKDGTEKFGIQMEFESNERNQS

SEQ ID NO: 10895 - protein, 81 aa, Thamnophis sirtalis
MLEEVSVTFSEEEWALLDPDQRALHRDVMAENSGITSSLGCDWPESENGEIHEILFGKIGSEEEDKQRPDTEAGRVKDESP

SEQ ID NO: 10896 - protein, 81 aa, Micrurus corallinus
LVSFEEVAVYFSEEEWSQLNPDQKALHLEVMLENHRNVVSLGNNGQENQDSCELFQVISAKDGTETFGIQMEFESHERNQS

SEQ ID NO: 10897 - protein, 81 aa, Thamnophis sirtalis
RLFTLEDVTVHFTQEEWALLDPAQKALHREIIEEIKGILASLGDEWRIRDKSIPNTNQRFRLEGKPYRCSECGKAFATKTN

SEQ ID NO: 10898 - protein, 81 aa, Micrurus corallinus
VSFEDVAVYFSKEEWSQLDADQKALHGEVMLENSRNLAFLGFNEKENKNCNDECEAIHLKKEKGKFAGQMKSNSDETKQSQ

SEQ ID NO: 10899 - protein, 81 aa, Micrurus corallinus
AQGFVSFEEVAVYFTEEEWALLDPSQRALHEEVMLENSRNVTALGKPRLWMETTETSPPCGGAATSQGLASFEEVVVYFTE

SEQ ID NO: 10900 - protein, 81 aa, Micrurus corallinus
VKWPVAFEEVAVYFTPEEWDLLNEEQRILYYTVMQENSENVTSLELLISKPDPRLHLDWEEVSQMADLHTLKGKDTIDQGF

SEQ ID NO: 10901 - protein, 81 aa, Thamnophis sirtalis
PKVPVTFDDMSVYFNEKEWEKLEEWQKELYKNLMKGNHQSLVSLDYAISKPGVLSQTERATDSCHRHDQDSEQQRSLPDAT

SEQ ID NO: 10902 - protein, 81 aa, Thamnophis sirtalis
LPQDLVSFEEVAVYFSEEEWSQLDPDQKALHGEVMLENSRNLASLGKHLTRPVVSCQFSGSGAHAHKRPGGWAEPSAATTT

SEQ ID NO: 10903 - protein, 81 aa, Thamnophis sirtalis
VPMTFEDNTVYFSEQEWGNLEEWQKELYKNVMKSNYESLVSLDDEVAQTSFRSQGKRDLERNLEGPDLLDKGEMHVRPNMG

SEQ ID NO: 10904 - protein, 81 aa, Thamnophis sirtalis
MKSNYEMLVSMDYAIAKPEILTRIEQGDSLYDTTVETMSENDTPAHPGTESPVAPVDVSLWLKEEVEGPQGGGIIRPPEEI

SEQ ID NO: 10905 - protein, 81 aa, Pseudonaja textilis
QGLFTLQEVAVHFTKEEWTLLEPDQKAPHRETMEEISGILQVGCWCGNPCRTPSIYVFSPPGECGKCFSQSGILTAHQAMH

SEQ ID NO: 10906 - protein, 81 aa, Pseudonaja textilis
MLEEVSVTFSEEEWALLNPDQRALHRDVMAENSGIASSLGKFPLKKKKGWCCDSGIGIYSHVEKSFLSEHLEAKRNLPVRE

SEQ ID NO: 10907 - protein, 81 aa, Pelodiscus sinensis
AEPVTFEEVAVYFSEEEWALLDPGQRALYWDVTQENYEAVNWLVDVFVGDTVQQSAHLPQGISWAIPDAGRCTFTAAGNGT

SEQ ID NO: 10908 - protein, 81 aa, Pelodiscus sinensis
MAVVEPVSFEEVAVYFSEEEWALLDPGQRALYWDVMQENYEAVNWLVSKAYVISWVVRGKELWIPDLQGCEEGEIISDTHT

SEQ ID NO: 10909 - protein, 81 aa, Pseudonaja textilis
VSFEEVAIHFNNEEWLLLDPNQKTLHREVMLETSRIVDSLGKGSFRGKLSQTGETLNESSRLSFVQSPPPLDETKARGFLQ

SEQ ID NO: 10910 - protein, 81 aa, Pseudonaja textilis
AMAVDFTPEEWALLDWSQKALWREVMLEIFLNIAALGKTRSLLHSLEIFRDRKSGNIFLCIGLGSQAKRKQYGCGQYERNV

SEQ ID NO: 10911 - protein, 81 aa, Pseudonaja textilis
FSGSQQREVSVTFSEEEWALLNPDQRALHRDVMAENSGIASSLGKDYIALHCINFRERTENVRLHFIIYQKSFCFSLLSGS

SEQ ID NO: 10912 - protein, 81 aa, Pseudonaja textilis
DGFGQSRTICIGWGLNYSPFEWFQALVSFEEVSMYFSEEEWRLLDESQRKIFTKVMMENYENVRELGESWTGLGKCNGLGE

SEQ ID NO: 10913 - protein, 81 aa, Pseudonaja textilis
WMCCSNPAALRNILSLPPQGPVTFEEVAVRFSKGEWGMLDPEQRALYRDVMITFSSVARRGGASAAILGLCVRRSVCIWSC

SEQ ID NO: 10914 - protein, 81 aa, Pseudonaja textilis
PKVPLNFSDASVHFNEQEWRNLEEWQRELYRTVMRSNYDMLVSLDHSISKPDILSQMDQGEEIRIEESEVLENREIPKDPS

SEQ ID NO: 10915 - protein, 81 aa, Pelodiscus sinensis
VAEPVSFEEVAVCFSEEEWGLLDLGQRALYRDVMQENYEAVSWLAFPLSKPQDLFSVVLGQQVWHLLSAGTEEALTFGQEG

SEQ ID NO: 10916 - protein, 81 aa, Micrurus corallinus
LFFRRIPWEDPSQGTSGEKQRMKLSGFYDGDQKADEPPNQESLVSFEEVAVYFSEEEWSQLDPDQKVLHLEVMLENHRNVV

SEQ ID NO: 10917 - protein, 81 aa, Micrurus corallinus
SQEMFFRRISQDDPNQDRTRGKNRRKFTVPDGGTETMIETPIQEGLVSFEDVAVYFSEEEWTELEPDQKALHREVMLENYR

SEQ ID NO: 10918 - protein, 81 aa, Pseudonaja textilis
MSFEEVAVYFSKEEWSQLDAGQKALHREVMLENSRNLASLTIHLKEGKEKRYQCMECGKTYIHTSSLNSHKRIHTEEKPYQ

SEQ ID NO: 10919 - protein, 81 aa, Pseudonaja textilis
GLVSFEEVAVYFSEEEWSQLDPDQKVLHLEVMFENHRNVVSLGKSFLKIRKKYPGKSVNLFKGKIQLNEHYYTPNKREDAI

SEQ ID NO: 10920 - protein, 81 aa, Pseudonaja textilis
SLVGGSKGGGPTASYLCSSGAWTSFSSPRNLAWSGAVYFSEEEWSQLDPDQKALHSEVMLENHRNMVSLGKTFRTVLSFVL

SEQ ID NO: 10921 - protein, 81 aa, Pelodiscus sinensis
AEPVTFKEVAVYFSVEEWALLDPGQRALYWNVMQENYEAVSWLGCKTRMSCSSAARGLQSQGKEMAAVELVTFEEVAVYFS

SEQ ID NO: 10922 - protein, 81 aa, Pseudonaja textilis
ENLVSFEEVAVYFSEEEWSQLDPDQKALHSEVMLENHRNVVSLGKCFLEKFPEKIRKKYTGKSVKLIKAKVQVNEHYLTQN

SEQ ID NO: 10923 - protein, 81 aa, Pelodiscus sinensis
VTFEEVAVYFTRAEWALLPPAQRALYRAVMQENYEYMTSLDLTLPCLSITPTCCATHVLLSKGKTSKKNICRSQEKHSTHY

SEQ ID NO: 10924 - protein, 81 aa, Pelodiscus sinensis
VVEPVNFEEVAVYFSEEEWALLDPGQRALYRDVMQENYEAVSWLGIPVSKAHVLSWMERGEELQILDLQGCEEGDGMLNEN

SEQ ID NO: 10925 - protein, 81 aa, Callipepla squamata
SQEPVSFEEVAVYFSREEWALLDPAQRALYRDVMLEMYECVASLAPLPGPKPMVISLLEEGEEPGSQMWVALRPWQEMSAH

SEQ ID NO: 10926 - protein, 81 aa, Callipepla squamata
PSVPVTFRDVFVQFSRDEWALLDDEQKELHQSVMQSNYEVLMSLYCDLAKPEVLLQMERGEPCLPAEPDLQGAAVSLNPAA

SEQ ID NO: 10927 - protein, 81 aa, Callipepla squamata
LQEPVSFEEVAVYFSREEWALLDPAQRALYRDVMLETYECVASLAPLPAPKPMVISLLEEGEEPWVPDVGSPEAVAGDVSP

SEQ ID NO: 10928 - protein, 81 aa, Callipepla squamata
EPVSFEEVAVYFSREEWALLDPAQRALYRHVMLETYECVASLAPLPAPKPMVISLLEEGEEPWIPDEGSRQAVAGDVSPGE

SEQ ID NO: 10929 - protein, 81 aa, Callipepla squamata
PKVPLTFDDIAVYFNEEEWERLDSWQKDLYKAVMRGNYETLVSLDYAVSKPDILSRIERGEELFVKDCWESPQTSNQVSPE

SEQ ID NO: 10930 - protein, 81 aa, Callipepla squamata
WQEPVTFEDIAVYLSRAEWDVVSEEQRELYCSVMLDNYELLASLGYPGPKPDIVHRLERGEEPWVSTPQSPVKWDGPDRSL

SEQ ID NO: 10931 - protein, 81 aa, Callipepla squamata
MSFEEVAVYFSREEWALLDPAQRALYRDVMLETYECVASLAPLPAPKPMVISLPEEGEEPWIPDVGSPEAVAGDVRPGEVV

SEQ ID NO: 10932 - protein, 81 aa, Alligator mississippiensis
PKVPVTFDDVSVYFNEKEWEKLEEWQKELYRNVMRSNYESLISLDYAISKPGTLSQVEQGRESSIGDQQDLEEREIITDPS

SEQ ID NO: 10933 - protein, 81 aa, Alligator mississippiensis
LREVFEDVAVYFTRKEWELLEDKDKVLYRDQMLRNFQALVSLGKTLVLASPWTYVYSEFYCLLPVFQQSHPHAPLTGLLCQ

SEQ ID NO: 10934 - protein, 81 aa, Alligator mississippiensis
DPGQLHKGQDKLPKQKLREAFEDMAVYFTRKEWELLEEEDKELYRDLMLRNYQALLSLDHCISTSVPGDHGSSTREINATQ

SEQ ID NO: 10935 - protein, 81 aa, Alligator mississippiensis
GSLSPEPSKLQQGQGKLAKQVETTELQEAFEDVAVYFTREEWELLEDAQKGLYRDQMLRNWRALVSLGKVFSGFSPQPCQR

SEQ ID NO: 10936 - protein, 81 aa, Alligator mississippiensis
TQVPVMFAEVAVVFTTAEWALLDESQRMLYRETTLETYQNLASLGVPVLKPHVVTCLEHGEEPVVVAAQGPGDVETSAGTC

SEQ ID NO: 10937 - protein, 81 aa, Alligator mississippiensis
SPQKKQASLELQEVFEDVAVYFTQKEWELLEDEDKVLYQDQMLKNYQALVSLGKTLVLASLWSYVNTQVLQSLPVSTVSSL

SEQ ID NO: 10938 - protein, 81 aa, Callipepla squamata
LQEPVSFEEVAVYFSREEWALLDPAQRALYRDVMLEMYECVASLGEGFAAFPPLLGTLGCAECASARGPQSKPHAVPSRET

SEQ ID NO: 10939 - protein, 81 aa, Pantherophis guttatus
SDDISDGKNKTNLTPFYGGAEILVEAPKEALMSFKEVAVYFSEEEWSQLDADQKALYREVMLENHRNVASLGENIKELLSE

SEQ ID NO: 10940 - protein, 81 aa, Pantherophis guttatus
SFEVNLAVNFTSEEWLLLDPSQKALYQEVMLETSRMVASLVDDPDTENYQEPGVVPSQIIKIEIQGDTTADKCDKGRNEEN

SEQ ID NO: 10941 - protein, 81 aa, Pantherophis guttatus
DLVSLEDVAVFFSVEEWALLDSEQRALYREVMLENKRNVASLAGDGWEMEDSGQEAAASLPKDKKEVAEKIYGKQSSEESQ

SEQ ID NO: 10942 - protein, 81 aa, Pantherophis guttatus
RLFTLEDVAVHFTEHEWALLGPEQKALHREVMEEISGIVASLGNKWRIMDKSKPSTNQRFRLEGKPYKCSECGKAFATKTN

SEQ ID NO: 10943 - protein, 81 aa, Pantherophis guttatus
QTQPVSFEEVSVCFSKGEWSLLGPSQRVLYKEVMQENYENVTSLVLSLTGLGPNSWMEEEDEAVLGLRSQLSEKGGNQDVS

SEQ ID NO: 10944 - protein, 81 aa, Pantherophis guttatus
PQDVVSFDDVAVYFSKEEWSQLEADQKVLHREVMLENSRNLASLVAVYFSKEESSQLDADQKTLHGEVMLENSWNLFSLGL

SEQ ID NO: 10945 - protein, 81 aa, Alligator mississippiensis
PWGEQLGVPDKCVVMHEEWAELAAWQRELYRDVMMDNYELVASLGSAGPKPEVICQIERGEEPHVGAPQGERDGGIPEAPG

SEQ ID NO: 10946 - protein, 81 aa, Lepidothrix coronata
PKVPLTFDDISVYFNELEWERLERWQKDLYRAVMRGNYETLVSLDYAMSKPDILSQIERDEELGDKEDQEPPWTRAGDRQE

SEQ ID NO: 10947 - protein, 81 aa, Pantherophis guttatus
FRRIPWEDPSPDTSGEKQRMKLSGFSDGDQTAVDPTNQESLVSFEEVAVSFSEEEWFQLDPDQKVLHSEVMLENHRNVVSL

SEQ ID NO: 10948 - protein, 81 aa, Pantherophis guttatus
TQNLVSFEDVAVFFSMEEWALLDLEQKALYREVMLENKRNMASLGQDTVLFHQLFLRLEMSSQRRQPSSAPAQYGAGDGWE

SEQ ID NO: 10949 - protein, 81 aa, Pantherophis guttatus
WRLFTLEDVAVHFTEHEWALLEPDQKALYREVMEEISGILATLEGDKREIEADGESPTNQTYKYLICGNGFRQKAELNSHQ

SEQ ID NO: 10950 - protein, 81 aa, Alligator mississippiensis
AQRWEAFEDVALYFTQKEWELLRDGDKVLYQEQMLRNYQALVSLGYQGPTPDLICRIQRGDMELWVCDDEDPKESMWSEGL

SEQ ID NO: 10951 - protein, 81 aa, Notechis scutatus
GLVSFEEVAVYFSEEEWCQMDAHQKALHEEVMLENSQNVASLGAHEQENEGCKEPFQEISQKKEERLKEREKPVKKRKKNK

SEQ ID NO: 10952 - protein, 81 aa, Notechis scutatus
GPGDADATELLQTSLEPGSFSSDRGMTARPLSQELLSFEDVAVHFTDEEWMLLDAGQQDLYREVMAENSGMVASLSKDPWA

SEQ ID NO: 10953 - protein, 81 aa, Pantherophis guttatus
RPGQVTFEDVAVYFSREEWEELSEWQRELYQAVMMENYEAVLSLGPLPIKPRIINQIEQKEAVVTGELWKPCKWTEAQDQW

SEQ ID NO: 10954 - protein, 81 aa, Pantherophis guttatus
DLVSLEDVAVFFSVEEWALLDSEQRALYREVMLENKRNVASLGDGWEMEDSGQEAAASLPKDKKEVAEKIYGKQSSEESQL

SEQ ID NO: 10955 - protein, 81 aa, Dipodomys ordii
APGSVTFRDVAIDFSQEEWKWLQPAQRDLYRCVMLENYGHLVSLGLCISKPDVVSLLEQGKEPWLGKGGVNRDLFSVSDGK

SEQ ID NO: 10956 - protein, 81 aa, Octodon degus
MLENYQNLVALGPPVCKPDVISHLERGEEPWRVYREGSGGSCSEREPVPEVKEQSLLQGCCRRDLPWEAVTGPLKRPSAHS

SEQ ID NO: 10957 - protein, 81 aa, Rattus norvegicus
KVPVTFVDIAVYFSEDEWKNLDEWQKELYSNLVKENYKTLMSLDTDGPVSKPDAPVQAEPREEPCVWEQHHPEEREIPGTA

SEQ ID NO: 10958 - protein, 81 aa, Rattus norvegicus
DAVTYEDVHVNFSPEEWALLDPSQKSLYKDVMVETCRNLTAIGYKLEDSNIEEHCQRSRGPRRYNICHCGYEPCEHWGHGK

SEQ ID NO: 10959 - protein, 81 aa, Rattus norvegicus
NQGESYVSLEDVCLRFTAEEWGLLDDAQKLLYHNVMLENFSLVLSLGLPISKSFPGTQVYPSWPYLFQKDKHTTVEPSINI

SEQ ID NO: 10960 - protein, 81 aa, Mesocricetus auratus
IQELVSFEDVTVQFTEEEWALLDPLQRTLYRKVMLENWKNLTSLGYCLDKPNLISQLEQEDKAMTENRGSIPGISPELETV

SEQ ID NO: 10961 - protein, 81 aa, Mesocricetus auratus
LRESVTFKDVVVNFTQEEWRHLDPTQRDLFRDVTLENYTHLVSIGLQVSKPDMISQLEQGTEPWIEESCIPVGSMEDWKIR

SEQ ID NO: 10962 - protein, 81 aa, Mus musculus
MGVVTYDDVHVNFTQEEWALLDSSQKNLYRDVMLETYRNLAAIGYSWEDHNPEEHFQSSRRHGRHEKSHIEEKPSEFTQCG

SEQ ID NO: 10963 - protein, 81 aa, Mus musculus
MDLVTYDDVQVNFTQDEWALLDPSQKSLYKGVMLETYRNLTAIGYIWEEHTIEDHFQTSRSHGRHERSCSPEQPSDFIQCG

SEQ ID NO: 10964 - protein, 81 aa, Mus musculus
FETLKDLAMDFTVEDWKDLESEWDQRDLFWDVTLNHYQDMFSFNTSQPSLTSQPDVREELEATSTEVPETKSSPLQSGFVE

SEQ ID NO: 10965 - protein, 81 aa, Mus musculus
AVTFRDVAVVFSEEEMGLLDAAQRKLYHDVMLENFLNLLAVGSQSPNKVDTLDSTGLRHLSLGWLPCWHMTGHDVKKLAST

SEQ ID NO: 10966 - protein, 81 aa, Mus musculus
MDLVTYDDVQVNFTRDEWALLDPSQKSLYKGVMLETYRNLTAIGYIWEEHTIEDHFQTSRSHGRHERSCSAEQPSEFIQCG

SEQ ID NO: 10967 - protein, 81 aa, Cavia porcellus
QTVEVTFEDVAVLFTRDEWRKLDALQRSLYRDVMLENYRNLASLAGFPFTKPRVISLLQQGEDPWKVEKEIPGGPSLGWKN

SEQ ID NO: 10968 - protein, 81 aa, Cavia porcellus
RPRALKFADVAVYFSLEEWGCLRPAQRTLYRNVMRETYGHLGALGCAGPKPALISWLERNTDDWEPAALDPQEYPRGVTVQ

SEQ ID NO: 10969 - protein, 81 aa, Cavia porcellus
KNEKLIFSDVSIDFSQEEWECLDSAQRDLYRDVMLENYRNLISLGLYIPKPQVISLLEQGKEPWMIGRELTRGLCLDLESM

SEQ ID NO: 10970 - protein, 81 aa, Cricetulus griseus
ISFEDVVVDFSWEEWQLLNPTQKSLYRDVVLENCSSLVFLGYQTIKPDVAFKLDQQEASLINEGILNQNFLEIWLDTSEVR

SEQ ID NO: 10971 - protein, 81 aa, Cricetulus griseus
MNGLLSFRDVSVDFSQEEWECLDCAQRALYMDVMLENYCNLLFVENHRTCGKCEEILHRGTKHFIHDHENIQEKTYKCNEL

SEQ ID NO: 10972 - protein, 81 aa, Cricetulus griseus
TQEFVSFEDVTVEFTEEEWALLDPLQRTLYRKVMLENWKNLASLGYCLDKPSLISQLEQEEKAITEDTGSHTGISTDLQTV

SEQ ID NO: 10973 - protein, 81 aa, Octodon degus
MDVMLENYCHLISLGYDMTKPDMILKLEQGEEPWTSFADHACLKENWKAEDFLMKFKEHQDKYSRSVVCINHNKLIKQKSS

SEQ ID NO: 10974 - protein, 81 aa, Peromyscus maniculatus
SQGLLTFRDVTVDFPQEEWECLDSAQRALYIDVMLENYSNLVSVENFYICDPVHQHVKTEKESCQYYELGKVLHDPSTSAF

SEQ ID NO: 10975 - protein, 81 aa, Rattus norvegicus
GPLENDGVCFSEQEWENLEDWQKELYRNVMESNYETLVSLKVLGQPEEEVELGAEMVGDLVEEGTHLADRAMVKQEMLYKQ

SEQ ID NO: 10976 - protein, 81 aa, Rattus norvegicus
MLSFWDVAIDFSPEEWECLEPVQWNLYRDVMLENYSNLVFLGLTFSKPFLVTFLEQRQGPWDMQRQAAAPVHPGRALSDPD

SEQ ID NO: 10977 - protein, 81 aa, Mus caroli
TNGLLTFKDVAIEFSQEEWECLDSAQRTLYRDVMLEIYSILVSVGLSISKPELLTCLEQNEEPSIAKGIEPVLSCFHNKEL

SEQ ID NO: 10978 - protein, 81 aa, Mus musculus
CERWMSFEDVTVNFSQEEWQHLDSAQRCLYQEVMLEIYSHLLAVGYSIPSPGVIFRMEKGKEAQTAKAEFPGQRCQEKSGN

SEQ ID NO: 10979 - protein, 81 aa, Cavia porcellus
VVFSDVSIDFSQEEWECLNDDQRDLYRDVMLENYSNLVSMVLESRCETKKLFVKKEIDEIKSTQWEIMGRLTRHDLQCSGF

SEQ ID NO: 10980 - protein, 81 aa, Cricetulus griseus
MESLSFEDIAVYFTWQEWQDLDIAQKLLYRDVMLENYSSLVSLGCCMIKPELILMLEREFGPWRVADTSLWNFPGYYMTRP

SEQ ID NO: 10981 - protein, 81 aa, Cricetulus griseus
GLLTFRDVAVDFSREEWRCLDSGQRALYMDVMLENYSNLLSVGIIACKADLVPCLEQIQMPWNVKREEMVARPETQQMCSN

SEQ ID NO: 10982 - protein, 81 aa, Cricetulus griseus
RRPWKLPASGVTVDSFQEEWQCLDPSQRAPYRHWMLQNRSSLVCVEFTDHPDLLLTCAAEQRSLNGEREETEAKEAEKLKG

SEQ ID NO: 10983 - protein, 81 aa, Rattus norvegicus
SQGLVTIKDVSLCFSQEEWRSLDPSQTDFYGEYVMQENCGIVVSLRFPIPKLDMLPQLEGGEEQWVPDPQDVEGRDIRKVT

SEQ ID NO: 10984 - protein, 81 aa, Mesocricetus auratus
WERLVSFEDVTVTFSQEEWQQLDSAQRCLYQDVMLEIYSHLLAVGDLRLDTPQQQIFVKASFLNDASSDVTGHGSYSILEK

SEQ ID NO: 10985 - protein, 81 aa, Rattus norvegicus
PQVPVTFREVAVYFCREEWECLSFSQRTLYRDVMLENFRNLNELGCCGRKPSLISRLEQWDEPWVDKWDSSELERQKSVCP

SEQ ID NO: 10986 - protein, 81 aa, Rattus norvegicus
YQVSVTFDDVAVDFTQEEWILLDQAHRDLYREVMLENYQNLASAGCEVIKPSLISWLEEEDLHREDLQEWEMPLGTQESTL

SEQ ID NO: 10987 - protein, 81 aa, Rattus norvegicus
MVTFRDVAVVFSEEELGLLDAAQRKLYREVMLENFRTLLSVAHQPFKPGLIAQLENDEKLWMVAADAQAGGLSGRRSGHTV

SEQ ID NO: 10988 - protein, 81 aa, Mesocricetus auratus
YQDAVTFDDVTVEFTPDEWTLLDLTQRNLYREVMLENYENLTSVGCQFFIPSLTPWLKQEELETVESTVPQQLELQPRIDD

SEQ ID NO: 10989 - protein, 81 aa, Mus caroli
QGLLTFGDVALDFSQEEWECLDSAQRALYIDVMLENYINLVSVEKHHMCGKYEKVLDQHSEHQHVNIQEKSYKYKELGKMV

SEQ ID NO: 10990 - protein, 81 aa, Mus caroli
PQCLLTFRDVAVDFPQEEWECLDSAQRALYIDVMLENYRNLVSVENYCICDTVHQHVKTEKESCQGNKLGEMLHEPSNCAL

SEQ ID NO: 10991 - protein, 81 aa, Mus caroli
PQGQLTFKDVAVDFSQEEWECLDCAQRALYMDVMLENYNNLFFVENHCVCSKYENVLDQDTQHIFHKHVNIQKKSCKCNDR

SEQ ID NO: 10992 - protein, 81 aa, Mus musculus
DKALMAFHDVAVAFSQMEWELLSPAQRILYRDVMLENYSHLVSLGIAFSKPKLITQLEQGAEPWRDGSGCFLDLCPEPRTE

SEQ ID NO: 10993 - protein, 81 aa, Mus musculus
AVTFRDVAVVFSEEELGLLDAAQRKLYHDVMLENFRNLLAVGGQSPGKTTHLHTTGLRFLSLGRLPCWQVTSHDANKLAGA

SEQ ID NO: 10994 - protein, 81 aa, Mus musculus
MDLVTYDDVHVNFTQEEWALLDPSQKSLYKGVMLETYRNLTAIGYIWEEHTIEDHFQTSRSHGRRERSCTAEQPSEFIQCG

SEQ ID NO: 10995 - protein, 81 aa, Mus musculus
MEEMLSFRDVAIDFSAEEWECLEPAQWNLYRDVMLENYSHLVFLGLASCKPYLVTFLEQRQEPSVVKRPAAATVHPGGKPY

SEQ ID NO: 10996 - protein, 81 aa, Mus musculus
MEEMLSFKDVAIDFSAEERECLDPAQWKLYRNVMLENYDNLVFLGLTSSKPYLVTCLEQIQEPSDVKRGAATSMLPECREY

SEQ ID NO: 10997 - protein, 81 aa, Cavia porcellus
NFWILRLPPGSKGEVPKEWGRLEDWQKELYKHVMRGNYETLVSLDYAISKPEVLSQIEQGEEPCTWRRAAPKIPDVPVDPS

SEQ ID NO: 10998 - protein, 81 aa, Cavia porcellus
MTLKDVAMDFTPEEWGKLDPAQRDVMLENYRNLVSLYMETIPESKDSISVQEFSKESHQDVIMDRLTRNNVYDSTLETALE

SEQ ID NO: 10999 - protein, 81 aa, Cricetulus griseus
PVSFDDVVVNFTSGEWALLDSSQKKLYRDVMKETFMNLISIGRIVEENIDVDYDKLQRNLRIQVTEQFCDYEYGIQCGKPH

SEQ ID NO: 11000 - protein, 81 aa, Cricetulus griseus
IGNLDLHPLRELSVAILLTCPSLEDHDQEHSHFLSAEFFRDLGADETLQSLSESKPELVTCLEENKEPWMVNIDEAEGLEQ

SEQ ID NO: 11001 - protein, 81 aa, Cavia porcellus
QQGCVAFEDVTIYFSQEEWGLLSEAQRLLYCDVMLENFALIASLGLTSFRCHVIAQLKMGKEPWVPDRVGMTSAMARGAFR

SEQ ID NO: 11002 - protein, 81 aa, Cavia porcellus
LQVLVSFEDVTVDFSREEWQQLDSTQRCLYHDVMLENYSHLLSVGFEVPKPEVIFKLEHGEEPWTWEKETPHHSCSGWTFG

SEQ ID NO: 11003 - protein, 81 aa, Octodon degus
FEGSVSFEDVAVDFTQQEWRRLDSAQRTMHKDVMLETYSNLASVGLCVAKPEMIFKLERGEELWILEEEPSGHAYTESLSL

SEQ ID NO: 11004 - protein, 81 aa, Octodon degus
EAVTFEDVAVKFTMEEWALLDLSQKNLYRDVMWENFRNVAAIERNWDDQQIEDEYKSCRRNGRSEEVRKCCQYKLCQKHGE

SEQ ID NO: 11005 - protein, 81 aa, Octodon degus
WSQMPVTFEDVALYLSREEWGRLDHTQQNFYRDVLQKKNGLALGFPFRRPFWAPQVSRKVEASSSGRQTGTEEEDSDPGSG

SEQ ID NO: 11006 - protein, 81 aa, Rattus norvegicus
AVTFRDVAVVFSKEEMGLLDAAQRKLYHDVMLENLRNLLAVGGQSPNKMKTVDATGIRCLLLGQLLYWEITGHDANKLARA

SEQ ID NO: 11007 - protein, 81 aa, Rattus norvegicus
FQETVTFGDVAVHFSREEWQCLDSGQRALYREVMLENHSSVAGLAGFLVFKPELISRLEQGQEPWALDLQGAEGTEAPRIC

SEQ ID NO: 11008 - protein, 81 aa, Rattus norvegicus
SQSLLTFRDVAVHFSQEEWECLDSSQRALYIDVMLENYSNLVSVENYCICETVHQHVKTEKESCQCNELGEMLRGPSNCAL

SEQ ID NO: 11009 - protein, 81 aa, Rattus norvegicus
SEGLVSFEDVSVDFTWDEWQDLDEAQRKLYRDVMLETYSSLMSLNQCDPKPELILKLEKEAGPWKEDNSPNQSVPDVKNVN

SEQ ID NO: 11010 - protein, 81 aa, Mesocricetus auratus
AWVPALFDEVAIYFSDEEWEVLTEQQKALYREVMRMNYETVLSLEFPFPKPDMISRLEREEEYPNSDEWRLQGVTFAENQE

SEQ ID NO: 11011 - protein, 81 aa, Mesocricetus auratus
HKKSMVFSDVSLDFSQEEWECLGPAQRDLYRDVMLENYSNLLSVAGLHIPKPQVISLLEQGKEPWMIGKELTRGLCSALES

SEQ ID NO: 11012 - protein, 81 aa, Mus caroli
QVDAVTFEDVAVDFTQEEWTSLDPVQRNLYRDVMLENYQNLATVGGQMFKPSLISWLEQKVELTVIEQGILQEWEMHLKTK

SEQ ID NO: 11013 - protein, 81 aa, Mus musculus
MDAVTYDEVHVNFTQEEWALLDHSQKSLYRDVMLETYKNLTAIGYNWDDHNIEEHCQSSRRHGSVCALGSLQRKLKEKFWK

SEQ ID NO: 11014 - protein, 81 aa, Mus musculus
MEEMLSFRDVAIDFSPEERDYLGPAQWDLYRDVMLENYSHLVFLGLAVAKPYLVTFLEQNQGSSGVKSHAAATIPGTTGNE

SEQ ID NO: 11015 - protein, 81 aa, Mus musculus
MLSFWDVAIDFSPEEWDCLEPAQWDLYRNVMLENFSHLVFLGLAVSKPFLVTFLEQRQGPWDMKRQGMATVYPGCDYTMVA

SEQ ID NO: 11016 - protein, 81 aa, Cavia porcellus
ANDSVTFGDVAIDFSQEEWEFLDSAQKDLYRDVMWENYSNFISLGASISKPDVITLLEEEGKEPGMVVKEGTRTFCSDLES

SEQ ID NO: 11017 - protein, 81 aa, Cavia porcellus
QCESVTFKDVVVDFTQEEWKQLDPGQRDLFRDVTLENYTHLVSIGLQVSKPDVISQLEQGTEPWTEEPGVTGHTDWEPRRE

SEQ ID NO: 11018 - protein, 81 aa, Cavia porcellus
GPVSFKDVAVDFTQEEWQQLDSDEKTTYRDVMLENYNNLLSVGYDVSKPNVIIKLEQGEEPWTIEDDFSHTWPDVWKVNDL

SEQ ID NO: 11019 - protein, 81 aa, Cavia porcellus
SVAFEDVAVYFSWEEWDLLDEAQRHLYLEVMLENLALMSSLGCSCRVEDEVVPSELGLSVDLSRVMTPKEGLSSQNAYAYE

SEQ ID NO: 11020 - protein, 81 aa, Cavia porcellus
EPLTLEDVTVTFMQEEWQLLDPAQKNLYRNVMLENYSNLVSVGYEGSKPDALFRLEQGGPWIIDEIYSHICPENDQVGNHL

SEQ ID NO: 11021 - protein, 81 aa, Cricetulus griseus
MLGLLGPPEFSLQYHMAYFRERYHIIKPDVIIKLEQGEEPWIVEGTFSPQSYPDEIWQGNDLMEKAQGDEKKQSRSAVFNY

SEQ ID NO: 11022 - protein, 81 aa, Cricetulus griseus
SVTFDDVTVEFTPDEWTLLDLTQRNLYREVMLENYENLTSVELELQPRIDDSELQNYFKMQSSDELEMTESQNGRELYNWT

SEQ ID NO: 11023 - protein, 81 aa, Cricetulus griseus
RREMLSFWDVAIDFSPEEWECLEPAQWNLYRDVMLENYSHLDFLGLAVSKPFLVTFLEQRQGPWDVKIQAEAPVNPGTIPN

SEQ ID NO: 11024 - protein, 81 aa, Cricetulus griseus
GSVSFTDVTVDFTQEEWEQLDPSQRILYMDVMLENYSNLLSVEVWRADDQVEKDPRDPDEQARPLTTPKNQPPIEERGSLF

SEQ ID NO: 11025 - protein, 81 aa, Cricetulus griseus
KMLSFQDVAIDFSAEERECLDPDQWDLYRDVMLENYSNLEFLGLASSKPYLVTFLEQSQGSNDMKRQTASTLQTGKQHFIG

SEQ ID NO: 11026 - protein, 81 aa, Cricetulus griseus
SKDLLTFRDVSVDFTKEEWQCLDSDQRALYIDVMLENCNNLIFVENYYRSDPVHQRVRIQKKSCQCSELGKVLHDPSTRAF

SEQ ID NO: 11027 - protein, 81 aa, Cricetulus griseus
FQHLLTFGDVAVDFPQEEWECLDSAQRALYIDVMLENYNNLLSVENYCKCDSVHHHVKNEKESCQCNKSGKMLHEPSTCIL

SEQ ID NO: 11028 - protein, 81 aa, Dipodomys ordii
TRDLVTFKDVAVEFSQEEWALLDTWQRTLYSEVTLENCRNLVSLGCHVDVPSLAAQLELCPQVGTEESGVVQDTCAELEHA

SEQ ID NO: 11029 - protein, 81 aa, Dipodomys ordii
MEEWEYLDPAQRSLYKDVMVENYGNLVSLDVLNRDKHEEPIVKQEIEEIEEDVEPQGVIVTRIKSEIEQDPMGQETFELVG

SEQ ID NO: 11030 - protein, 81 aa, Octodon degus
LRAVSFEDITVDFSREEWQYLDLAQKSLYRDVMLENYFNLVSVVVGCQVPNPEVIFNWEPEEDPCSMGSENSSQNYLGGDI

SEQ ID NO: 11031 - protein, 81 aa, Peromyscus maniculatus
QDAVTYEDVHVNFTHEEWALLDPSQKSLYKDVMLETYWNLTILGYKWEDYNIEEYYQGSRRHGRYINCQCSYNSCEHKGYG

SEQ ID NO: 11032 - protein, 81 aa, Peromyscus maniculatus
LTFRDVAVDFSQEEWEYLDSIQRALYIDVMMENYSNLVSVENYCMCEIVHQHMDSEEIYSKCNNDVDEILHESNRYTVYKT

SEQ ID NO: 11033 - protein, 81 aa, Mus musculus
MLENYRNLASVGFPLLKPAVISQLEERKDLENLFQLATGTDSQGLWTECTAVQSGNNLTKEVHEEEKSTLFELQKDFSQET

SEQ ID NO: 11034 - protein, 81 aa, Mus musculus
PQGLLTFKDVAVDFSQDEWKYLDRAQRALYVDVMLENYKNLFFVESHYLTHKYENILDEDTQCIVHEHMNLQSYKCHELGK

SEQ ID NO: 11035 - protein, 81 aa, Mus musculus
VQDLVTFKDVAVLFTQEEWGQLSSAQRALYQDVMLENYSNLVSLAGLLGSQPDMFFPLEEVEECVSEEAPEGFVLDAADEP

SEQ ID NO: 11036 - protein, 81 aa, Mus musculus
AQRLMTFRDVAVDFSPEEWECLSLDQRSLYRDVMLESYSHLVSVGQLQRSNAEILQSTLKDTDACTGLAPSYLQMVPQTLD

SEQ ID NO: 11037 - protein, 81 aa, Mus musculus
YMAPTASSFTTRTAQCRNTVAAIEEDAVTYDDVHVNFTGEEWNLLNPSQKSLYKDVMLETYWNLTVIGAGRPVETQGVHQP

SEQ ID NO: 11038 - protein, 81 aa, Cavia porcellus
MELLTFRDVAIDFSSEEWEYLDLAEQNLYTEVMLENYRNLVFLGLSFCKPDLITFLEQSKEAWIVKSQGTAAIFPGMTSHH

SEQ ID NO: 11039 - protein, 81 aa, Cavia porcellus
MMAFEDVAVYFSREEWVLLDKAQRALYRHVMLENFALVASLGFFSSPPRVVVQLECGEEPWVPTGKDLILGRNAHKRLDLG

SEQ ID NO: 11040 - protein, 81 aa, Cavia porcellus
APVPVAFDDVSIYFSTPEWEKLEEWQKELFKNIMKGNFESLISMDYAVSQPDVLSQIQPEAEHNTEDQAGPEESEIPAVSS

SEQ ID NO: 11041 - protein, 81 aa, Cricetulus griseus
YQDSVTFDDVTVEFTPDEWTLLDLTQRNLYREVMLENYENLTSVGCQFFIPSVTPWLKQEELETVESTVPQELELQPRIDD

SEQ ID NO: 11042 - protein, 81 aa, Cricetulus griseus
WSHMPVTFEDVALYLSHEEWGRLDHTQQNFYKDVLQEKNGLALEFPFSRPFWVPQVQGKGEMASSSRPAGAERRSLGSGIV

SEQ ID NO: 11043 - protein, 81 aa, Cricetulus griseus
LQGTVFFKDVAIDFSQKEWECLTSAQRALYRDVMLENYNNLVSVGLSVSKPELINSLEQSKQFWNGNTGESEGKEQVLCYH

SEQ ID NO: 11044 - protein, 81 aa, Cricetulus griseus
MQGLVTFSDVTVTFSKEEWECMDSAQWNLYTDVMLANYNNLVFVENYYKCDPVHQHMETEKESCQCNEIGEVLHDPSTCAL

SEQ ID NO: 11045 - protein, 81 aa, Castor canadensis
KPGPVSFADVAVYFSPEEWGSLRPAQRALYRDVMRETYGLLGALGLPGPKPALISWMEQESEAWSPAAQDPEEGESLGGAL

SEQ ID NO: 11046 - protein, 81 aa, Peromyscus maniculatus
MAMYLTREEWRPLDPTQRDLYRDVMQENYGNVVSLDFEIRSENEANSKPELSEDVEFVTMSEEPVGDAEKNPESEEAFESG

SEQ ID NO: 11047 - protein, 81 aa, Octodon degus
SQGLVSFKDVAVDFTQEEWQQLDPAQRTLYKDVMLENYSHLVSMAYPVSKPDIISKLEQGEDPWIIKTDMASCNYPDANYT

SEQ ID NO: 11048 - protein, 81 aa, Peromyscus maniculatus
SQEHVSFKDVCVDFTKEEWYLLDPAQKVLYRDVILENYSNFVSVGHCVTKPDVIFKIEQGEDPWIPENRFQCHPERKWKVD

SEQ ID NO: 11049 - protein, 81 aa, Peromyscus maniculatus
FQEAVTFKDVALVFTTEELGLLDLTQRQLYQDMMLENFKNLVAVGCFPLKADMVSLLEAEERLWLKETEVQRNGSSPQESA

SEQ ID NO: 11050 - protein, 81 aa, Peromyscus maniculatus
IQELVSFEDVTVQFTEEEWALLDPLQRTLYRKVMLENWKNLVSLGHHLDKPNLISQLEQEDKAIIEERGSIPGICPDLETV

SEQ ID NO: 11051 - protein, 81 aa, Peromyscus maniculatus
PQDPLTFRDVTVDLSQEEWECLDCAQRTLYMDVMLENYSNLVFVENHHICGKYKKFLDQGSKYIIHQHLNIQEKSYKCSEL

SEQ ID NO: 11052 - protein, 81 aa, Peromyscus maniculatus
RLGVVSFEDVTVDFSQEEWRRLDPAQRRLYQDVMLEIYSHLLAVGYPIPSSGAILRIKQRKEAWMGEVKFPHQQCGCREVE

SEQ ID NO: 11053 - protein, 81 aa, Rattus norvegicus
EEGCVSFEDVAVYFSWEEWTLLDDSQRLLYQTVMTEIFTLVSSLRLELSGIQDLTQAESCGDLSVPALRFLTPCLWTGCWI

SEQ ID NO: 11054 - protein, 81 aa, Rattus norvegicus
SCERLVSFEDVTVDFSQEEWQHLDSAQRCLYQEVMLEIYSHLLAVGYPRPEAILQMKNRKDTRLGQVDFLHQRCGQGQSEH

SEQ ID NO: 11055 - protein, 81 aa, Rattus norvegicus
QDQEPVTFKDVAVAFTQEEWEQLDLVQRTLYRDVMLETYGHLLSVGNQIAKPEVISLLEQEEPWSLEQGYPKSSCPEWMRN

SEQ ID NO: 11056 - protein, 81 aa, Mus caroli
EMGLVSFEDIAVEFTWQEWQDLNEGQRTLYRDVMLENYSNLLFLGHCKTKPELIFNLEQRLGSWIVEASHQCVPDFQNMST

SEQ ID NO: 11057 - protein, 81 aa, Mus musculus
MDLVTYDDVHVNFTQEEWALLDPSQKSLYKGVMLETYRNLTAIGYIWEEHTIEDHFQTSRSHGRHERSCTAEQPSEFIQCG

SEQ ID NO: 11058 - protein, 81 aa, Cavia porcellus
FKGLVTLKDVTVEFTKEEWQLLTPAQKALYKHVMLENYRQLVSIGYRVSKSNVILKLKQGKEPWRQEVKLPRRKASENLGN

SEQ ID NO: 11059 - protein, 81 aa, Cricetulus griseus
EEGCVSFEDVAVYFSWEEWKLLDDSQRLLYQTVMTEIFTLMSSLGLVPSGIHGVTQLGSWGEPALRFLTPGCWIKAESDTA

SEQ ID NO: 11060 - protein, 81 aa, Cricetulus griseus
FQEPVTFLDVAVDFTQEEWGQLDPTQRTLYRDVMLETFGHLLCVGPDLPKPAVISQLEQGAELWVTERGGTRACHPAWILG

SEQ ID NO: 11061 - protein, 81 aa, Cricetulus griseus
SQEQVSFKDVCVDFTKEEWYLLDPAQKGLYRDVTLENYSNFVSVGYCVTKPDVIFKIEQGEDPWIPENGFQCHPESKWKAD

SEQ ID NO: 11062 - protein, 81 aa, Cricetulus griseus
KPELVSFEDVAVYFSPHEWGCLRPAQRALYREVMRETYGLLGALGFPGPKPALISWMEQESEAWSPAAQDPAEGESLGGAL

SEQ ID NO: 11063 - protein, 81 aa, Cricetulus griseus
MEPLTFKDVAIDFSGEEWECLNSEQQNLYKDVMLENYRNLIFLGLAVSKPYLVTCLEQRKEPWNVKRQKTMVLFPAMFPHY

SEQ ID NO: 11064 - protein, 81 aa, Cricetulus griseus
MLENYSNLVFLGLALSKPHLVTVLEQSTEPWSVKRKSAAASHSGSKPHKCKECGKSFDRNSVLVQHQRIHTGERPYACEEC

SEQ ID NO: 11065 - protein, 81 aa, Cricetulus griseus
EQGLVSFEDVAVDFTWQEWQELDAAQRTLYRDVMLENYSSLVSLGHCVTKPELIFRLEHGFGPWSIGETSLWNLPGVLEVP

SEQ ID NO: 11066 - protein, 81 aa, Cricetulus griseus
CAADQRGLEGERRQKLKMQDLVTFSDVTVTFSKEEWECIDSAQWNLYTDVMLENYNNLVFVVSSFPENYCKCDPVNHHVKT

SEQ ID NO: 11067 - protein, 81 aa, Cricetulus griseus
LQDLLTFGDVAVDFSQEEWECLESASKALYIDVMLENYHNLVFVEKYHMYVKNMKVLDQESKHIVYHPVNIQEKSYENNEM

SEQ ID NO: 11068 - protein, 81 aa, Cricetulus griseus
KVKQFSFQSLLTFKDLAINFSKEEWEYLNTSQKDLYKDVMLENYSNLVSVGLSESKPELVTCLEQNKEPWMVHIVEAEGLE

SEQ ID NO: 11069 - protein, 81 aa, Cricetulus griseus
VTFEDVALYLSHEEWGRLDHTQQNFYKDVLQEKNGLALGIVEMGKMVPTLAVATLEDTKPLRKPRARWALREEPQCGQHEA

SEQ ID NO: 11070 - protein, 81 aa, Octodon degus
SQGLVTFEDVAVYFSLEEWERLDADQRGLYQDVMQENYGILVSLGYPVPKPDLIFRLEHGEEPWVPDSPHPEEGDIVTGVY

SEQ ID NO: 11071 - protein, 81 aa, Octodon degus
SLGLVSFEDVAVDFSWEEWQDLDDAQKTLYRDVMLETYSSLVSLGHCSPKPEVIIKLELGAQQWMGEEHPSQAHTGHCTPS

SEQ ID NO: 11072 - protein, 81 aa, Peromyscus maniculatus
PHEPVKFEDVSLTFSKEEWAQLEFQQKCLYKEIMLENYNNMVSVERHFSKPNVISQLEEVEDFWPVEREIPQDIFPESSGP

SEQ ID NO: 11073 - protein, 81 aa, Peromyscus maniculatus
CERLVSFEDVTVDFSQEEWQQLDPAQRRLYQDVMLEIYSHLLAVGELQLDTPHQQTFVKASLLNDASSEVAGHGSYCSVLE

SEQ ID NO: 11074 - protein, 81 aa, Rattus norvegicus
PKVPVTFDDVAVHFSEQEWGNLSEWQKELYKNVMRGNYESLVSMDYAISKPDLMSQMERGERPAMQEQEDSEEGETPTDPS

SEQ ID NO: 11075 - protein, 81 aa, Rattus norvegicus
ETVTFGDVAVHFSREEWQCLDSGQRALYREVMLENHSSVAGLGFLVFKPELISRLEQGQEPWALDLQGAEGTEAPRICQTG

SEQ ID NO: 11076 - protein, 81 aa, Mus caroli
VSFEDLVVHFTQDEWALLAPSQKTLYGDVMLETFRNFTAIGYEWEDETIEDHCEEPEINLRNIVTHSEYTQYEREEYEEKP

SEQ ID NO: 11077 - protein, 81 aa, Mus caroli
MTYEDVHVNFSQEEWALLDPSQKSLYKDVMLETYWNLTCIGYMWEDCNIEDQHQSSGRHRRCINCPSAYGKKQCTNLFPRT

SEQ ID NO: 11078 - protein, 81 aa, Mus musculus
AVTFRDVAVVFSEEELGLLDAAQRKLYHDVMLENFRNLLAVGGQVPNKMENLHTTGVRCLSLGQLPCGHMASHDANKLARA

SEQ ID NO: 11079 - protein, 81 aa, Mus musculus
PQDLLTFRNVAVDFSKEEWEYLNSSQRALYMDVMWENYSNLVFVENHCICGKYEEDMDQSSNHIIYQHANIEEKSYKYHEL

SEQ ID NO: 11080 - protein, 81 aa, Mus musculus
VSFEDLVVHFTQDEWDLLAPSQKTLYGDVMLETFRNFTDTGCEWEDQKIEDHFEEPEINLRNIITHSEYTQYEHEEYEEKP

SEQ ID NO: 11081 - protein, 81 aa, Mus musculus
MESVSFEDVAVKFTQEEWAVLDPSQKKLYKDVMQETLKNLASIGNKSGKQKVINEYGKLWRKLSSHLAGKFSDYNENHQCA

SEQ ID NO: 11082 - protein, 81 aa, Mus musculus
MEEMLSFWDVAIDFSPEEKECLEPAQWDLYRDVMLENFSHLDFLGLAVAKPYLVTFLEQNQGSSGVKSQTSATIPPGTTGN

SEQ ID NO: 11083 - protein, 81 aa, Mus musculus
FQEMLSFRDVAIDFSAEEWECLEPAQWNLYRDVMLENYSNLVFLGLASCKPHLITCLEQIQEPSDVKRGAATSMLRGEKCY

SEQ ID NO: 11084 - protein, 81 aa, Cavia porcellus
MLENYNNLLSLGIPVPTPPGICWLQQGEDPYTEEREKPPDTCPDFKSWPDIGAVPVRQDIFTEEICHGIVKKKSSNFGPWN

SEQ ID NO: 11085 - protein, 81 aa, Cavia porcellus
SEDLVTFGDVSINFTQEEWKWLSPVQRNLYRKVMLENYRSLVSLGISVSKPDVISLLEQGKEPWMMKKGTRDLCPDWEYVF

SEQ ID NO: 11086 - protein, 81 aa, Dipodomys ordii
GSVSFTDVTVDFSQEEWERLDPSQRILYMDVMLENYSNLLSVEVWKADEQMEGDPKTPDEQARQFLILKNQTPVEERGYLF

SEQ ID NO: 11087 - protein, 81 aa, Cavia porcellus
SLGPALFRDVAVVFSQEEWAWLEPAQRDLYRDVMLETYSNLVSLGLAISKPDVISFLEQGREPWVEEKVKAGGLCPVLESE

SEQ ID NO: 11088 - protein, 81 aa, Peromyscus maniculatus
AHSEVMFRDVTVNFSQEEWECLNSYERDLYKDVMLENYSHLVSLAGCSISKPDVITLLEQGKEPWMIVRDERRRWSQDLET

SEQ ID NO: 11089 - protein, 81 aa, Peromyscus maniculatus
LSFEDVVVKFTKEEWALLDPSQKKLYKDVMQETLRNLTAIGNKLENKKVANEYKNLCRKLRSQLAEIFCEYKESLQSTELF

SEQ ID NO: 11090 - protein, 81 aa, Peromyscus maniculatus
FQRSVSFKDLTVDFTHEEWQCLGPAQRLLYRDVMLENYRNLLSVGFRVSKPDVILKLEQGKEPWVVEESPSQNHPEDDDAL

SEQ ID NO: 11091 - protein, 81 aa, Rattus norvegicus
SQGPVLFEDVFVAFTQKEWQLLDAAQRHLYREVMLETYRHLQAVGHSITKPELICKLEHGEGPWDPPGHGLSEAQRVDTMT

SEQ ID NO: 11092 - protein, 81 aa, Rattus norvegicus
KAVTYEDIHVNFTREEWALLDPSQKSLYRDVMLETYENLTAIGSYWEEHIIEENCQNSRRHGSHLDWNERIHTGEKTNEVV

SEQ ID NO: 11093 - protein, 81 aa, Mesocricetus auratus
SQVSVTFEDVAVLFTRDEWKKLDHSQRSLYREVMLENYSNLASLGFPFAKPEMISVLQQGEEPWKVEKRSLGFSLGCNSSL

SEQ ID NO: 11094 - protein, 81 aa, Mus caroli
AQRLMTFRDVAVDFSPEEWECLSLDQRSLYRDVMLESYSHLISVGLFVYRPHLFSLLEKGQDPWMILRNETRGPYPDIDFS

SEQ ID NO: 11095 - protein, 81 aa, Mus musculus
YKGPVTLRDVAVEFSKAEWKLLTPAQKSLYKNVMLETFSNLFSVGYRVVKPSVIAKLKKGKEPWPLEEFFRKSRGDKRRTA

SEQ ID NO: 11096 - protein, 81 aa, Mus caroli
QASVTFEDVAVRFTQEEWALLDPSQKILYGDVMQETYRNLTSVGINWECWDLEAYFRSLERNLRVQLVKRDCELKNNDPCG

SEQ ID NO: 11097 - protein, 81 aa, Mus musculus
VCGSVTFRDVAVDFSQEEWACLDATQKVLYRNIMLETYSNLVAVVGRCIPKPDLIVLLEQEKEPWMAVKKETGRPSQGLET

SEQ ID NO: 11098 - protein, 81 aa, Mus musculus
MATSEPAESDAEWEQLEPVQRDVYKDTKLENCSNPASMGNQDPKQDIVSVLEEEEPSSGKGKKASPSSLKKIARPKTAGTS

SEQ ID NO: 11099 - protein, 81 aa, Mus musculus
PRRWMAFEDVAVYFSQEEWMFLNAAQRALYRHVMLENFALVDSIGPSVSRPRVIIQLQRGEEPWVPNRTNRGPGRGAHRRS

SEQ ID NO: 11100 - protein, 81 aa, Mus musculus
AVTFRDVAVVFSEEELGLLDAAQRKLYHDVMLENFRNLLAVGGQSPNKMEIVDATGLRCLSLGQLLCWGETSHNINKLARA

SEQ ID NO: 11101 - protein, 81 aa, Dipodomys ordii
SQVSVTFEDVAVLFTRDEWRKLDPSQRSLYREVMLENYSNLASLGFPFTKPKVISVLQQGEDPWKVGKEGAGNTTLGWKHS

SEQ ID NO: 11102 - protein, 81 aa, Dipodomys ordii
PQLPESLEDMAVYISQEEWGHQDPRKKALSRDTGQESYENMDSLEACIPNQEALSTQMEQDGKPWDPSIQGCKEGMSSRSP

SEQ ID NO: 11103 - protein, 81 aa, Octodon degus
MKPAQRILYRDVMLENYSNLVTVGCEVTKPDVIFKLEQEEEPWVMEEEMFWRHFPEVWEVDEHIKKQQKTLVRKGTSVSKK

SEQ ID NO: 11104 - protein, 81 aa, Cricetulus griseus
PKVPMTFDDLAVYFSELEWATLEDWQKELYKHVMRDNYETLVSLDCAISKPDILNWIERGEEPFPAGPCGQGRGTEEEAAC

SEQ ID NO: 11105 - protein, 81 aa, Peromyscus maniculatus
VVGLVSFEDVSVDFTWEEWQDLDDAQRKLYRDVMLETYSSLLSLNQCDAKPELILKLEQGAGPWKEEDAPNQRLPAMENVK

SEQ ID NO: 11106 - protein, 81 aa, Peromyscus maniculatus
EMGLVSFEDIAVEFTWQEWQDLNESQRTLYRDVMLENYKNLLFLGHCKTKPELIFNLEHRLGSWIVGEASDQSIPDSQEMN

SEQ ID NO: 11107 - protein, 81 aa, Cricetulus griseus
VKQFSFQSLLTFKDLAINFSKEEWEYLNTSQKDLYKDVMLENYSNLVSVGLSESKPELVTCLEQNKEPCMVNIVEAEGLEP

SEQ ID NO: 11108 - protein, 81 aa, Mesocricetus auratus
QGLLTFGDVALDFSQEEWECLDSSQRALYIDVMLENYSNLVSVENHGMRGKPKKVLNQDSSHNVHQHGNTQENSYKSNQLD

SEQ ID NO: 11109 - protein, 81 aa, Mesocricetus auratus
FVTLKDTAMDFTLEDWEELELELNKRDPFWDLTLSNCQDLFLLNPPKPSLVSQPDIREELEATVRGGGLEATDTEVTETKS

SEQ ID NO: 11110 - protein, 81 aa, Mesocricetus auratus
MLENYSNLLSVAGLHIPKPQVISLLEQGKEPWMIGKELTRGLCSALESMCESKLLSLKKEVYEIESCQRELMGLKKHGLEY

SEQ ID NO: 11111 - protein, 81 aa, Mus caroli
MLSFRDVAIDFSPEERDCLGPAQWDLYRDVMLENFSHLVFLGLAVAKPYLVTFLEQNQGSSRVKSHAAAAIPGTTGNEFNN

SEQ ID NO: 11112 - protein, 81 aa, Mus caroli
MAHVMTFRDVAVDFSPEEWECLSLDQKSLYRDVMLENYSHLVSVGLCIYQPHGFPVQEKKQDACMDLGNEPNRFCPATDSG

SEQ ID NO: 11113 - protein, 81 aa, Mus caroli
PSRTVTFKDVAVDLTQEEWQQMKPAQRDLYRDVMLETYSNLVTVGCQVTKPDVIFKLEQAEEPWVLEEEMFWRRSPEAARG

SEQ ID NO: 11114 - protein, 81 aa, Mus musculus
PVTFEDVAVNFSLGEWALLDSYQKKLYRDVMMETFMNLISIGKTEEESMDVNYPQLQRNSRIQVVEKFCDYEHSSQCGKTH

SEQ ID NO: 11115 - protein, 81 aa, Mus caroli
PQESVTFKDVAVNFTQEEWHHVGPAQRSLYRDVMLENYSHLVSLGYQVSKPEVIFKLEQGEEPWISEKETQRPFCADWKTR

SEQ ID NO: 11116 - protein, 81 aa, Mus musculus
NQGESCVSLEDVCLRFTAEEWGLLDDTQKLLYHNVMLENFLLVLSLGLPISKSFPGTRVYPSWPYLLQKDKHMTSGPSINI

SEQ ID NO: 11117 - protein, 81 aa, Mus musculus
PQGLLTFKDVALDFSLEEWECLNFAQRRLYMDVMLENYNNLLFVENHCIRGKNGKVLDQDSQYIVHEHMNIQEKSSKWDKL

SEQ ID NO: 11118 - protein, 81 aa, Mus musculus
QCLLTFKDVFLDFSSEEWECLNFAQRTLYMDVMLENYNNLLFVENHCICGNYEKEKVLEQDTQHIFNEHGHIQEKSFKCNE

SEQ ID NO: 11119 - protein, 81 aa, Cavia porcellus
HAQGRVTFGDVAVDFSWEEWKLLDETQRLLYLDVMLENIALVASLGLISSRIHVVQLEVGKQTRLPDTADFTPAILRSTGS

SEQ ID NO: 11120 - protein, 81 aa, Cavia porcellus
GSLLFEDVSVTFTQKEWQLLDSSQRRLYRDMMLENYRHLESLGLCVTKPELICRLERGEEPWIPKMGHGLLEGSADQGTAG

SEQ ID NO: 11121 - protein, 81 aa, Cavia porcellus
MLENYRNLVWLGLSISKPNMISLLEQGKEPWMVQRELSRGHCTDWGSWCEMKELSSEWFTDEEEIPPGMVMRRIRSRSLQC

SEQ ID NO: 11122 - protein, 81 aa, Cavia porcellus
TARSQETMTLKDVAMDFTPEEWGKLDPAQRDVMLENYRNLVSLWLPVSKPENYSLDNGKEPLRFERKAPKRSYSDMETIPE

SEQ ID NO: 11123 - protein, 81 aa, Cricetulus griseus
PQGLLTFRNVSVDFSQEEWECLDSSQRALYMDVMWENYSNLVFVENHCICGKNEIVLNQGSKHIVHEDVKTQEKSHSCHEL

SEQ ID NO: 11124 - protein, 81 aa, Cricetulus griseus
RPRALKFADVAVYFSSEEWGCLRPAQRTLYRDVMRETYGLLGALGCAGPKPALISWLERNTDDWEPAALDPQEYRRWVTFQ

SEQ ID NO: 11125 - protein, 81 aa, Cricetulus griseus
REKVAFEDVAVNFTSGEWALLDSFQKKLYRDVMKETFLNLISIEETVEENIGEDCKDLSRSTTQVIKEDYGYGCDHKCDKT

SEQ ID NO: 11126 - protein, 81 aa, Cricetulus griseus
IRGLVTIKDVSLCFSQEEWRSLDPSQTDFYGEYVMQENCGIVVSLRFPIPKLDMLSQLEGGEEQWVPDHQDLEGRDILKVT

SEQ ID NO: 11127 - protein, 81 aa, Cricetulus griseus
PAALEAPRDVAVDFSQEEWECLDSGQRALCIDVMLENYSNLVFVEKYQKSDPVRHHVKTEKESCQCNELGKVLHDPSTCSH

SEQ ID NO: 11128 - protein, 81 aa, Cricetulus griseus
GNQFCFQSLLTFKDVAINFSKEEWECLHTSQKDLYRDVMLENYSNLVSVGLSESKPELVTCLEENKEPWMVNIDEAEGLGQ

SEQ ID NO: 11129 - protein, 81 aa, Cricetulus griseus
LQGSVSFEDVSVDFTQEEWNQLDPTQRSLYRDVMLENYSHLVSLGYPITKPEVITSLEQGMLGTIKREISSSSCTEDGQAE

SEQ ID NO: 11130 - protein, 81 aa, Cricetulus griseus
MLSFWDVAIEFSPEERECLDPAQWSLYRDVMLENYSNLLFLGLAVPKPHLVTFLEQRQESSGVKRQAAATVHPGRIPNDYN

SEQ ID NO: 11131 - protein, 81 aa, Cricetulus griseus
KNVLSYEDVHIHFTCEEWTLLDTSQKNIYKDVMLETYKNLNDIGKVAKLQRRLRYIHNLLQPLHIRVVLKAIKKTHTGGKP

SEQ ID NO: 11132 - protein, 81 aa, Cricetulus griseus
FQGLLTFSDVTVYFTKDEWECLDCAQRALYIDVILENYSNLLSVENYYKCDPVHQHVKTEKESCQCNEPGKVLHDPSTCAL

SEQ ID NO: 11133 - protein, 81 aa, Ictidomys tridecemlineatus
SQASVSFKDVTVELSPEEWQHMGPAQRTLYREVMLENYSHLVSVGFCFPKPELIFTLEQGEDPWSLEKEKGFLNWSSPEDS

SEQ ID NO: 11134 - protein, 81 aa, Octodon degus
FQAKVTFEDVAVFLSQEEWDRLGPAERGLYRNVMMETYGNVVSLGLPGSKPNVICQLERGEDPWVPYEHGAPESRGLGSGC

SEQ ID NO: 11135 - protein, 81 aa, Peromyscus maniculatus
MQGLLTFGDVAVDFPQEEWECLDSAQRALYIDVMLENYSNLVSVENYCKCDPVHQHVTNEKEYSQYNKLDKVLHDPSTSTL

SEQ ID NO: 11136 - protein, 81 aa, Peromyscus maniculatus
LQEVVTFRDVAVEFSEEEWKWMEPAQRDLYRDVTLENFSHLLSLGLVLSKPDVIFLLEQGKEPWLVTNYMTRPWHPDLESK

SEQ ID NO: 11137 - protein, 81 aa, Heterocephalus glaber
GWVPALFDEVAIYFSDEEWEVLTEQQKALYREVMRMNYETVLSLEFPFPKPDMISRLEREEESHNSDEWQLQKGTFAENED

SEQ ID NO: 11138 - protein, 81 aa, Peromyscus maniculatus
EMGSVSFEDVAVDFTRQEWQDLDAAQRTLYRDVMLENYSSLVFVGHCTTKPELIFKLEHGFGLWSKAEASVWNFPDVQKVC

SEQ ID NO: 11139 - protein, 81 aa, Rattus norvegicus
PQAKVTFEDVAVLLSQEEWARLGPAQRGLYRNVMMETYGNVVSLGLPGSKPVVISQLERGEDPWVLDGQETELSQGLGSDH

SEQ ID NO: 11140 - protein, 81 aa, Rattus norvegicus
ARGLMAFEDVAVYFSQEEWMFLNAAQRALYRHVMLENFALVDSIGPSVSRPRVIIQLQRGEEPWVPNRTIAGPGRGTHRRS

SEQ ID NO: 11141 - protein, 81 aa, Rattus norvegicus
VSFEDLVVHFTQDEWDLLEASQKSLYGDVMLETFRNLTDTGYEWEDQKIEDHCEDPEINLRDIVSHSEYTREYEHEEYEEK

SEQ ID NO: 11142 - protein, 81 aa, Rattus norvegicus
EMGLVSFEDIAVEFTWQEWQDLNEGQRTLYRDVMLENYSNLLFLGHCKTKPELIFNLEQRLGSWIVEASHQSIPDFQKVNT

SEQ ID NO: 11143 - protein, 81 aa, Octodon degus
CSWKPLTFTDVAVMFSPEEWVFLDSAQRSLYRDVMLENYSNLASIDQLCKTSTVSYMEKREELWSIKRGIFSEPQLQPQES

SEQ ID NO: 11144 - protein, 81 aa, Octodon degus
PQEPVTFEDVAVTFSPEQWASLESGQRSLYRRVMLDNYALVAALAASPACKPALIARLERGEALWNSEALGSGLPGAGNWV

SEQ ID NO: 11145 - protein, 81 aa, Peromyscus maniculatus
FRESVTFKDVVVNFTQEEWKHLDPTQRDLFRDVTLENYTHLVSIGLQVSKPDVISQLEQGTEPWTEESCIPIASVEDWKIR

SEQ ID NO: 11146 - protein, 81 aa, Peromyscus maniculatus
SQAPVTFEDMAMYLTREEWRPLDPTQRDLYRDVMQENYGNVVSLDFEIRSENEANSKPELSEDVEFVTMSEEPVGDAEKNP

SEQ ID NO: 11147 - protein, 81 aa, Mus musculus
VCGSVTFRDVAVDFSQEEWACLDATQKVLYRDMMLETYSNLVAVVGRCISKPDLIVLLEQEKEPWMAVKEETDRPSPDLEL

SEQ ID NO: 11148 - protein, 81 aa, Mus musculus
MLSFRDVAIDFSAEEWECLEPAQWHLYRDVMLENYSHLVFLELADSKPQLVTFLEQRQQSTGVKRQEVLQTPCRELWGRNP

SEQ ID NO: 11149 - protein, 81 aa, Mus caroli
SQVSVTFEDVAVLFTRDEWKKLVPSQRSLYREVMLENYSNLASLAGFPFTKPKVISLLQQGEDPWKVEEEGPGGFSLGLKC

SEQ ID NO: 11150 - protein, 81 aa, Mus musculus
PQGLLTFKDVALDFSLEEWESLSFAQRTLYMDVMLENYNNLLFVENHCICGKYEKVLDQDSQYIVHEHMNIQEKSSKWDKL

SEQ ID NO: 11151 - protein, 81 aa, Mus musculus
PQGLLTFKDVAVDFSQEEWECLDCAQRALYMDVMLENYNNLFFVENHYICHKYENFLDQDTQHIVHEDINIKLKSYKCHEL

SEQ ID NO: 11152 - protein, 81 aa, Mus musculus
DSTGCCERRLVKLRTPNMDLLTYDDVHVNFTQEEWALLDASQKSLYKGVMVETYRNLTAIGYSWEEHTIEDHFQTSRSLGR

SEQ ID NO: 11153 - protein, 81 aa, Cavia porcellus
TRLPLTFEDVAIYFLEEEWQDLEVWQKELYNDVMKTNYETFVSLGGALPKPELISWIEQGREPCRSWGESQHPGNVALSSA

SEQ ID NO: 11154 - protein, 81 aa, Cavia porcellus
VTFEDIAVYFSQEEWGLLDETQRFLYLDVMMENFELTTSLVCEHETKDGEALSTLKKVQPCDICVPVVKDILHLDDLPVQK

SEQ ID NO: 11155 - protein, 81 aa, Cricetulus griseus
PKVPVAFDDVSIYFSTPEWEKLEDWQKELYKNIMKGNCESLISMDYAMSQPDVLSQIQPEGEHSTDDQPRPEASEIPADAS

SEQ ID NO: 11156 - protein, 81 aa, Cricetulus griseus
FQGLVSFEDIAVVFTWEEWQELDAAQRTLYRDVMLENYSNLVFLELCTVKPKLIFNLEHGCGPWSLAEASVWSPPNVHKVS

SEQ ID NO: 11157 - protein, 81 aa, Cricetulus griseus
VQEPVTFRDVAVSFSQDEWLHLDSAQRSLYREVMLENYRNLASLGILFSKPKVISQLEQAEDFQMVESGMLRGVYLGWKSL

SEQ ID NO: 11158 - protein, 81 aa, Peromyscus maniculatus
NFWILRLPPGSKGEVPKEWAKLEDWQKELYKHVMRGNYETLVSLDYAISKPEVLSQIEQGKEPCTWRRTGPKVPEVPVDPS

SEQ ID NO: 11159 - protein, 81 aa, Peromyscus maniculatus
MASPSPLLEPKEWDYLDPARRSLYKDVMMDSYGNLVSLDVLNRNKNEEPTVKEEIEEDIDPPGVIVTRIKSEIDQDPIGRE

SEQ ID NO: 11160 - protein, 81 aa, Peromyscus maniculatus
FKGPVTLRDVTVEFTKAEWKLLTPAQKALYKNVMLENYRHLVAVGYRVVKRSVISKLKQGKEPWILEKELPNRNRAGAFEK

SEQ ID NO: 11161 - protein, 81 aa, Peromyscus maniculatus
ISVKAEPQIFEDVAMYFTEQELASLTLDQKALYKDVVLENFAHVAFLGIRLDGSNPACQPGSSVPVPGERHAESRRGRQIC

SEQ ID NO: 11162 - protein, 81 aa, Peromyscus maniculatus
PQVKVTFEDVAVLLSQEEWARLGPAQRGLYRNVMMETYGNVVSLGLPGSKPVVISQLERGEDPWVLDGQETEQSQGLGSGH

SEQ ID NO: 11163 - protein, 81 aa, Peromyscus maniculatus
VKGLVSFEDVSVDFTWEEWQDLDDAQRKLYRDVMLETYRSLESLGHCITKPEVIFKLEQGTGPWRVEEVPEQSRPDVQKVN

SEQ ID NO: 11164 - protein, 81 aa, Peromyscus maniculatus
EMEPVTFEDVAVNFTSGEWTLLDSSQRKLYRDVMKENFLNLISIEKTQEDVEEDYQNLRRNLGSQVVEKDGEYEHDSHCEK

SEQ ID NO: 11165 - protein, 81 aa, Peromyscus maniculatus
MEPLTFKDVAIDFSGEEWECLNFEQQTLYKDVMLENYRNLVFLGLAVSKPYLVTCLEQRKEPWNVKRQKTVLLFPALFPHY

SEQ ID NO: 11166 - protein, 81 aa, Peromyscus maniculatus
SQELVSFEDVAVDFTWEEWQELDAAQRTLYKDVMLENYSSLVSLGHCVNKPELIFKLEQGLGPWNVAEASDRNLPGLPMWT

SEQ ID NO: 11167 - protein, 81 aa, Peromyscus maniculatus
NAVTYDDVHVAFTWEEWTLLNPSQKNLYKDVMLETYRNLITIGYSRDEHNIEEHCKISRRQERNERSRTGQQPPEYPQCVK

SEQ ID NO: 11168 - protein, 81 aa, Peromyscus maniculatus
DCLTFEDVAVNFTLEEWDLLNPSQKQLYTDVMQETFKNLVAIGQTEEGQRIEEDEHFRRNLRNEVVELLYERSEGRQCEEI

SEQ ID NO: 11169 - protein, 81 aa, Peromyscus maniculatus
LNAVSYDDVHANFTWEEWTLLNPSQKNLHKDVMLETYRNLTTIGYNWEDYDTEEHCQSSRRHERVYHVSLWIQDISASGYG

SEQ ID NO: 11170 - protein, 81 aa, Peromyscus maniculatus
EMEPVTFDDVAVNFSPGEWALLDFSQKKLYRDVMTETFMNLISIGRTEENIEEECANVRSPLRTPVIERECKYGDGCQCGE

SEQ ID NO: 11171 - protein, 81 aa, Mesocricetus auratus
MEMLSFWDVAIEFSPEERKYLDPAQWNLYRDVMLENYSHLDFLGLAVPKPQLVTFLEQRQEPSEVERQAAATVHPGTRSKN

SEQ ID NO: 11172 - protein, 81 aa, Mesocricetus auratus
HGELLSFKDVSIDFSPEEWECLDPAQWNLYRNVMLENYRNLVSLGLTVCKPYLISLLEQGLAPWNVKRQESGTMYPENLCD

SEQ ID NO: 11173 - protein, 81 aa, Mesocricetus auratus
VKIEDVADVAVSFILEEWGHLDQSQKSLSRDGREENCESITPVDYESREGNSELIVRQISNGADSPWATAESPEKNGAQSQ

SEQ ID NO: 11174 - protein, 81 aa, Mesocricetus auratus
MLENYSSLVSLGHCVSKPELIFRLEHGFGPWSIGETSLWNLPGVLEVPALDKSYLENPESPVWPVGRISRNLSNREMLEAE

SEQ ID NO: 11175 - protein, 81 aa, Rattus norvegicus
MLENYSNLVFLGLASSKPYLITLLEQIKEPSDMKKREAITLHPGGKCYMCEECGQVFEWKKVLQNHQKIHLRAKPYKCEEC

SEQ ID NO: 11176 - protein, 81 aa, Mesocricetus auratus
TQGLVTFEDVAVYFSLEEWERLDVEQRDLYREVMQENYGILVSLGYPIPKPDLIFHLEQGEEPWVPDSPHPEEGDIVTGVY

SEQ ID NO: 11177 - protein, 81 aa, Mus musculus
PQTQITFKDVAVDFSQEEWECLDCAQRALYMDVMLENYNNLFFVENHCMCPKFEDMLDQDLQHIVHEHVNIQVKSYECHEL

SEQ ID NO: 11178 - protein, 81 aa, Mus musculus
VCGSVTFRDVAVDFSQEEWACLDATQKVLYRDMMLETYSNLVSVVGSCISKPDLIVLLEQEKEPWMAVKEETDRPSPDLET

SEQ ID NO: 11179 - protein, 81 aa, Cavia porcellus
LTGLMTFEDVAVYFSLEEWERLDADQRGLYQEVMQENYGILVSLGYPVPKPDLIFRLEHGEEPWVPDSPHPEEGDIVTGVY

SEQ ID NO: 11180 - protein, 81 aa, Cavia porcellus
LEGSVSFEDVAVDFSQQEWYQLDPAQRTMHKDVMLETYSNLASVGLCMVKPEMIFKLERGEELWILEEESSGHGYAESLSV

SEQ ID NO: 11181 - protein, 81 aa, Cavia porcellus
LQESFSFDDLSVDFTQKEWQLLEPHQKNLYRDVMLENYSSLVSLGYIVMKPDVIFKLEQGEEPWSRDEVQHSNCSEVWQVE

SEQ ID NO: 11182 - protein, 81 aa, Cavia porcellus
ALTLVSFEDVAVTFTAEEWRHLDLAQRSLYQEVTLQTCELLVSLGHPVPKAELMCLLEYGQRLWMMKRALLQHTCTGQKAK

SEQ ID NO: 11183 - protein, 81 aa, Cavia porcellus
PQAKVTFEDVAVFLSQEEWDRLGPAQRGLYRNVMMETYGNVVSVGLPGSKPNVICQLERGEDPWVLDEHGTTKSQGLGSDC

SEQ ID NO: 11184 - protein, 81 aa, Cricetulus griseus
SQESLTFKDVAVDLSPEEWGQLTPAYRDLYREVMLENYRNLVSVGYQLSKPSVISQLEKGEGPWMAESQGPEDPMIGVKNK

SEQ ID NO: 11185 - protein, 81 aa, Cricetulus griseus
TQGLVTFEDVAVYFSVEEWERLDVEQRDLYREVMQENYGILVSLGYPIPKPDLIFHLEQGEEPWVPDSPHPEEGDIVTGVY

SEQ ID NO: 11186 - protein, 81 aa, Cricetulus griseus
GNQFSFQSLVTFKDVAINFSKEEWECLHTSQKDLYRDVMLENYGNLVSVGLSESKPELVTCLEENKEPWMVNLDEAEDLEQ

SEQ ID NO: 11187 - protein, 81 aa, Cricetulus griseus
PQGLLTFWDVAVDLSQEEWECLDSAQRTLYVDVMLENYSNLVFVDNHHMCVEYKKDLHHGSKDIVHDYMNLQEKPFKCIEL

SEQ ID NO: 11188 - protein, 81 aa, Cricetulus griseus
FQGLVTFSDVTVTFSKEEWECMDSAQWNLYTDVMLENYNNLMFVENYYKCDPVHQLMETEKESCQYNELGKVFHDPSTCAL

SEQ ID NO: 11189 - protein, 81 aa, Cricetulus griseus
MGPVSFKDVTVDFTQEEWQHLDPDQKALYRDVMLENYCHFVSVGFPITKPDMIRKLEQGKELWTERIFPSQSYLEEKPYQC

SEQ ID NO: 11190 - protein, 81 aa, Cricetulus griseus
AVTFKDVALVFTREELRLLDPTQKQLYQDVMLETFKNLIAVGGRDQREAATLRRTALKPLAQEELCCWHIWKQVAQKSSRC

SEQ ID NO: 11191 - protein, 81 aa, Cricetulus griseus
VTFHDVAVDFSQDEWQLLGPMQRNEYCDVMLETLGNLVSVGWQPTSGKQELTPESPTSVAEPVHIPKPKDFSRNDTQSTVS

SEQ ID NO: 11192 - protein, 81 aa, Cricetulus griseus
MSFLGLLTFRDVAVDFQQEEWECLDSTQRALCIDVMLENYSNLVSVGKNILFVEFLNCLFKRKMSITGKSNLKSSIFTYIK

SEQ ID NO: 11193 - protein, 81 aa, Cricetulus griseus
FQGVLTFRDVAVDFSQEEWECLDSGQRALCIDVMLENYSNLDFVENYRKCDPVHQHVKTEKESCQCNELGKVLHDPSTCAL

SEQ ID NO: 11194 - protein, 81 aa, Cricetulus griseus
YQVSKPEVIFKLEQGEEPWISEREIQRPFCPDWKTRPDTKSLGIQRGKSEVSHSTNVLSHAILGDIWDASIQKHQEGWKRH

SEQ ID NO: 11195 - protein, 81 aa, Cricetulus griseus
KVPVTFVDIAVYFSEDEWKNLDEWQKELYSNLVKENYKTLMSLDSDGPVSKPDAPVQAEPREEPCVWEQHHPEEREIPVAA

SEQ ID NO: 11196 - protein, 81 aa, Peromyscus maniculatus
FQNSLTYDDVHINFTCEEWALLDASQKRLYKDVMLETYSNLTAIGYKWEDHNIEEHCQRFRRRGRHKRSRTEERPYECKQC

SEQ ID NO: 11197 - protein, 81 aa, Peromyscus maniculatus
PQSLLSFRDVAIDLSMEEWECLDFAQRALYMDVMLENYYNLVFVENHRICDKYENVLDQGTKPIFCDHVNIQGKLFQCNEL

SEQ ID NO: 11198 - protein, 81 aa, Peromyscus maniculatus
PQGLLSFRDVAVDISQEEWEYLDCAQKALYMDVMLENYNNLLFVENHFICGKYEKVLHQDTKHFIHDHENVKEKSYKCNEL

SEQ ID NO: 11199 - protein, 81 aa, Peromyscus maniculatus
LQEMLSFRDVAIDFSAEEWECLGPAQWSLYRDVMLENYSNLVFLGLAFSKPYLVTFLEQRQEPSDVKRQAAAIQTDIKPYK

SEQ ID NO: 11200 - protein, 81 aa, Peromyscus maniculatus
MLENWKNLVSLGHHLDKPNLISQLEQEDKAIIEERGSIPGICPDLETVLKAKWLTPKEHVFSKEDANGGKTVKLEERDHHG

SEQ ID NO: 11201 - protein, 81 aa, Peromyscus maniculatus
MNAVTYDDVHVDFTQEEWALLDPSQKNLYKDVMIETYRNLTTIGYSWEDNNIEEHCQSSRRHGRHERNHTGVKSCGYTQSG

SEQ ID NO: 11202 - protein, 81 aa, Peromyscus maniculatus
GLLTFRDVAVDFPQEEWEYLDSAQKALYIDVMLENYNNLVFVENHCKCDPVHQHVKTEKESCRCNELVKVLHDLSTCALYK

SEQ ID NO: 11203 - protein, 81 aa, Peromyscus maniculatus
DAVTYEDVHVNFTHEEWALLDPSQKSLYKDVMLETYWNLTSIGYKWEDHNFEENCQSSRRHGRHINCPSGYKPCEHEEYGK

SEQ ID NO: 11204 - protein, 81 aa, Mesocricetus auratus
MLSFWDVAIDFSPEEWECLEPAQWNLYRDVMLENYSHLDSLGLAVSKPFLVTFLEQRQGPWDVKIQAEAPVHPGTIPSDCN

SEQ ID NO: 11205 - protein, 81 aa, Mesocricetus auratus
MEKRGMALDQAKHKEEWECLGPAQRDLYRDVMLENYSNLLSVAGLHIPKPQVISLLEQGKEPWMIGKELTRGLCSALESMC

SEQ ID NO: 11206 - protein, 81 aa, Mesocricetus auratus
WSHMPVTFEDVALYLSKEEWGRLDHTQQNFYRDVLQEENGLALGFPCSRPFRVPRVQGKGEMTSPSRSAGAERRGLGSGVV

SEQ ID NO: 11207 - protein, 81 aa, Mesocricetus auratus
AAGSVSFEDVAVDFTWREWQGLDAAQRILYKDVMLETYSSLVFVGHCTTKPELIFKLEQGFGPWCKAEASVWNVRACVPIE

SEQ ID NO: 11208 - protein, 81 aa, Mesocricetus auratus
SEGLVTFEDVSVDFTWEEWQNLDDAQRKLYRDVMLETYSSLLSLNQCDPKPELILKLEQEAGPWKEEDIPNQSLPDMQHVN

SEQ ID NO: 11209 - protein, 81 aa, Mesocricetus auratus
MEKVVFEDVAVNFTSGEWALLDSSQKKLYRDVMKETYLNLIFIEKAVEKNIGEDCKHLIRNTRTQAIDKDCGYACDHDCDK

SEQ ID NO: 11210 - protein, 81 aa, Mesocricetus auratus
TVDESGLKLPASRVLGLKDTVTYEDVHVNLTHEEWALLDPSQKSLYKDVMLETYWNLTSIGYKWEDQNIEEHCQSSRRHER

SEQ ID NO: 11211 - protein, 81 aa, Mesocricetus auratus
SQDLLTFGDVSLDFSQEEWECLESASKALYIDVMLENYRNLVFVEKYHMYVKNMNILDQGSKHIVYHPVNIQEKSYENSEI

SEQ ID NO: 11212 - protein, 81 aa, Mesocricetus auratus
HMGLLTFQDVAVDFTQEEWECLDSAQRTLYIDVMLENYSNLVSLGIISCKADLVPCLEQIQMACNVKKEEMVARPGFVDSD

SEQ ID NO: 11213 - protein, 81 aa, Mesocricetus auratus
GSVSFTDVTVDFTQEEWEQLDPSQRILYMDVMLENYSNLLSVEVWRADDHVEKNPRDPDEQARPLTTLKNQPPVEERGNLF

SEQ ID NO: 11214 - protein, 81 aa, Ictidomys tridecemlineatus
TARSQEKMTFKDVAMDFTPEEWGKLDPKQRDMMLENYRNLVSLWLPVSKPENYNLDSGKEPLKLERKTPKCSYSDVETLPE

SEQ ID NO: 11215 - protein, 81 aa, Mesocricetus auratus
MNTVTYDDVHVNFTWEEWTLLDPSQKNLYKDVMLETYRNLTAVGYSWEDHNVEEHCQSYRRHSRLERSHTGEKSSVHTQCV

SEQ ID NO: 11216 - protein, 81 aa, Ictidomys tridecemlineatus
MITNYETLLSLDDRLSKPELISWIEQEEEPFKSWGESQEPRNMIHSADMYFDPYIEGEFFGGSQETVKSGETKCHFQFSPL

SEQ ID NO: 11217 - protein, 81 aa, Ictidomys tridecemlineatus
SQEAVTFEDVAVYFTQNQWASLEPAQKALYQEVMLENYANITSLAALPFPKPDLIFQLELGEAPWVPDSWRPVGEEALGGR

SEQ ID NO: 11218 - protein, 81 aa, Ictidomys tridecemlineatus
MFENYRNLAWLGLSISKPNMISLLEQGKEPWMVERKMSHDQCADWESWCEMKELSPKLFIDEEEISQCMVTERLTSHGLEC

SEQ ID NO: 11219 - protein, 81 aa, Ictidomys tridecemlineatus
SQGPVLFEDVSVDFTQKEWQLLDPAQRRLYRDVMLENYRHLESLGHCVTKPELIRRLEQGEEPWILKREVPSHSHAEVQRA

SEQ ID NO: 11220 - protein, 81 aa, Marmota monax
MFEEVSVCFTSEEWACLGPIQRALYWDVMLENYGNVTSLEWETMTENEEVTSKPNISQRADAQKGISKRLQGSVSQVPGFE

SEQ ID NO: 11221 - protein, 81 aa, Marmota monax
VQEPVTFEDVAVDFTQEEWGQLDLVQRTLYRDVMLETYGHLLSVGNQMAKPEVISLLEQGEEPWLVEQTCPESSCPEWMRD

SEQ ID NO: 11222 - protein, 81 aa, Marmota monax
SKAPVTFGDLAIYFSQEEWEWLSPIQKDLYEDVMLENYTNLVSLGLSSRRPNVIALLEKGKAPWMVEPPRRRQGPDSRSKC

SEQ ID NO: 11223 - protein, 81 aa, Peromyscus maniculatus
SQNLLTFRDVTIDFHQEEWECLDFAQRALYIDVMVENYNNMVFVENYCKCDPVHQQVKTEKESYQCNELGKVLHDPSICAL

SEQ ID NO: 11224 - protein, 81 aa, Peromyscus maniculatus
SQDLVTFEDVAVYFIWKEWKRLEPAQRDLYRDVMLENYGNVFSLDGESKTGNDQILSEGMGSHEMILGRLQTDVSQGLKFE

SEQ ID NO: 11225 - protein, 81 aa, Peromyscus maniculatus
VSFEDLAVNFTQEEWDLLDPSQKILYGDVMLETCRNFTAIGYEWEDHTIEDHHEEPEINLRHIISHSEYTQYEPEDCEQKP

SEQ ID NO: 11226 - protein, 81 aa, Rattus norvegicus
WFQDLKFEDVVIYFSLEEWECLHHSHRNLYRAVMLDNYSNLLSLSLANMKPRVVSLLEQGKEPWMVMRNGTKVWCADWESK

SEQ ID NO: 11227 - protein, 81 aa, Rattus norvegicus
MEEMLSFWDVAIDFSPEEWECLEPVQWNLYRDVMLENYSNFVFLGLTFSKPFLVTFLEQGQGPWDMQRQAAAAVHPGIALN

SEQ ID NO: 11228 - protein, 81 aa, Mesocricetus auratus
PQESVTFKDVAVDFTQEEWHHVDPAQRSLYRDVMLENYSHLVSLGYQVSKPEVIFKLEQGEEPWISEREIQRPFCPDWKTR

SEQ ID NO: 11229 - protein, 81 aa, Mesocricetus auratus
METVTFEDVAVDFTLEEWALLDSSQKKLYRDVMKETFFNLISIEKTLEENTEEDYQDLRRNMRSPVLEEDCGYECDTECDK

SEQ ID NO: 11230 - protein, 81 aa, Mus caroli
SKNLLTFEDVSVNFTQEEWQWLSDTQRNLYRKVTLENYRSLVSLAGIPVYKPAVISLLEQGKDPWMVQKKGARDTCPDWEY

SEQ ID NO: 11231 - protein, 81 aa, Mus caroli
CQALVTFEDVAVTFTDDEWKRLVPVQRALYKAVMLENYESIISLGLPVPRPDLILQFKRRGEPWMRGFHGSEEKAWPESVS

SEQ ID NO: 11232 - protein, 81 aa, Mus caroli
YQDSVTFDDVAVEFTPDEWTLLDLTQKNLYREVMLENYENLTSVGCQLFIPSLTPWLKQEEPEAESAVPQQLELQPTIDDS

SEQ ID NO: 11233 - protein, 81 aa, Mus caroli
CERWMSFEDVTVNFSQEEWQQLDSAQRHLYQEVMLEIYSHLLAVGYSIPSPGVIFRMEKGKEAQTAKAEFPGQRCQEKSGN

SEQ ID NO: 11234 - protein, 81 aa, Mus caroli
GSVSFTDVTVDFTQEEWEQLDPSQRILYMDVMLENYSNLLSVEVWKADDEVEKDPRDLQRQAGSLTAIKSQPPTEERGSLS

SEQ ID NO: 11235 - protein, 81 aa, Cavia porcellus
SVTFEDVAVYFSWEEWDLLDEAQRHLYLEVMLENLALMSSLGCSCGVDDEVAPSELGLYVDLSRVMTLKEGLSSQNAYTYE

SEQ ID NO: 11236 - protein, 81 aa, Cricetulus griseus
QGVLTFRDVAVDFSQEEWECLGSAQRALCIDVMLENYSNLVFVENYCKCVPGHQYVKIEKESCQCNVFGKVLHDPSTCALY

SEQ ID NO: 11237 - protein, 81 aa, Cricetulus griseus
EKQFSFQSLLTFEDVAINFSKEEWECLNTSQRDLYRGFLLKNYSNLVSVGHSESKPELVTCLEQNKEPWKVNIEEAERLEP

SEQ ID NO: 11238 - protein, 81 aa, Cricetulus griseus
FWGLLTFRDVTVDFSQEEWQCLDSAQRTLYIDVTLENYNNLLCVENYCICDPVHHHVKTEKESHQCNELGKVLHDPSTCAL

SEQ ID NO: 11239 - protein, 81 aa, Cricetulus griseus
QQEMVTFKDVAVVFSKEELVLLDAAQRKLYRDVMLDTFRTLLSVAHEPFKPGLIAQLENEEKLCMVEAQAGGNDASGSAGS

SEQ ID NO: 11240 - protein, 81 aa, Cricetulus griseus
SQGLLTFKDVTVDISQEEWVCLDSAQRALYIDVMLENYSNLIFAENYCKCDPVHQHVKTEKESCQCNELGKVLHDPSTCAL

SEQ ID NO: 11241 - protein, 81 aa, Cricetulus griseus
MLENFSNLVFLGLASSKPYLVTFLEQSQGSNDMKRQGSAAMQTVLCVHKRSHTGEKPYICEVCDKDFHAASLLKAQARIHT

SEQ ID NO: 11242 - protein, 81 aa, Cricetulus griseus
SQEQVSFKDVCVDFTKEEWYLLDPAQKGLYRDVTLENYSNFVSVGYCVTKPDVIFKIEQGEDPWIPENGFQCHPERKWKAD

SEQ ID NO: 11243 - protein, 81 aa, Cricetulus griseus
EMEPVTFEDVAVNFSPGEWAFLDSSQKKLYRDVMTEIFMNLISIGKTEENIEEECANDRNLRTQVVERDCKYGDACQCEAH

SEQ ID NO: 11244 - protein, 81 aa, Cricetulus griseus
PKGTVTFKDVAIDFTPEEWKQLDPIQRNLYRNVMLENYNNLITVGSPLTKPDVIFKLEQEEEPCIVEKEMVKRHSPGEIWG

SEQ ID NO: 11245 - protein, 81 aa, Cricetulus griseus
PVTFEDVAVDFTVGEWALLDSTQKKLYSTVMEETFLNLISIGKALKENIEEDRKELSGNMGAQVTEKACGYECASRCNTNQ

SEQ ID NO: 11246 - protein, 81 aa, Castor canadensis
LQEQVSFKDVCVDFTKEEWCLLDPTQKILYRDVILENYSNLTSVGYCVTKPDVIFKIEQGEEPWILEKGFPSQCHPERKWK

SEQ ID NO: 11247 - protein, 81 aa, Peromyscus maniculatus
MLSFWDVAIEFSAEERECLEPAQWNLYRDVMLENYSNLVFLGTTPNDYNIYKKAIDCKSLYIPHQRIHTREKPYKCEECGK

SEQ ID NO: 11248 - protein, 81 aa, Peromyscus maniculatus
SQGLVTIKDVSLCFSQEEWRSLDPSQTDFYGEYVMQENCGIVVSLRFPIPKLDMLSQLEGGEEQWVPDPQDLEGRDILKVT

SEQ ID NO: 11249 - protein, 81 aa, Peromyscus maniculatus
IVVHMAFRDVAVDFSQEEWSLLNPAQRSLYKEVMLENYSNLVSLGIPFSKPKLITQLEQGKETWQEERTCPQVACQAQAKR

SEQ ID NO: 11250 - protein, 81 aa, Peromyscus maniculatus
PKVPVAFDDVSIYFSTPEWEKLEEWQKELYKNIMKGNYESLISMDYAMNQPDVLSQIQPGEHSTDDQPRPEASEIPADASE

SEQ ID NO: 11251 - protein, 81 aa, Peromyscus maniculatus
QQGCVTFEDVAICFSREEWRLLDKTQRLLYLNVTLQNFALINSLGCGHRTEDEEQRVSTRASWVWRSETTLSPPKTHLCEK

SEQ ID NO: 11252 - protein, 81 aa, Peromyscus maniculatus
MDAVTYEDVHVNFTHEEWALLDPSQKSLYKDVMLETYWNLTSIGYKWEDYNIEEYYQGSRRHGRYINCQCSYNSCEHKGYG

SEQ ID NO: 11253 - protein, 81 aa, Peromyscus maniculatus
MEEWALLSPSQKKLYRDVMQETFRNLAAIGMEQEDQNFEKDYRCSQRNPKSQMGKSLCEHNEDNQCVENFSWILDPTLYKD

SEQ ID NO: 11254 - protein, 81 aa, Peromyscus maniculatus
EQDAVTYEDVHVNFTHEEWALLDPSQKSLYKDVMMETYWNLTCIGYKWEDHNIEEHCQSCRRNGSRCVICHSGHNPCEHKG

SEQ ID NO: 11255 - protein, 81 aa, Peromyscus maniculatus
EAVTYEDVHVNFTHEEWALLDPSQKHLYKDVMLETYWNLTCIGYKWEDHNIEEHCQSCRRNGRCVICHSGHNPCEHKGHGK

SEQ ID NO: 11256 - protein, 81 aa, Peromyscus maniculatus
MEDMLSFWDVAIYFSAEEWECLGPAQWNLYRDVMLENFSNLVFLGLTSCKPYLVTFLEQRQEPSDVRTQGAAATQAGKKCY

SEQ ID NO: 11257 - protein, 81 aa, Peromyscus maniculatus
MDPSQRNLYKDVMVETYMNLTAIGYNWEDLEVEEHCQNSLKHGRQERPHTTEKSCEYMGCGKAFVCHSHPQRHEKTQTGEK

SEQ ID NO: 11258 - protein, 81 aa, Peromyscus maniculatus
MEELLSFTDVAINFSVEECECLEPAQWNLYKEVMLENYSNLVFLGLVFSKPYLVTFLEQNTEPWIVKRKAPAASRPGSKPH

SEQ ID NO: 11259 - protein, 81 aa, Peromyscus maniculatus
EAVTFKDVAVVFSEEELGLLDAAQRKLYHDVMLENFRMLLSVGSRNLNEMESLQEAGWRHLPREELFCSRIWQQVTRELTQ

SEQ ID NO: 11260 - protein, 81 aa, Mesocricetus auratus
STNLLTFRDVSVDFSREEWECLDSAQRALYIDVMMENYSNLLSVENYYIHDRVHHHVKTEKESCQCDELDKVLHDPSTCAL

SEQ ID NO: 11261 - protein, 81 aa, Mesocricetus auratus
MVTFRDVAVDFSQEEWDCLTPSQRHLYSHVMLENYRILVSLGLCFSKPRVILLLEQGKEPWTVKTELTDSLSTEWESMYVT

SEQ ID NO: 11262 - protein, 81 aa, Mesocricetus auratus
LREDAVTYEDVHVNLTHEEWALLDPSQKSLYKDVMLETYWNLTSIGYKWEDDNIEEHSQSSRRHGRHIICHSGYKPCEYLG

SEQ ID NO: 11263 - protein, 81 aa, Mesocricetus auratus
MLENYSNLLSVGLHIPKPQVISLLEQGKEPWMIGKELTRGLCSALESMCESKLLSLKKEVYEIESCQRELMGLKKHGLEYS

SEQ ID NO: 11264 - protein, 81 aa, Mesocricetus auratus
MLENYSHLVSLGYPITKPKVITSLEQGILDIIKREIPSSSCTDDGQAEDCLEWHEKNQNAHLEQAISIVEKNVTEERSCEY

SEQ ID NO: 11265 - protein, 81 aa, Mesocricetus auratus
MSFEDVTVTFSEEEWQQLDSAQRRLYQDVMLEIYSHLLAVGFPIPSPGVVFRLEKGKEAQAGKVEFPGQQSQEKSGIDTSP

SEQ ID NO: 11266 - protein, 81 aa, Mesocricetus auratus
MEDMLSFWDVAIYFSAEEWECLGPAQWNLYREVILENYNNLVFLGLASSKPYLVTFLEQTAPDMKRQAAGTMQPGKEQYIG

SEQ ID NO: 11267 - protein, 81 aa, Peromyscus maniculatus
SKAPVTFGDLAIYFSQEEWEWLSPIQKDLYEDVMLENYQNLVLLGLACRRPNIITLLEKGKAPWVVEPSRRRRGPESGSKC

SEQ ID NO: 11268 - protein, 81 aa, Octodon degus
LQAHMAFRDVAVDFSQEEWRLLSPAQRSLYREVMLETYSHLVSLGIPFSKPKLITQLEQGKEMWREERKCPPAICPAEPKS

SEQ ID NO: 11269 - protein, 81 aa, Octodon degus
AQVQVTFRDVAVEFSQEEWESLDLTQRALCQEVIMENYRNLVSLGICLPNLNVICMLEHGKEPWTVENEMKIAKTPSGWEY

SEQ ID NO: 11270 - protein, 81 aa, Octodon degus
FKGPVTLKDVTVEFTKEEWKLLTPAQRTLYKDVMLENYRHLVSVGYRVNKSNVISKLKQGKEPWILEVEFPCRQSSENLRN

SEQ ID NO: 11271 - protein, 81 aa, Octodon degus
VSVSFTDVTVDFTQEEWEQLDPSQRILYMDVMLENYSNLLSVEVWKADDQMEREHRNPDEQARQFMILKNQTALEERGNLF

SEQ ID NO: 11272 - protein, 81 aa, Cricetulus griseus
GNQFCFQSLLTFKDVAINFSKEEWECLHTSQRNLYRDVMLENYSNLVSVGLSESKPELVTCLEENKEPWMVNIDEAEGLEQ

SEQ ID NO: 11273 - protein, 81 aa, Mus caroli
MLSFRDVAIDFSAGELECLEPAQWDLYRDVMLENFSHLVFLGFSFSKPLLVRFLEKNQELRNVKRKAAAVPRGKKLYKCKE

SEQ ID NO: 11274 - protein, 81 aa, Mus musculus
SQELVTFEDVAVYFIWREWKRLEPAQRDLYRDVMLENYGNVFSLDGDSKTGNDRVISEGMGSCEMILGRFQKDVSQGLKFE

SEQ ID NO: 11275 - protein, 81 aa, Mus musculus
MDLVTYDDVHVNFTQDEWALLDPSQKSLYKGVMLETYKNLTAIGYIWEEHTIEDHFQTSRSHGRHERSCSAEQPSEFIQCG

SEQ ID NO: 11276 - protein, 81 aa, Cavia porcellus
IQDLLTFRDVAIEFSQEEWKCLDPAQRTLYREVMLENYMNLVSLGISPFDQSVFSMLEQEAEPWSMDGQVKASRNSDRWEN

SEQ ID NO: 11277 - protein, 81 aa, Cavia porcellus
YQEFVTFEDVAVYLTREEWGCLDPVQRNLYREVMLENYGNVVSLGILLRLPTTRIHCVNSCPALSHTQASAFSGETLAVLS

SEQ ID NO: 11278 - protein, 81 aa, Cavia porcellus
SRGSVSFKDVTVDFTQEEWQHLDPKQKSLYRDVMLENYSHLVAVGYCVTKPELIVRLEQAKEPWILKEEFPRPSFQEFWKT

SEQ ID NO: 11279 - protein, 81 aa, Cavia porcellus
FQELLTFKDVTVDLSLEEWECLDSAQRNLYRDVMLENYRNLVFLGLAVSKPYLITLLEQSKKPWIVKCQKAAAMHSAMSYA

SEQ ID NO: 11280 - protein, 81 aa, Cavia porcellus
KQGQVNFEDVFVCFSQEEWELLDEAQRFLYRDVMLENFALMASLGCWRGEEDKKIPCEQSVSIKGVSQIRISRGSPSTQKA

SEQ ID NO: 11281 - protein, 81 aa, Cricetulus griseus
MDGLLSFRDVSVDLSQEEWECLDCVQRALYTDVMLENYSNLLFVENHRICGKHENVLHQGTNYCIHGHEYIQEKTNTCNEP

SEQ ID NO: 11282 - protein, 81 aa, Cricetulus griseus
RGTEPVTFRDVAVFFSQDEWLRLDSAQRSLYREVMLENYSNLASLGIQASIPRVIGKLQKGQDPCMEREDLEDTCLDFQIW

SEQ ID NO: 11283 - protein, 81 aa, Cavia porcellus
LQGMVSFEDVVVDFTWEEWKNLDDAQRTLYRDVMLETYSNLLSLGNCITKPDVIFKLEQEAQLWVVDKIPNQIFPDFKKTQ

SEQ ID NO: 11284 - protein, 81 aa, Cavia porcellus
QEIPVSFKDVVVGFTQEEWHWLNPVQRALYRDVMLETYSNLVSVGYEGTKPDVILRLEQEEAPWVCEAPCPGCCCWEDIWQ

SEQ ID NO: 11285 - protein, 81 aa, Peromyscus maniculatus
MLENYSHLVSLGCQVSKPEVIFKLEQGEEPWISEREIQRPFCPDWKTKPDTKSSSLQRGKSDVSHSTNILSYATLGDIWDD

SEQ ID NO: 11286 - protein, 81 aa, Peromyscus maniculatus
CQGVVTFGDVAVVFSREEWEWLSPEQRSLYWRVMLDNYSNLASLGLCASKPDMIALLEQGEDPWVTKRKRTGGRCPDLKAV

SEQ ID NO: 11287 - protein, 81 aa, Peromyscus maniculatus
MLENYSHLVSLGYPITKPDVITSLEQGVLGIIKREIPSSSCTEDGQTEDYLEWHQENQNIHLEQAVSIFEKNVTERSYEYD

SEQ ID NO: 11288 - protein, 81 aa, Peromyscus maniculatus
SQEALTFKDIAVDFSQEEWAQLAPAYRDLYREVMLENYRNLVSVGYRLSKPRVISQLEKGEGPWMAESQGPEDPIFDEKRK

SEQ ID NO: 11289 - protein, 81 aa, Peromyscus maniculatus
EKNGVTYDDVHVDFTWEEWALLDPSQKSLYKDVMLEIYRNLTDIGYSCEDHNIEEHCGSSRIHGRYERSHTEEKPSEYSHC

SEQ ID NO: 11290 - protein, 81 aa, Peromyscus maniculatus
FQGLLTFRDVAVNFPQEEWECLDSAQRALYIDVMLENYNNLVFVENYCKCDPVHQQVKTEKESYQCNELGKVLHDPSICAL

SEQ ID NO: 11291 - protein, 81 aa, Peromyscus maniculatus
MDAVTYEDVHVNFTQEEWALLDSSQKSLYKDVMLETYENLISVGYKWEDQNIEEHCQSSRRHGRYKPCEHKGYGKKQCTSL

SEQ ID NO: 11292 - protein, 81 aa, Peromyscus maniculatus
QGLLSFRNVDVDFSKEEWEYLDCAQRALYMDVMLENYNNLVFVVLAQHDLNPSTLDADARVYEYHRICHKYGKVLDQGTTH

SEQ ID NO: 11293 - protein, 81 aa, Peromyscus maniculatus
MLENYSNLVFLGLAFSKPYLVTFLEQRKEPWSVKRHAKVGAHAGSKSYKCKECGKTFDWKPLLIKHQSIHTGGKPYICKEC

SEQ ID NO: 11294 - protein, 81 aa, Peromyscus maniculatus
FWGLLSFKDVSVELSSEEWQLLDPAQQQMYREVTLENYSNLLSVGYLDTKPELIFKLEQGKEPWVINAKMSTQSCPEGWKK

SEQ ID NO: 11295 - protein, 81 aa, Peromyscus maniculatus
QEPVTFEDVAVNFTLEEWALLDSSQKKLYSTVMKETFLNLISIEKALEEKTEEDYKDISRNMGIRVIEKDCEYECDSNCDK

SEQ ID NO: 11296 - protein, 81 aa, Ictidomys tridecemlineatus
SRSLENDGVCFSEQEWENLEDWQKELYRNVMESNYETLVSLKVLGQPEGEADLGTEMLGDLEEEGPDAAHPVDGAVVKQEV

SEQ ID NO: 11297 - protein, 81 aa, Ictidomys tridecemlineatus
LQGPVSFKDVAVDFTQEEWQQLDPEEKMTYRDVMLENYSNLVSVGYDVTKPNVIIKLEQGEEPWTIEDDFPSQSHSEVWEI

SEQ ID NO: 11298 - protein, 81 aa, Dipodomys ordii
YQEFVTFEDVAVHLTREEWGCLDPVQRDLYREVMLENYGNVVSLGFPISKPDEITPLEQDLQVFDPETKDREVLRDDCSDG

SEQ ID NO: 11299 - protein, 81 aa, Rattus norvegicus
PKVPVAFDDVSIYFSTPEWEKLEEWQKELYKNIMKGNYESLISMDYAMNQPDVLSQIQPEGEHSTDDQPRPEASEMPADPS

SEQ ID NO: 11300 - protein, 81 aa, Mesocricetus auratus
PGLHVTFEDVAIHFSQEEWMLLDKAQRFLYCTVMLENLALVASLGSCPGVGGEEVTSERGAPPEGVMTEASPSTQETHLIE

SEQ ID NO: 11301 - protein, 81 aa, Mesocricetus auratus
MESVSFEDVAVKFTQEEWALLDPPQKKLYKDVMQETLRNLASIGNKLENQKIVNEYENLWRKLSSQLVEQFCDYKGSLQCT

SEQ ID NO: 11302 - protein, 81 aa, Mesocricetus auratus
SQAPVTFEDMAMYLTREEWRPLDPTQRDLYRDVMQENYGNVVSLDFEIRSENEVNQKQELSEDVEFVTMSEEPIGDAEKNP

SEQ ID NO: 11303 - protein, 81 aa, Mus musculus
PQGLLTFRDVAVDFPQEEWECLDSDQRALYIDVMLENYRNLVSVENYCICDTVHQHVKTEKESCQGNKLGEMLHEPSNCAL

SEQ ID NO: 11304 - protein, 81 aa, Mus caroli
CLTFEDVAVNFTLEEWDLLDPSQKQLYTDVMQETFKNLIAIGQIEEVQRSKDVDEDSRRNLRRGLVELLYEPNEGRRCDGI

SEQ ID NO: 11305 - protein, 81 aa, Mus caroli
FRESVTFKDVVVNFTQEEWKHLDPIQRDLFRDVTLENYTHLVSIGLQVSKPDMISQLEQGTEPWTEDSCIPVGSLEDWKKR

SEQ ID NO: 11306 - protein, 81 aa, Mus musculus
SQGLLAFKDVAVEFSQEEWGCLDSAQRSLYINVMLENYNNLVSVENYCIRDTVDQHVNTEKESCQYNELGKILHEHFKCAL

SEQ ID NO: 11307 - protein, 81 aa, Mus musculus
MDAMTYEDVHVNFSREEWALLDPSQKSLYKDVMLETYWNLTCIGYMWEDCNIEDHCQSSRRHGRCINCPSAYGKKQCTNLF

SEQ ID NO: 11308 - protein, 81 aa, Mus caroli
DQELVSFEDVIVDFTQEEWTSLNPDQRNLYRDVMLENYQNLATVGYQLIKPSLISWLEQEEFSKGQKIVFPEWKLQLETKC

SEQ ID NO: 11309 - protein, 81 aa, Mus caroli
FETLNDVAMDFTVEDWKDLESELDQRDLFWDVTLNDYQDMFSFNTPQPSLTSQPDVREELEATSTEVPETKNSPLQNGFLE

SEQ ID NO: 11310 - protein, 81 aa, Mus musculus
PQGLLTFKDVALYFSLEEWECLSFAQRTLYMDVMLENYNNLLFVENHCIHGKYGKVLGEESQYIVHEHVNIQEKSSKWDKL

SEQ ID NO: 11311 - protein, 81 aa, Mus musculus
MLSFWDVAMYFSAEEWEYLGPAQWKMYRDVMLENYSNLVFLGLASTKPYLVTFLEQRQELSDVKRQAATAKYSGGKSYTCK

SEQ ID NO: 11312 - protein, 81 aa, Mus musculus
MTFRDVAVDFSPEEWECLSLDQKSLYRDVMLENYSHLVSVGLCIYQPHGFPVPEKEQDACMDLGNEPSRFCPDTDSRWQMK

SEQ ID NO: 11313 - protein, 81 aa, Cavia porcellus
VVFEDVALRFSQKEWGLLSLAQRSLYRDVMLENFALISSLGCLCRVKDEESSPKQVKNSGIHVGEQLCTCGEQGANQATTG

SEQ ID NO: 11314 - protein, 81 aa, Cricetulus griseus
VSGSIENDGVCFSEQEWENLEDWQKELYRNVMESNYETLVSLKVLGQPEEEAELGAEMVGDLVEEGTHLDRAMVKQEGPAG

SEQ ID NO: 11315 - protein, 81 aa, Octodon degus
SQAPVTFEDMAMYLTREEWRPLDPTQRDLYRDVMQENYGNVVSLDFEIRSENEVNPKQEISEDVEFGTTSERPGGNVEENP

SEQ ID NO: 11316 - protein, 81 aa, Peromyscus maniculatus
CERWMSFEDVTVNFSQEEWQQLNSAQRRLYQDVMLEIYSHLLAVGYPIPSPGVIFRMEKGKEAQAGQAEFPGQHCQEKSGI

SEQ ID NO: 11317 - protein, 81 aa, Peromyscus maniculatus
VDCLKSSNKDGAVDFTQEECTTKDPTQNIIPSDVTVEDYKNLVSVGCQTLTKPSALTCLKEELVSTQREVLQELEKQLQTK

SEQ ID NO: 11318 - protein, 81 aa, Rattus norvegicus
TARPQEAVTFKDVAMDFTPEEWGKLDPVHRDVMLENYRNLVSLWLPISKPDDYDSEDGKELLKLERKSPKCSDSDVETRPE

SEQ ID NO: 11319 - protein, 81 aa, Mesocricetus auratus
QGYLTFKDVAVDFSQEEWECLDSVQRALYIDVMLENYRNLVSVENYCMCAIVHQQVDCEEKYSKCNELDEMLHESTRCTVY

SEQ ID NO: 11320 - protein, 81 aa, Rattus norvegicus
SEGLVTFKDVAIDFTPEEWKQLDPTQRNLYRNVMLENYNNLITVGPPLSKPDVIFKLEQEEEPCVVEKEVLRRRRPGEILG

SEQ ID NO: 11321 - protein, 81 aa, Mus musculus
MLENYSNLLFLGHCKTKPELIFNLEQRLGSWIVEASHQCVPDFQNMSTLNKSSPDTKARHVWQVALNSETSKELAGIGNTC

SEQ ID NO: 11322 - protein, 81 aa, Mus caroli
AWVPALFDEVAIYFSDEEWEVLTEQQKALYREVMRMNYETVLSLEFPFPKPDMINRLESDEECPNSDEWRLQGVTFAENEE

SEQ ID NO: 11323 - protein, 81 aa, Mus musculus
PQGLLTFKDVAVEFSLEEWERLSFAQRSLYIDVMLENYNNLLFVENHFICAKCGKALDEDSQYIVHEHMNIQEKSSKWNKL

SEQ ID NO: 11324 - protein, 81 aa, Mus musculus
MEEMLSFRDVAIDFSEEEWECLGPAQWNLYRDVMLENYSHLVFLGLALSKPYLVTCLEKIQETSGVKRGGAPFMLPGGKCY

SEQ ID NO: 11325 - protein, 81 aa, Mus musculus
MDALTFDDVHVHFTREEWSLLDPSQKRLYKDVMLENYRNLTAIGYNWKDHNIEEHCQNDRRYGRHKITPAGEKPYEYTQWD

SEQ ID NO: 11326 - protein, 81 aa, Mus musculus
QCLLTFKDVFLDFSSEEWECLNFAQRTLYMDVMLENYNNLLFVENHCICGNYEKEKVLEQDTQHIVNEHGHNRKKSSKCNE

SEQ ID NO: 11327 - protein, 81 aa, Mus musculus
LQEAVTFNDVAIDFSPEEWDWLNPAQRSLYRTVVLENYRNLVSVGGKSVQKTHELSLRQLVFEDVAVENTTSLGCESLTSG

SEQ ID NO: 11328 - protein, 81 aa, Cavia porcellus
SQGLVTIKDVSLSFSQEEWRSLDPSQTDFYGEYVMQENCGIVVSLRFPIPKLDMLPQPEGGEEQWVPNPQDLEERDILRIT

SEQ ID NO: 11329 - protein, 81 aa, Cavia porcellus
AQVEVTFEDVAVLFTRDEWRKLDALQRSLYRDVMLENYRNLASLGFPFTKPRVISLLQQGEDPWKVEKEIPGDPSLGCKSS

SEQ ID NO: 11330 - protein, 81 aa, Cavia porcellus
MLENYFNLVSVGCQVPNPEVFFSWEPGEDPCSLGRENSSHSYTGEDIGLEASQPEPSEEFFLQPDRIHLFIRDLELWKDDK

SEQ ID NO: 11331 - protein, 81 aa, Cavia porcellus
KPGVVRFADVAVYFSPEEWGCLRPAQRALYRDVMCETYGLLGALGFPGPKPALISWMEQESEAWSSAAQDPEEGESLVGAL

SEQ ID NO: 11332 - protein, 81 aa, Cricetulus griseus
SKASVTFGDLAIYFSREEWEWLSPIQKDLYEDVMLENYQTLVSLGLVCRRPNIITLLEKGKAPWMVEPSRRRRGPESGSKR

SEQ ID NO: 11333 - protein, 81 aa, Cricetulus griseus
LQHLVTFRDVSVDLSQEEWECLDCAQRALYVDVMLENYRNLVFVGNRCICHNYENVLDQSSMPIVHQHANTQVKPYKCNQP

SEQ ID NO: 11334 - protein, 81 aa, Castor canadensis
PKVPMAFDDVSIYFSTPEWEKLEEWQKELYKNIMKGNYESLISMDYAMNQPDVLSQIQPEGEHNTEDQAGPEESAIPADPS

SEQ ID NO: 11335 - protein, 81 aa, Peromyscus maniculatus
LKEPVTFRDVAVDFTQEEWGQLDPTQRTLYRDVMLETFGHLLSVGPDLPKPAVISQLEQGAELWVAERGGSRACHPGWILG

SEQ ID NO: 11336 - protein, 81 aa, Peromyscus maniculatus
MEEMLSFWDVAIDFTPEEWECLEPAQWDLYRDVILENYSHLDFLGLTVSKPYLVTFLEQRQGPWDVKKQAGTTPNNYNNYS

SEQ ID NO: 11337 - protein, 81 aa, Peromyscus maniculatus
VAFDDVAINFTQEEWALLDTSQKNLYTDVMQEVFRNLNYIENGWEDQNIEEDKNPEINLRHIITDSGYNLYENQEYSEKPY

SEQ ID NO: 11338 - protein, 81 aa, Peromyscus maniculatus
MDAVTYEDVQVSFTREEWTLLDPSQKSLYKDVMVETYRNLTAIGYKWEDQNIKKHHQCSRRHGRHERSNSAEKDYECEQCG

SEQ ID NO: 11339 - protein, 81 aa, Peromyscus maniculatus
HKKSMVFSDVSLDFSQEEWECLGPAQKDLYRDVMLENYSHLLSVAGLHIPKPQVISLLEQGKEPWMIGKELTRGLCSALES

SEQ ID NO: 11340 - protein, 81 aa, Peromyscus maniculatus
MLENYSSLASLGIQASVPRVIGKLQKGQDPCMEREDPEDSCLDLQIWPDMEALPPKQDIFIEEPSHGLIKHESTEGVHWKT

SEQ ID NO: 11341 - protein, 81 aa, Peromyscus maniculatus
PQGLLTFRDVSVYISQEEKECPDSSQRALYIDVMLENYNNLVSVGNYCKCDPDHQHVKTGKEPCQCNELGKVLHDPSTCAL

SEQ ID NO: 11342 - protein, 81 aa, Peromyscus maniculatus
MVLVSFEDVAVDFTWEEWQGLDAAQRTLYKDVMLENYSSLVSLGHCMAKPELIFNLEHGFGPWRTADASVWNLAGVNKMSS

SEQ ID NO: 11343 - protein, 81 aa, Peromyscus maniculatus
MDLVTFEDVTVNFTQDEWALLDSSQKNLYREVVGEIFMSLASMGERWDQNIEDWYRKQGRILSNHIIGRLGDSKRGSRGGE

SEQ ID NO: 11344 - protein, 81 aa, Peromyscus maniculatus
SQGLLTFRDVTVDFPQEEWECLDSAQKALYIDVMLENYNNLVFVENYCKCDPVHQHLKTEKESCQYKELGKVLHDHSRCAL

SEQ ID NO: 11345 - protein, 81 aa, Peromyscus maniculatus
MLENYRSLVWLGHCLAKPELISKLEQGLVPWSGAEATEQCLPDVHKWSALAETRQQAQEKYLGQLEITKRNSSNEDMVEVE

SEQ ID NO: 11346 - protein, 81 aa, Peromyscus maniculatus
MDLMTFGDVAIHFSPEEWECLDCVQRDLYRDVMVENYRNLLSVVVSSHYTQYISSKENIKHSFQEVIRRHEECGIDSSHLR

SEQ ID NO: 11347 - protein, 81 aa, Peromyscus maniculatus
GCVTFEDVAVYFCQEEWELLDEAQRLLYLTVMLENFALITSLVCWHEADAEETTCVQSVSPVEEPQVRTSKEGLPTKKTHP

SEQ ID NO: 11348 - protein, 81 aa, Octodon degus
SCEGSVSFRDVTIDFTREEWQHLDPGQRNLYRDVMQETYSHLLSVGYQVPEPEVFILEQEKEPWTSQGDSSHQSCQEKLQK

SEQ ID NO: 11349 - protein, 81 aa, Peromyscus maniculatus
GSVSFTDVTVDFTQEEWEQLDPSQRILYMDVMLENYSNLLSVEVWKADDQVDKDPTDPGEQGRPLRTLKNQPPTEERGSLF

SEQ ID NO: 11350 - protein, 81 aa, Peromyscus maniculatus
VSFEDLAVNFTQEEWDLLDPSQKILYGDVMLETCRNFTAIGYECEDQKIEEHYEDPEVNIRHIISHSEYTQYEPEDCEQKP

SEQ ID NO: 11351 - protein, 81 aa, Rattus norvegicus
TQGLVTFEDVAVYFSLEEWERLDVDQRDLYRDVMQENYGILVSLGYPIPKPDLIFHLEQGEEPWVEDSPHPEEGDVVTGVY

SEQ ID NO: 11352 - protein, 81 aa, Mesocricetus auratus
EMGLVSFEDIAVEFTWQEWQNLNEGQRTLYRDVMLENYSNLLFLGHCKTKPELIFNLEQRLGSWIVGEASNQSIPEFQGMN

SEQ ID NO: 11353 - protein, 81 aa, Mesocricetus auratus
MLSFQDVAIEFSPEEWEYLEPAQWNLYRDVMLENYSHLDFLGLVLSKPHLVTFLEQRQRSTGVKKQEAATVHTGKAVNKCK

SEQ ID NO: 11354 - protein, 81 aa, Mesocricetus auratus
MEEWAMLDPSQKELYKDVMKEILRNVISIGNIRKHQKIENEYQNSGRKLRCQLVEKLHDCKEDHECAEIFNFSTEGTVNHT

SEQ ID NO: 11355 - protein, 81 aa, Mesocricetus auratus
SQGPLTFRDVTVEFPQEEWECLDSAQRALYIDVMLENYSNLVSVENYYICDPVHQRVKTEKESCQCNDLDKVLHDPSTYAL

SEQ ID NO: 11356 - protein, 81 aa, Mus caroli
AVTFRDVAVVFSEEELGLLDAAQRKLYHDVMLENFRNLLAVGGQVPNKMENLHTTGVRCLSLGKLPCWHMASHDANKLARA

SEQ ID NO: 11357 - protein, 81 aa, Mus musculus
AQRLMTFRDVAVDFSPEEWECLSLDQRSLYRDVMLESYSHLVSVGLFVYRPHLFSLLEKGQDPWMILRDETRGPYPDIDFS

SEQ ID NO: 11358 - protein, 81 aa, Cavia porcellus
WSQMPVTFEDVALYLSREEWGRLDHTQQDFYRDMLQKKNGLALGFPFSRPFWAPQVPRKVEALSSSRQTGAEEEQGDYGSG

SEQ ID NO: 11359 - protein, 81 aa, Cavia porcellus
MDVMLENYCHLISLGCDMTKPDVILKLEHGEEPWTSFADHACLKENWKAEDILMKFRTPRSTFTLVKKPASLKNLPPKYDT

SEQ ID NO: 11360 - protein, 81 aa, Cavia porcellus
VVRFADVAVYFSPEEWGCLRPAQRALYRDVMCETYGLLGALADTSTKEEEIDEPGGKGPGMTSGKEWPEALIEHNPDSSIS

SEQ ID NO: 11361 - protein, 81 aa, Cricetulus griseus
FKGPVTLRDVTVEFTKAEWELLTPAQKALYKNVMLENYRHLLAVGYRVVNRSVISKLKKGKEPWVSEKELPNRRRADKQRN

SEQ ID NO: 11362 - protein, 81 aa, Cricetulus griseus
EEPVTFEDVAVNFTLGEWALLDSSQKKLYRDVMTETLMNLISIGKTKGKENVEDNYQNLRKNVRTQVVERNCVYGAGGRCG

SEQ ID NO: 11363 - protein, 81 aa, Cricetulus griseus
RNQFSFQSLVTFKDVAINFSKEEWECLHTSQKDLYRNVMLENYGNLVSVGLSESKPELVTCLEENMEPWMVNKNEAEDLEQ

SEQ ID NO: 11364 - protein, 81 aa, Cricetulus griseus
GETGKVPVTFDDITLYLLQEEWMQLNHPQKDFSASNKPTAPLGPTAANPELFHEFGQGTEPWLGSIQGQQSLLNHHTGKTH

SEQ ID NO: 11365 - protein, 81 aa, Cricetulus griseus
SLTFDDVAVDFTQEEWVIMDQTQRDLYREVMLENYQNLFSAGLSTHIQKHVGQKPYVCKLCGRSFTISSNLTEHLRSHTGE

SEQ ID NO: 11366 - protein, 81 aa, Cricetulus griseus
DSVTFEDVTVNFTQDEWALLDSSQKNLYREVVGEIFMNLASMGKDDGFLLSQTGFFAHHNHIIERFGDSKQGSRCGERFSQ

SEQ ID NO: 11367 - protein, 81 aa, Cricetulus griseus
QQESVSFEDVAVKFTQKEWAMLDPSQKKLYKDVMQETLRNLAFIGKKLGKQKVVTKYENLWRKLSSQLVEKFCEYKESLQC

SEQ ID NO: 11368 - protein, 81 aa, Cricetulus griseus
SNSVLSFRDVSVDLSQEEWECLDCAQRALYMDVMMENYSNLLFVENHCICGKYETVLDQGTKLIVHDHVNIQEKPSQYNEL

SEQ ID NO: 11369 - protein, 81 aa, Cricetulus griseus
VTFEDVAIFFSKEEWRLLAEAQRQLYLRVMLENFALVTSLGMETGKLPFDQVSGEGLSLVMPPKASPANQESHPSDIYLPV

SEQ ID NO: 11370 - protein, 81 aa, Peromyscus maniculatus
MESVSFEDVAVRFTKEEWALLDPSQKKLYKDVMQETLRNLAAIGNKLENQKVVNEYENLCRKLSSQLVEIFCEYKESLQCT

SEQ ID NO: 11371 - protein, 81 aa, Peromyscus maniculatus
ALALLSFEDVAVTFTVEEWGHLDLAQRTLYQEVMMETCGLLVSLGHRVPKPELIYLQEHRQGVWAGQSGLSQCTCTDEEAK

SEQ ID NO: 11372 - protein, 81 aa, Peromyscus maniculatus
SQGLVTFKDVALCFSQDQWSDLDPTQKEFYGEYVLEEDCGIVVSLSFPIPRLDDTSQIREEEPQFPDAHESPEPAEPEILS

SEQ ID NO: 11373 - protein, 81 aa, Peromyscus maniculatus
DAVTYEDVHVNFTQEEWALLDSSQKSLYKDVMLETYENLISVGYKWEDQNIEEHCQSSRRHGRYITCHSRYKPCEHKGYGK

SEQ ID NO: 11374 - protein, 81 aa, Peromyscus maniculatus
MNAVTYDDVHVDFTWDEWALLDPSQKNLYKNVMLETYRNLTAIGYKWEEHNINEKFQRSRRNRRHERSHTGEKSYECNQCG

SEQ ID NO: 11375 - protein, 81 aa, Peromyscus maniculatus
AKNAVAYEDVHVDFTQEEWALLDPSQKSLYRDVMLETYRNLTAIGYKWEDHNIEDRCQSSGRHERRHTGENPSEYTQSVKA

SEQ ID NO: 11376 - protein, 81 aa, Peromyscus maniculatus
LQDSVTFKDVAVDFSQEEWEQLNPAQRSLYRTVVLENYQNLVSVGACISKPHLISLLEHGKEPWEVKGEVTRSTLQDGEPI

SEQ ID NO: 11377 - protein, 81 aa, Peromyscus maniculatus
PQNAVTYNDVHVDFTWEEWALLDPSQKNLYKDVMLETYRNLITIGYSWEDHNIEEHFQSSRRHERHERSDNEENSSVYTQC

SEQ ID NO: 11378 - protein, 81 aa, Peromyscus maniculatus
DQLTFSDVAIDFSPDEWECLDPPQQNLYRDVMLENYRNLVSVALSHHCTQNFSPEQILKYSFKKVTHGRPGSYGLKSLRNW

SEQ ID NO: 11379 - protein, 81 aa, Peromyscus maniculatus
SCERLVSFEDVTVNFSQEEWQQLDPAQRRLYQDVMLEIYSHLLAVGYPRPEAIFKVKEVHFPHQRCQCQGESEHGSPHQIC

SEQ ID NO: 11380 - protein, 81 aa, Peromyscus maniculatus
AMTAVTYDDVHIDFTWEEWTLMDPSQKNLYKDVMWETYRNLTAVGYSWEDHDIEEHCQSSGKLRRYKEHHIGEKPSEYTQC

SEQ ID NO: 11381 - protein, 81 aa, Mesocricetus auratus
DAVTYQDLHITFTQEEWALLDSSQRNLYKDVMLETYMNLNAIGYKWEDNDIEQHCRSPQRHGRHERSPTREKPSAYMQCDK

SEQ ID NO: 11382 - protein, 81 aa, Mesocricetus auratus
MLENYSNLASLGFPFAKPEMISVLQQGEEPWKVEKRSLGFSLGCNSSLQTTKSTQTKDSSFQGLMRKQLKRDKSWDFTSGK

SEQ ID NO: 11383 - protein, 81 aa, Mesocricetus auratus
MESLSFEDIAVYFTWQEWQDLDVAQKLLYRDVMLENYSSLVSLGCCMIKPELILMLEREFGPWRVADTSVWNLPGYCMTRP

SEQ ID NO: 11384 - protein, 81 aa, Mesocricetus auratus
CLKTCNKDEAVDFIQEEWTTKDPAHNSVPGDVTVEDYTSLASVEGEKQLHTKDLALEQEFLTRHSFMETQKVDAVTFEDVT

SEQ ID NO: 11385 - protein, 81 aa, Mesocricetus auratus
SLGPLSFKDVAVAFTQEEWRQLGSEEKTTYRDVMLENYSNLVSVGYHIIKPDVIIKLEQGEEPWIVEGAFSPQSYPDEIWQ

SEQ ID NO: 11386 - protein, 81 aa, Mesocricetus auratus
SQDLLTFGDVAVDFPQEEWECLDSAQRALYIDVMLENYSNLVSVENYCKCDPVHHHVKTEKESCQCNELDKVLHDPSTCAL

SEQ ID NO: 11387 - protein, 81 aa, Mesocricetus auratus
HSVTYDDVHITFTQEEWALLDASQKSFYNDVMLETYRNLSAIGYRWEDHYIEEHSQSSRRHGRHKGTHTGENPYEYNQCGK

SEQ ID NO: 11388 - protein, 81 aa, Mesocricetus auratus
QGSVSFTDVTVDFTQEEWEQLDPSQRILYMDVMLENYSNLLSVVWRADDHVEKNPRDPDEQARPLTTLKNQPPVEERGNLF

SEQ ID NO: 11389 - protein, 81 aa, Ictidomys tridecemlineatus
EDVAVNFTQEEWALLDPFQKKLYRDVMQETFINLASIGENWEDQNTEDKYKSQGIHLRKKISHEGILACQFGETIRQTPNL

SEQ ID NO: 11390 - protein, 81 aa, Mesocricetus auratus
VCGSVTFGDVAVDFSQEEWACLDATQRVFYRDMMLETYSNLVTVVGSSISKPDLITLLEQEREPWMVVKEETDSPSPDLES

SEQ ID NO: 11391 - protein, 81 aa, Ictidomys tridecemlineatus
SQAPVTFEDMAMYLTREEWRPLDPTQRDLYRDVMQENYGNVVSLDFDIRSENEVNPKQEISEDVEFGTTSERPVGNAEENP

SEQ ID NO: 11392 - protein, 81 aa, Dipodomys ordii
MAQLMTFRDVAIQFSQEEWEYLNPEQRNLYTDVMSENYSNFVSVGLSIYQPHVISLLEKEQEAWIELDEERRGFCPDLQST

SEQ ID NO: 11393 - protein, 81 aa, Peromyscus maniculatus
GAEPVTFRDVAVFFSQEEWLHLDSAQRSLYREVMLENYSSLASLGIQASVPRVIGKLQKGQDPCMEREDPEDSCLDLQIWP

SEQ ID NO: 11394 - protein, 81 aa, Peromyscus maniculatus
MMLETYSNLVTVVGSSVSKPDLIALLEQEREPWMVVKEETDRPSPDLESCYNTENISPENHTYDINLPTQSIKQLSKNFDL

SEQ ID NO: 11395 - protein, 81 aa, Peromyscus maniculatus
MQGQLTFRDVAIEFSQEEWECLDAAQRALHRDVMLENYSNLVSLGVTRPNLNAMSMLEQQKGPWTVESEAIITRKSNGQEY

SEQ ID NO: 11396 - protein, 81 aa, Cricetulus griseus
VKQFSFQSLLTFKDLAINFSKEEWKYLNTSQKDLYKDVMLENYSNLVSVGLSESKPELVSCLEQNKEPWMVNIEEGECLEQ

SEQ ID NO: 11397 - protein, 81 aa, Mesocricetus auratus
MDVTIDFGREEWQHLDPDQRSLYRDVMQETYSHLHSVEELQQIGDQKETYQQIGNKSGSDVIFIKKTLDTKGHHGCKVIRK

SEQ ID NO: 11398 - protein, 81 aa, Rattus norvegicus
EQLTFRDVAVDFSPDEWECLDPPQQRLYRDVMVENYRNLVSVALSHHCTQNFSPEQILKYSFTKGTNGSCGLKSLYLREDC

SEQ ID NO: 11399 - protein, 81 aa, Ictidomys tridecemlineatus
SISFEDVTVNFSREEWQHLDPVQRRLYWDVTLENYHHLISVGEDIRKTQQQEISGEVSFHCERFDQPTGEDSLCSILEELW

SEQ ID NO: 11400 - protein, 81 aa, Octodon degus
SQESLSFRDVFVDFTLEEWQQLDSAQKNLYRDVMLENYSHLVSVGYLVAQSDAIFSLGQGEEAWGADRGTQIRSCPDVSIF

SEQ ID NO: 11401 - protein, 81 aa, Rattus norvegicus
AQGLVTFRDVAVDFSQEEWEFLDPAQKNLYRDVMWENYSNFISLDLESRFKTDTSSLDKDICEVYSVQWELIEKIKNLSPQ

SEQ ID NO: 11402 - protein, 81 aa, Mesocricetus auratus
SQELVTFEDVAVYFIWKEWKRLEPAQRDLCRGVMLENYGNVLSLDGESKTGNDQVISEGMGSHEMVLGRFHTDASQGGRFG

SEQ ID NO: 11403 - protein, 81 aa, Mus caroli
AHSMVMFRDVTVDFSQEEWECLSSYERDLYRDVMLENYSHLVSLAGCSISKPDVITLLEQGKEPWMIVRAEKRRWSRDLES

SEQ ID NO: 11404 - protein, 81 aa, Mus caroli
SRTPVSFEDVAVSFTQEEWEYLTSTQKNLYQKVMSETFKNLTFVGSKKKPQEPSSDLQDKNEEQKSSSCTGVFKGGPLFFC

SEQ ID NO: 11405 - protein, 81 aa, Mus caroli
SQESVTFQDIAVDFTEKEWPLLDSSQRKLYKDVMLENYSNLSSLVGYQVGKPRLISHLEQEEDLRMEERGIQQGPSPDWGT

SEQ ID NO: 11406 - protein, 81 aa, Mus musculus
RERLVSFEDVTVDFSQEEWRRLDSVQRHLYQDVMLEIYSHLLAVGYPVPSPGAIFRIKKRKEARTGEAKLPHPCWCQEVES

SEQ ID NO: 11407 - protein, 81 aa, Mus musculus
VCGSVTFRDVAVDFSQEEWACLDATQKVLYRDIMLETYSNLIAVVGSCISKPDLIVLLEQEKELWMAVKEETDRLSPDLES

SEQ ID NO: 11408 - protein, 81 aa, Mus musculus
QDAVTYEDVHVNFTKEEWTLLHPSQKSLYRDVMLETCRNLTAIGIISVTLDPSLVSIRDMERSNVLLQVTVFFKLTEESIL

SEQ ID NO: 11409 - protein, 81 aa, Cavia porcellus
NQESVTFQDVAVDFTEKEWPLLDTSQRKLYRDVMLENYSNLTSLGYHIGKPSLISHLEQEADPRTEERGTQQGTCPDWETP

SEQ ID NO: 11410 - protein, 81 aa, Cavia porcellus
VQEPVTFWDVAVDFTQEEWGQLDPTQRTLYRDVMLETFGHLLSVGHQIAKPEVISLLEQGEEPWSVEPVHSQSSCPEWMRN

SEQ ID NO: 11411 - protein, 81 aa, Cricetulus griseus
SMDAVTYDDVHINYTQEEWDLLNPSQKRLYKDGMLDTYRNLTDTGYSWEDHNIEEQCQSSRRCRRLIEMMCFRKRGFFDTS

SEQ ID NO: 11412 - protein, 81 aa, Ictidomys tridecemlineatus
RESGKAPVTFDDITVYLLQEEWMLLSQQQKDFYGSDKLVPPLGPTVTSPELFCEFGKVSKPWPGNVQGQRSLLDHHPGKDQ

SEQ ID NO: 11413 - protein, 81 aa, Ictidomys tridecemlineatus
SRGTVTFKDVAIAFTQEEWKQLDPAQRNLYRNVMLENYNNLITVGYPFTKPEVIFKLEQEEEPWVVEEEVFSRHCSGEILG

SEQ ID NO: 11414 - protein, 81 aa, Peromyscus maniculatus
WSQMPVTFEDVALYLSREEWGRLDHTQQHFYRDVLQEKNGLALGFPFSTPFWVPQVQGKGEVASSSRPPGAEERRGLGSGI

SEQ ID NO: 11415 - protein, 81 aa, Peromyscus maniculatus
SRLTFRDVAVDFSHEEWECLDSAQRALYMDVMLENYSNLVFLDNHHMCVEYKNDLHHDSKHIVHDYVNIQEKAFKCNDLCK

SEQ ID NO: 11416 - protein, 81 aa, Cricetulus griseus
CNSWISPSDVAINFSKEEWECLHPSQKDLYRDVMLENYSNLVSVGLSESKPELVTCLEENKEPWMVNIDEAEGLGQGVFCY

SEQ ID NO: 11417 - protein, 81 aa, Mus caroli
SQCLLTFGDVSVDFSQEEWECLDSAQRALYIDVMLENYSNLVSVENYSTCDTVHQHVNTGKESCQRNNLGEMLRNPSHDAL

SEQ ID NO: 11418 - protein, 81 aa, Mus musculus
MLLREEWECLSPSQRTLYRNVMLENFRNLNELGCCSRRPGLITRLEQWDEPWVDDWDRSEFPDGQKSFCPGSRKVAHSRIG

SEQ ID NO: 11419 - protein, 81 aa, Mus caroli
VTFEDVALYLSQEEWGRLDHTQQNVYRDVLQGKNGLALGFPFSRPFWVPQIQGKGQAASRITGAEERRGLGSGAVEVGKVV

SEQ ID NO: 11420 - protein, 81 aa, Mus caroli
PQSQLTFKDVAVDFSQEEWECLDCVQRALYIEVMLENYNNLFFVENHCMCPKFENMFDQDLQHIVHEHLNTQVKSYECHEL

SEQ ID NO: 11421 - protein, 81 aa, Mus musculus
IVGLVSFEDVSVDFTWDEWQDLDDSQRKLYRDVMLETYSSLLSLNQCDAKPELILKLEQGAGPWKEDNAPDQSLPALQPMK

SEQ ID NO: 11422 - protein, 81 aa, Mus musculus
PKVPVAFDDVSIYFSTPEWEKLEEWQKELYKNIMKGNYESLISMDYAMNQPDVLSQIQPEGEHSTDDQPRPEASEIPADPS

SEQ ID NO: 11423 - protein, 81 aa, Cavia porcellus
FRGSVSFEDVAVDFTQEEWNRLDPAQRTLYRDVMLENYSHLVSLGFPLTKPDVIASLEQGVLGIIKKEIPNLNCTDDGQAE

SEQ ID NO: 11424 - protein, 81 aa, Cavia porcellus
SDIFEESVTFKDVAVDFTQEEWHHMDSAQRTLYRDVMLENYSHLVSLGYQVSKPEVIFKLEQGEEPWISEGEIQRPFCPGK

SEQ ID NO: 11425 - protein, 81 aa, Cavia porcellus
LQIRVTFKDVLVDFTREEWKLLDAAQQIMYKDVMLENYKNLVSLGHQLPKPDVILRLEKGEEPWLMQKGFYHRTHPDLETA

SEQ ID NO: 11426 - protein, 81 aa, Cavia porcellus
SQEQVSFKDVCVDFTKEEWCLLDPTQKLLYRDVILENYSNLVSVGHCIAKPEVIFKIEQGEDPWVLEKRFPSHHNPERKWK

SEQ ID NO: 11427 - protein, 81 aa, Cavia porcellus
MITCLEQSKEPWNVKRQETVVMHPAVSSHFAQDVSSEKGTKQSLQTVTKGRYSICGLDNLHLKKEWEHVDDHKGQDACYNG

SEQ ID NO: 11428 - protein, 81 aa, Cricetulus griseus
LETVTFEDVAVDFTLEEWTLLDSSQKKLYRDVMKETFWNLISIQKTLEENIEEDYKDLSRNMGTPVLEEDCGYECDTECDK

SEQ ID NO: 11429 - protein, 81 aa, Cricetulus griseus
ILECMKYNDLHIDFTLEEWTLLDTSQKNLYKDVMLETYKNLSDIGYIWEDHTIEEHCAGSKRHERHERSKTRQRLSIYIQC

SEQ ID NO: 11430 - protein, 81 aa, Cricetulus griseus
MGMPGHFSEGFVQRCHVGEYSNLVSEGLFESKPELVSCLEQNKEPWLVKVTAKFTMKGKISSVQHVGSLLPMGFLFRFIRE

SEQ ID NO: 11431 - protein, 81 aa, Cricetulus griseus
VTFDDVAVDFTQEEWILLDQAHRDLYREVMLENYQNLASAGHQTQSYLLVGRRGFAQRRSPRMGNATWHQRVNISSGVFEE

SEQ ID NO: 11432 - protein, 81 aa, Cricetulus griseus
MLENYKSLVWLGYCLDKPELISKLEQGLVPWSSAEATEQCQPDVHKWSALAKTRQKAQEKYLGQLEITKRNTSNEDMIEVE

SEQ ID NO: 11433 - protein, 81 aa, Cricetulus griseus
MLKKKRKGCGLDFSWEEWQDLDDAQRILYPDVMLEIPSSFVSLGHCILKPEAIVKLEQGAEPCTGEEPQDQNLPGVQKVDD

SEQ ID NO: 11434 - protein, 81 aa, Cricetulus griseus
GLLTFREVTVDFSQEEWELMDSAQRALYIDVMLENYNNLVFVGNYCKSDPVHQHVKTEKESCQCNELGKVLHDPSTCALYR

SEQ ID NO: 11435 - protein, 81 aa, Peromyscus maniculatus
SQDLVTFGDVSVNFTQEEWEWLNDAQRDLYRKVTLENYKSLVSLGIPVYKPAVISLLEQGKDPCVVQKEGARDASPDWDYV

SEQ ID NO: 11436 - protein, 81 aa, Peromyscus maniculatus
MDAVTYNDVHVDFTQEEWALLDPSQKNLYNNVMLETYMNLSAIGYTWEDHKVEEHCQSSQRHGRHERSYTGDQSSEWTLCV

SEQ ID NO: 11437 - protein, 81 aa, Peromyscus maniculatus
MDAVTYKDVHVNFTHEEWALLDPSQKSLYKDVMLETCENLTAIGYKWEDQNIEEHCQSSRRHGRYIICHSGYKPCDPKGYG

SEQ ID NO: 11438 - protein, 81 aa, Peromyscus maniculatus
AMNAVTYDDVHVNFTQEEWALLAPSQKNLYKDVMLETYWNLTTIGYNWEDHNIEEHCESSRRHKRHKRNYTEEKTHEVIQY

SEQ ID NO: 11439 - protein, 81 aa, Mesocricetus auratus
CQTLVTFEDVAVTFTDEEWRHLVPVQRALYKAVMLENYESIISLGLPVPQPDVILQLKKRDEPRTQGLHGSEEKEWPESIS

SEQ ID NO: 11440 - protein, 81 aa, Ictidomys tridecemlineatus
GPVSFKDVAVDFTQEEWQQLDPDEKVTYRDVMLENYSNLVSVDEVWQVEDPMEKLQEDEDMFFINKTLGEERGNVSGKAFN

SEQ ID NO: 11441 - protein, 81 aa, Ictidomys tridecemlineatus
CQGSVTFEDVAVIFTDEEWRHLVPVQRALYKAVMLENYESIVSLGLPVPQPDVIFQLKRGIEPWTEGLHGSEDRKCPENVS

SEQ ID NO: 11442 - protein, 81 aa, Ictidomys tridecemlineatus
MLENYGNVASLGFSLLKPAVISRLEGGGKLVGPSLLATGNRTGQGLYLDIQTGSNLSKEMCEEKISTSFELHKDSSQETDF

SEQ ID NO: 11443 - protein, 81 aa, Ictidomys tridecemlineatus
PTLALVSFEDVVVTFTGEEWRHLNLAQRTLYQEVMLEICGLLVSLGHPVPKPETILDHEQGLWTEKRHLSQSTCAGEKAKP

SEQ ID NO: 11444 - protein, 81 aa, Ictidomys tridecemlineatus
FQGLVTFGDVAVAFSPEEWEWLSPTQRSLYRRVMLENYRSLASLGLCASKPDVISSLEQGRGPWTMRRRGTRGPCPGEFID

SEQ ID NO: 11445 - protein, 81 aa, Ictidomys tridecemlineatus
SQASLTFEDIAVNFTSKEWQSLTYFQRHLYKDVMLENYGNMVSLGFSFPKPPLISHLEREAEPCVQDLQYGRFLSCSFPVP

SEQ ID NO: 11446 - protein, 81 aa, Marmota monax
MAMYLTREEWRPLDPTQRDLYRDVMQENYGNVVSLDFDIRSENEVNPKQEISEDVEFGTTSERPVGNAEENPEGEEAFGTG

SEQ ID NO: 11447 - protein, 81 aa, Marmota monax
MAFRDVAVDFSQEEWSLLSPAQRTLYKEVMLENYSNLVSLGIPFSKPKLITQLEQGKETWREERKCLLSTCPAEAKPELQP

SEQ ID NO: 11448 - protein, 81 aa, Marmota monax
RPRALKFVDVAVYFSPEEWGYLRPAQRALYRDVMRETYGHLGALGCAGPKPALISWLERNTDDWEPAALDPQEYRRGLTVQ

SEQ ID NO: 11449 - protein, 81 aa, Marmota monax
MAKPEVISLLEQGEEPWLVEQTCPESSCPEWMRDHESSALIPTQSTFNEEPSHGMKLKRYIWDDPWFSRLGVWGCKDQLEM

SEQ ID NO: 11450 - protein, 81 aa, Marmota monax
IQESLTFGDVTVTFTRLEWRHLDAVQQALYRDVVMENYGNLVSVGLLSSKPKLITQLEQGEEPWMEVQEVPSVQEYWPKTK

SEQ ID NO: 11451 - protein, 81 aa, Marmota monax
LQESFSFEDLCVAFSQKEWLLLGPHQKALYKDVMLENYHVLVSLGYEVMKPDVIFKLEQGEEPWVGDGETPRSDSAVLGLE

SEQ ID NO: 11452 - protein, 81 aa, Peromyscus maniculatus
MLSFWDVAIEFSAEERECLEPAQWNLYRDVMLENYSNLVFLGLAVSKPHLVTLLEQRQDSSDVKRQAAANVQPGTTPNDYN

SEQ ID NO: 11453 - protein, 81 aa, Octodon degus
MAMYLTREEWRPLDPTQRDLYRDVMQENYGNVVSLDFEIRSENEVNPKQEISEDVEFGTTSERPGGNVEENPESEETFEGG

SEQ ID NO: 11454 - protein, 81 aa, Peromyscus maniculatus
CQTSVTFEDVAVTFTDEEWRHLVPVQRALYKAVMLENYESIISLGLPVPQPDVILQLKRRDEPWTQGHHGSEEKEWQENVS

SEQ ID NO: 11455 - protein, 81 aa, Octodon degus
LQGRVSFKDVAVDFTQEEWQQLDPDEKTTYRDVMLENYNNLISVGCDVTKPNVIIKLEQGEEPWTIEDDFSHTCSEVWKVD

SEQ ID NO: 11456 - protein, 81 aa, Peromyscus maniculatus
TVTFRDVAVVFSEEELGLLDATQRKLYRDVMLENFRNLLSVGGQGPNKMEVLHAIGLRCLSLGRLPCWQLMIPDVNTLART

SEQ ID NO: 11457 - protein, 81 aa, Peromyscus maniculatus
MFRDVTVNFSQEEWECLNSYERDLYKDVMLENYSHLVSLAGCSISKPDVITLLEQGKEPWMIVRDERRRWSQDLETRYSSK

SEQ ID NO: 11458 - protein, 81 aa, Peromyscus maniculatus
MGSVSFEDVSVDFTQEEWNQLDPIQRSLYRDVMLENYSHLVSLGYPITKPDVITSLEQGVLGIIKREIPSSSCTEDGQTED

SEQ ID NO: 11459 - protein, 81 aa, Rattus norvegicus
APLPLTFEDVAIYFSEQEWQHLETWQKELYKQVMRTNYETLISLDNGLPKPELISWMELGRENFGSWGEGQKVDRGIRCSV

SEQ ID NO: 11460 - protein, 81 aa, Mus musculus
KPGTVSFADVAVYFSPEEWRYLRPAQRALYREVMRETYGLLTYLDVGCAKPALISWVEEESEVWGPGAQDPEVAMCRTEVH

SEQ ID NO: 11461 - protein, 81 aa, Mus caroli
DKALMAFHDVAVAFSQMEWELLSPAQRILYREVMLENYSHLVSLGIAFSKPKLITQLEQGAEPWRDGSGCFLDLCPAEPRT

SEQ ID NO: 11462 - protein, 81 aa, Mus musculus
MGVVTYDDVHVNFTQEEWALLDPSQKNLYRDVMLETYRNLAAIGYSWEDHNPEEHFQSSRRHGRLEKSHIEEKPSEFTQCG

SEQ ID NO: 11463 - protein, 81 aa, Mus caroli
VCGSVTFKDVAVDFSQEEWACLDATQKVLYRDMMLETYSNLVAVVGRCISKPDLIVLLEQEKEPWMAVKEETDRPSPDLES

SEQ ID NO: 11464 - protein, 81 aa, Mus musculus
SQCLLTFGDVSVDFSQEEWECLDSAQRALYIDVMLENYSNLVSVENYSTCDTVHQHVKTQKESCQRNNLGEMLRDPSHDAL

SEQ ID NO: 11465 - protein, 81 aa, Cavia porcellus
CQESVTFEDVAVVFTDEEWRHLVPMQRALYKAVMLENYESIVSLGLPVPPPDVIFQLKRGDKPWIEGLQGPEEKECPLIIF

SEQ ID NO: 11466 - protein, 81 aa, Cavia porcellus
KKLNLYLRKELCCVFFFSSGSTISKPDVIAFLEQEKEPWIGVRKETSRRCPDYGAEEIPPENYTSEINLSKQGIKQISNTL

SEQ ID NO: 11467 - protein, 81 aa, Cricetulus griseus
MEWELLSPPQRALYREVMLENYSHLLSLGIAFSKPKLITQLEQGAEPWRDGSECLRDLCLAESRTELEPHLSCPIAFASPE

SEQ ID NO: 11468 - protein, 81 aa, Cavia porcellus
LQVPVTFEDVTVTFTQEEWGQLDPGQRTLYQEVMLENCGLLVSLGCPVPTPELIQQLEHGQPPWTLSLGVQSTQPGDSGKT

SEQ ID NO: 11469 - protein, 81 aa, Cricetulus griseus
MAFEDVAVYFSQEEWVFLDAAQRALYRHVMLENFALVDSIGLSISRPRVIIQLQRGEEPWVPNRTNTGPGRGTRRRPSLGS

SEQ ID NO: 11470 - protein, 81 aa, Cricetulus griseus
LLCPSLEDHDQVHSHFLSTEFFRDLGADETIQRLLSSESWTRTHPQQDMSLSESKPELVSCLEENKEPWMVNIDEAEGLEQ

SEQ ID NO: 11471 - protein, 81 aa, Cricetulus griseus
QDCVTFEDVAICFSHEEWRLLDKAQRHLYVSVTMQNFALINSLGCGHRREDEEPRVSAGASKVWLSETTPSIPKTHLCEKC

SEQ ID NO: 11472 - protein, 81 aa, Cricetulus griseus
VTFADVAIDFTQEEWILLDTKQRNLYREVMLENYQNLATLEWAMRLKTGGTLLQQDIFQVKISNEIQLSDSYSGKELSKPP

SEQ ID NO: 11473 - protein, 81 aa, Peromyscus maniculatus
MLENYGHLVSLGLTISKPDVIAILEQGREPWLEERGTAGGLPSALESGYGAKILSAKPRVNEMESPRWGMMGGLASCGLEG

SEQ ID NO: 11474 - protein, 81 aa, Octodon degus
MLDNYALVAALAASPACKPALIARLERGEALWNSEALGSGLPGAGNWVMKEELDLEPEADAEMPGAQPGSATRSVSSAGQA

SEQ ID NO: 11475 - protein, 81 aa, Octodon degus
AQGSVSFKDVTVDFSQEEWQHLDSAQKTLYMDVMLENYCHLISLGYDMTKPDMILKLEQGEEPWTSFADHACLKENWKAED

SEQ ID NO: 11476 - protein, 81 aa, Rattus norvegicus
VTFQDVAISFSHEEWRLLDETQKLLYLSVMLQNFALINSQGCGHRTEDEERRVSTRASKVLRSETVPFTQKSHLCEKCVPI

SEQ ID NO: 11477 - protein, 81 aa, Rattus norvegicus
SQCLLTFRDVAVDFSQEEWECLASPQRALYIDVMLENYSNLVSVENYCICDTVCQPVKTERESCQCNELGKMLHDPSHGGL

SEQ ID NO: 11478 - protein, 81 aa, Mus musculus
GCVTFEDVAVYFSQEEWELLDESQRLLYLDVMLENFTLITSLAHWSEAEAEDKTCAPQIRTAKEGLPTKKPHPSDICSTVL

SEQ ID NO: 11479 - protein, 81 aa, Mus musculus
MDLVTYDDVQVNFTQDEWALLDPSQKSLYKDVMLETYRNLTAIGYIWEEHTIEDHFQTSRSHGRHERSCSAEQPSEFIQCG

SEQ ID NO: 11480 - protein, 81 aa, Cavia porcellus
EPVTFRDVAVDFTQEEWGQLDPTQRTLYRDVMLETFGHLLSVGPKLPKPDVISQLEQGAEFWVGEQGHTQHCRSGWEPDIP

SEQ ID NO: 11481 - protein, 81 aa, Cavia porcellus
MVKPEMIFKLERGEELWILEEESSGHGYAESLSVLCGNTSVGDNAFNILRHQKIQTLNENVDYNRCDKGFHEETAFVRCKR

SEQ ID NO: 11482 - protein, 81 aa, Cricetulus griseus
MLENYSNLISVGYDVTKPNVIIKLEQGEEPWMMEGDCHAQSHLEISKVGDTIEKIQENEDKHTRQADDLNNQRAEKGDTSD

SEQ ID NO: 11483 - protein, 81 aa, Cricetulus griseus
IQGVLTFRDVAVDFSQEEWECLDSAQRALCIDVMLENYSNLVFVEEYCKCDPVHQHVKTEKESCQCNELGKVLHDPSTCAL

SEQ ID NO: 11484 - protein, 81 aa, Cricetulus griseus
SQDLLSFKDVSVDFTREEWQCLDSSQRALYVDVMLENYNNLVSVENYYICDPVHQHKKTEKKSCQCTEFGKILHDPSTCAL

SEQ ID NO: 11485 - protein, 81 aa, Cricetulus griseus
MLETYSNLVTVVGSSISKPDLITLLEEEREPWMVVKEETDRPSPVGSSISKPDLITSLEQEREPWMVVKEETDRPSPDLES

SEQ ID NO: 11486 - protein, 81 aa, Cricetulus griseus
VQGLVSFEDVAVDFTWQEWQELDAAQRTLYRDVMLENYKSLVWLGYCLDKPELISKLEQGLVPWSSAEATEQCQPDVHKWS

SEQ ID NO: 11487 - protein, 81 aa, Cricetulus griseus
KMQDLVTFSDVTVTFSKEEWECMDSAQWNLYTDVMLENYNNLVFVENYYKCELVHRHVKTEKESCQCNELGKVLHDPSTCA

SEQ ID NO: 11488 - protein, 81 aa, Cricetulus griseus
LSEEKRAEEVASLRLTAKSQEWGKLDPACRDVMLENYRNLVSLWLPVSKPDSYNLDDGKELLKLEKKPRKCSYSDMETRPE

SEQ ID NO: 11489 - protein, 81 aa, Cricetulus griseus
MLSFRDVAIDFSPEEREYLEPAQWNLYRDVMLENYSNLDFLGKTVNKCKDYSKAFHCNSLPIQHQTAHLGEKPYKCEVCGK

SEQ ID NO: 11490 - protein, 81 aa, Ictidomys tridecemlineatus
MHKDVMLETYSNLASVGLCVAKPEMIFKLERGEELWILEEESSDHGYSGSLSLLCGNSSVGANALRLDNSLLQHQRLHSLH

SEQ ID NO: 11491 - protein, 81 aa, Marmota monax
SQRSVSFKDLTVNFTHEEWQQLDPDQRLLYRDVMLENYSNLISVGFRVSKPDVIFKLEQGEEPWIVEEISRESYTEDDDAL

SEQ ID NO: 11492 - protein, 81 aa, Marmota monax
FQVPALFDEVAIYFSDEEWEVLTEQQKALYREVMRMNYETVLSLEFPFPKPDMITRLEGEEESHNSDEWQLQRGTSTENEE

SEQ ID NO: 11493 - protein, 81 aa, Marmota monax
SVTFRDVAVLFSQDEWLHLDSAQRTLYREVMLENYSNLVSLGWENLFETTVSKEENLEVMEKLIVDDFRLGKVYMNEDKLE

SEQ ID NO: 11494 - protein, 81 aa, Marmota monax
GSVTFKDVTMAFTQKEWKQLEPAQKNLYKDVMLENYSNLASMGYQAPKPDMISKLEKGEEPWLGKGKKPSQNRLNKKARSK

SEQ ID NO: 11495 - protein, 81 aa, Marmota monax
TFKEAVTFKDVAVAFTEEELGLLDPAQRKLYQDVMVENFRNLVSVEHQFFKRDISYAEREEKLWMMKTATQRETSLGENNQ

SEQ ID NO: 11496 - protein, 81 aa, Marmota monax
YQGVVVFSDVTVDFSQEEWEYLDSVQRVLYRDVMLENYSNLVSVGLSISKPAVITLLEQGHEPWTDGPVPAKSQSLHKWQK

SEQ ID NO: 11497 - protein, 81 aa, Heterocephalus glaber
CWGLLSFKDVSMEFSWEEWQLLDSTQRHLYREVTLENYSNLLSVGYHGTKPELIFKMEQGEEPWIINAKMSTPSCAGWEEW

SEQ ID NO: 11498 - protein, 81 aa, Mus musculus
YQDSVTFDDVAVEFTPDEWTLLDLTQKNLYREVMLENYENLTSVGCQLFIPSLTPWLKQEESEVAESAVPQQLELQPTIDD

SEQ ID NO: 11499 - protein, 81 aa, Mus musculus
MVTFRDVAVVFSEEELGLLDAAQRKLYHDVMLENFRMLLSVGDKNPEEMESLEEVGLRHLSHEALFCSQIWQQVSRDLMKA

SEQ ID NO: 11500 - protein, 81 aa, Cavia porcellus
MAMYLTREEWRPLDPTQRDLYRDVMQENYGNVVSLDFEIRSENEVNSKQEISEDVKFGTTSETPSGNVEENPDSEETFESG

SEQ ID NO: 11501 - protein, 81 aa, Cavia porcellus
EPWAVTFADVAVYFSSEEWGCLRPAQRALYRDVMRDTYSLLSALGGGGTKPALISWVEEEADLWDPDAQDPEVAKWPTEAD

SEQ ID NO: 11502 - protein, 81 aa, Cavia porcellus
SQELVTFEDVAVYFIRKEWKRLEPAQRDLYRDVMLENYRNVFSLDGESRTENDQEISEDTGLHGLLLGRFQKDMSQGLKFE

SEQ ID NO: 11503 - protein, 81 aa, Cavia porcellus
ECLTFRDVAIEFSPEEWKCLNAAQRTLYREVMLENYRTLVSLGIFLPNVSVISILEQGKEPWTVENEMKIARNSSRWECCK

SEQ ID NO: 11504 - protein, 81 aa, Cavia porcellus
SQGLVTFGDVAVDFSQEEWEWLNSVQRSLYRKVMLENYRNLASLGLCASKPDVISSMEQGQDPWMAGRGRTGDWHPDLKAV

SEQ ID NO: 11505 - protein, 81 aa, Cavia porcellus
MGLVSFDDVSVDFTWEEWKDLSDAQRNLYKEVMLETYSNLVALGHCSIKPDVIFKLEQGSGPCVLGEALRQCLPDVQKLTS

SEQ ID NO: 11506 - protein, 81 aa, Cricetulus griseus
MLSFQDVAIEFSPEEREYLEPAQWSLYRDVMLENYSNLNFLGLAVPKPHLVTFLEQTQGPCDMTIQATDTVHPGTTPNDYN

SEQ ID NO: 11507 - protein, 81 aa, Cavia porcellus
SKGSVSLKDVTVDFTEEEWQQLDTAQKALYRDVMLENYRHFISVGFHITKPHMICKLEQGEELWTERIFPSQSYLNVLVKF

SEQ ID NO: 11508 - protein, 81 aa, Cricetulus griseus
APASVSFEDVAVTFTVEEWGRLDLAQRMLYQEVMMETRGLLASLGHRVPKPELLYPQEHCQGVWAVKTGLPQGTCTGEEAK

SEQ ID NO: 11509 - protein, 81 aa, Cricetulus griseus
IEDAVTYSDVHVDFTLEEWALLHPSQKNLYKDVMLETYTNLAAIGYKWEDHKIEEHCQSSRRHERHERSHTGEKPSEYTQC

SEQ ID NO: 11510 - protein, 81 aa, Cricetulus griseus
PKVPVSFDDVSVYFTKTEWKLLDLKQKNLYKQVMLENYSHLVSVGFAVSKPNLVSQLERGEKPWITDGGIGATTGSCAGNG

SEQ ID NO: 11511 - protein, 81 aa, Cricetulus griseus
EMLSFRDVAIDFSAEERECLGRDQWSLYRNVMLENYSHLVYLGLSFSKPLLVRFLEKNPELRNVKRQGPPGKKPYKCKECG

SEQ ID NO: 11512 - protein, 81 aa, Cricetulus griseus
TQSLLTFVDVVINFCKEEWECLNTSQKDLFRGVILENYSNLFSVGVSESKPELVTCQEQNKEPWKHPQITVPYISSNDFHE

SEQ ID NO: 11513 - protein, 81 aa, Cricetulus griseus
CLTFDDVAVNFTLEEWDLLDPSQKQLYTDVMQETFKNLVAIGQTEEGQRIEDDGHFRRNLRNGIVELLFEPSEGRQCEEIF

SEQ ID NO: 11514 - protein, 81 aa, Cricetulus griseus
GSLCKKVKLSNNSQNWNVLTYDDVHIDFTWEEWTLLDTSQKNFYKDVMLETYKNLREIGYSWEALQLKNIFQVLKDMKEET

SEQ ID NO: 11515 - protein, 81 aa, Cricetulus griseus
LQGSVSFEDVAVDFTWREWQELDASQRTLYRDVMLETYSSLVFVGHCTTKPELIFKLEQGFGPWSKAEASVWNVRGVKKAC

SEQ ID NO: 11516 - protein, 81 aa, Cricetulus griseus
SSRRAGSVSFEDVAVDFTQQEWHRLDSTQKNVHKDMMLETYNHWHLWASAHDFQVRTGKELWILEEESSDRDYSGPLSLLC

SEQ ID NO: 11517 - protein, 81 aa, Cricetulus griseus
MLENYSNLLFLGHCKTKPELIFNLEQRLGSWIVGEASDQSIPEFQGMNTLSKICPETKARHVWQVALDSDTSKKLTGVGKA

SEQ ID NO: 11518 - protein, 81 aa, Cricetulus griseus
KEKQFTFQSLLTFEDVAVNFSKEEWECLYTSQRNLYIGVMLENYSNLVSVGLSESKPELVTCLEQNKEPWMVNIEEVEGMA

SEQ ID NO: 11519 - protein, 81 aa, Peromyscus maniculatus
MDPSQRNLYKDVMVETYMNLTAIGYNWEDLEVEEHCQNSLKHGRHEKTQTGEKSYEYNQCGKALSHNRALQLHERTHTGEK

SEQ ID NO: 11520 - protein, 81 aa, Peromyscus maniculatus
SVSFEDVAVRFTKEEWALLDPSQKKLYKDVMQETLRNLAAIGNKLENQKVVNEYENLCRKLSQLVEKFCEYKESLQSTELF

SEQ ID NO: 11521 - protein, 81 aa, Peromyscus maniculatus
MIPRSVSFMDVTIDFSREEWQHLDPDQRSLYQDVMQETYSHLRSVGYQVPKTEVFMLEQGKETWSLRNESPCQHCAEELQQ

SEQ ID NO: 11522 - protein, 81 aa, Peromyscus maniculatus
SQGLLTFRDVTVNFSQEEWECLDTAQRALYIDVMLENCNNLLFLENYFKCDTVHQHVKTESESCQYNKFGKVLHDPSIYAL

SEQ ID NO: 11523 - protein, 81 aa, Peromyscus maniculatus
VQDLVTFKDVAVLFTQEEWRQLSSAQRALYRDVMSENYSNLVSLGLSGSKPDVFFHLEKADKCVSEDAPGGFVLGGITMTT

SEQ ID NO: 11524 - protein, 81 aa, Peromyscus maniculatus
ELGVVSFADVAVYFSPEEWGCLRPAQRALYREVMRETYGLLGALGGGGAKPALISWVEEEAELWGPGAQDPAVAMRPTEAD

SEQ ID NO: 11525 - protein, 81 aa, Peromyscus maniculatus
MLENYKNLLFLGHCKTKPELIFNLEHRLGSWIVGEASDQSIPDSQEMNTLTKFCPETKARHVWQVVFDHDTSKELTRVGKA

SEQ ID NO: 11526 - protein, 81 aa, Peromyscus maniculatus
TQGQVLFRDVSVTFTQKEWQLLDAAQRRLYREVMLETYKHLQAVGCDVTKPELICKLEQGDVPWELPGGSLSEVQRADCMT

SEQ ID NO: 11527 - protein, 81 aa, Peromyscus maniculatus
MEVVTYEDVHVNFTHEEWALLDPSQKSLYKNVMLDWNLSAIGYKWEDHNIEEHYQSFRRHGRYIICPYRFKPCEHKGHGNK

SEQ ID NO: 11528 - protein, 81 aa, Peromyscus maniculatus
MDPVTFEDVAVSFTEEEWALLDVFQKNLYRDVMRETYRNLTSIGTKWEQWNLEAYYRSLKRNMRIQMVKRDDELADNGQYR

SEQ ID NO: 11529 - protein, 81 aa, Peromyscus maniculatus
VSFEDVAVRFTKEEWALLDPSQKKLYKDVMQETLRNLAAIGNKLENQKVVNEYENLCRKLRSQLVEKFCEYKESLQSTELF

SEQ ID NO: 11530 - protein, 81 aa, Peromyscus maniculatus
TQVSLTFEDVAVAFTQEEWGQLDPAQKTLYQEVMLEISGFLVSLGYPVPRLELLCQLEQGQEPWAVAKSQSTCSGDSGKTK

SEQ ID NO: 11531 - protein, 81 aa, Mesocricetus auratus
PHEPMEFEDVFLTFTKEEWAQLDHQQKCLYREIMLENYNNMISVEHHFSKPNVISELEEVEDFWPMDREIPQDTFPGSSRP

SEQ ID NO: 11532 - protein, 81 aa, Mesocricetus auratus
MESVSFEDVAVNFTPEEWALLNSSQKRLHRDVMQENFRNLAAIAKNQEDPTLEDDYEYLRKILPFAVQTGYRLCENQDYAE

SEQ ID NO: 11533 - protein, 81 aa, Mesocricetus auratus
KYGTVSFADVAVYFSPEEWSCLRPAQRALYREVMLETYGLLGALGGGGAKPALISWVEEEAELWGPGAQDPEVAMCQMEAD

SEQ ID NO: 11534 - protein, 81 aa, Mesocricetus auratus
VVGLVTFEDVCVDFTWDEWQDLDDAQRKLYRDVMLETYSSLESLNQCDAKPELILKLEQGAEPWKEEDVPNQSLPAVENVK

SEQ ID NO: 11535 - protein, 81 aa, Mesocricetus auratus
LQRLLTFRDVAVDLSREEWECLDSVQRALYMDVMLENYNNLIFVEKNCLCGKYEKILGQGINHILHNCETIQEKSYKCEKL

SEQ ID NO: 11536 - protein, 81 aa, Ictidomys tridecemlineatus
SQESVTFQDVAVDFTEKEWPLLDSSQRKLYKDVMLENYSNLTSLGYQVGKPSLISHLEQEEEPRTEERGSQHGTCPDWETP

SEQ ID NO: 11537 - protein, 81 aa, Marmota monax
MASPSPPLEPKEEWDYLDPAQRSLYKDVMMENYGNLVSLDVLNRDKDEEPTVKQEIEEIEEEVEPQGVIVTRIKSEIDQDP

SEQ ID NO: 11538 - protein, 81 aa, Marmota monax
FQESVTFKDVAVDFTQEEWGQLDSPQRALYRDVMLENYQNLLALAGPPVCKPDVISHLERGEEPWQVHSKVTGRTCSEWEP

SEQ ID NO: 11539 - protein, 81 aa, Heterocephalus glaber
TVTFEDVAVNFTMEEWTLLNPSQKKLYRDVMRETFRNMTAIGRACDDQEVEEDCRNYWRNLSNEEVEKCYQYKGWNQYEKI

SEQ ID NO: 11540 - protein, 81 aa, Mus caroli
MLDNYRNLASLGLCASKPDMITSLEQGRDPWMMKRKMRKGQRLDLKAMQETKEFPPKDLSEETLSLAVLRKQLLPCRPKCS

SEQ ID NO: 11541 - protein, 81 aa, Mus caroli
MVLVSFEDVAVDFTWEEWQDLDAAQRTLYRDVMLETYSSLVSLGHCMAKPELIFNLEQGLGPQSTEGASVWNLSGVGKVSS

SEQ ID NO: 11542 - protein, 81 aa, Mus musculus
DMGLVSFEDVAVDFTWQEWQELDAAQRTLYRDVMLENYRSLVWLGHCLAKPELISKLEEGFEPWGVAEATEQCLPGAEDQT

SEQ ID NO: 11543 - protein, 81 aa, Mus musculus
MLENYSNLVSLGLAFSKPYLVTFLEKRQQSWDVKQQATVATYPGTKPYKYKECNKTFVRKSLLIQHQRVHTGEKPYKCEQC

SEQ ID NO: 11544 - protein, 81 aa, Cavia porcellus
ETVTFRDVAIDFTKEEWKQLDPAQRNLYRNVMLENYNNLITVGYPFTKPDVIFKLEQEEDPWVVEEEVLRRHYPGEIWGID

SEQ ID NO: 11545 - protein, 81 aa, Cavia porcellus
YQELVTFRDVAVDFSQEEWDCLDSSQKHLYSNVMLENYRILASLGLCFSKPSVILLLEQGKEPWMVKRELTNGLSSGWKSV

SEQ ID NO: 11546 - protein, 81 aa, Cavia porcellus
VSVSFTDVTVDFTQEEWEQLDPTQRILYMDVMLENYSNLLSVEVWKADDQMEREHENPDEQARQFMILKNQTALEEGGNLF

SEQ ID NO: 11547 - protein, 81 aa, Cavia porcellus
GPVSFKDVAVDFTQEEWRQLDASEKMTYRDVMLENYSNLVSVDEVWQADDLMERVQGNVSEKAFSVEMSPVASRKISSRCD

SEQ ID NO: 11548 - protein, 81 aa, Cricetulus griseus
NVLSYEDVHIHFTCEEWTLLDTSQKNIYKDIMLETYKNLNDIGYSWEDHTIEEHFPCSKRYERKSSQTAETPSIHTQFVTA

SEQ ID NO: 11549 - protein, 81 aa, Cricetulus griseus
DILTFKDVAIGFSREEWECLDSAQRALYRDVMLENYSNLVSVGYLIFHAGEKPCKCSLCEKCFRSSTYIMRHKRMHTEEKQ

SEQ ID NO: 11550 - protein, 81 aa, Cricetulus griseus
ISFRDVAVDLSQEEWECLDCAQRALYLDVMLENYSNLVFVENVIESLTHRLIHVFPNCINFPENHCIYGKYEKILDQGTKH

SEQ ID NO: 11551 - protein, 81 aa, Cricetulus griseus
SQEMVTFKDVAVVFSKEELVLLDAAQRKLYRDVMLDTFRTLLSVAHEPFKPGLIAQLENEEKLCMVEAQAGSKGGHAVESH

SEQ ID NO: 11552 - protein, 81 aa, Cricetulus griseus
KPRSFGRAARNADFSAEERECLGPDQWNLYRDVMLENFSNLVFLGLASSKPYLVTFLEQSQGSNDMKRQGSAAMQTGNKPL

SEQ ID NO: 11553 - protein, 81 aa, Cricetulus griseus
VGFLKNCNKDEAVDFTQEEWATKDPPQNDIPSDVTAENCKNPASVGCQTLTKPNALTCLKEELVTTQRGGVQEVEKQLHTK

SEQ ID NO: 11554 - protein, 81 aa, Cricetulus griseus
AETIFFQSLLTFKDVAINFSKQEWEFLNTSQRELYRHVMLENYSNLVSVGLSESKPELVTCLEENKEPWIMNIDEAEGLEP

SEQ ID NO: 11555 - protein, 81 aa, Cricetulus griseus
FQSLLTFKDVAINFSKEEWECLHTSQKDLYRDVMLEHYGNLVSVGLSESKPELVTCLEENKEPWMVNIDEAEGLGQECLAI

SEQ ID NO: 11556 - protein, 81 aa, Cricetulus griseus
VLQGLEFKDVVIYFSREEWECLHHSHRNLYQNVMLENYSNLISLDWVSGREGKNLLPKDGYKIRSLQQKMAKKQTHLNVED

SEQ ID NO: 11557 - protein, 81 aa, Cricetulus griseus
HKDAVTYEDVHVNFTQEEWALLDPSQKSLYKDVMLETWENLISIGYKWEDPNIEDHCQSPRKHGRSLQDLYHERVLDFVKG

SEQ ID NO: 11558 - protein, 81 aa, Cricetulus griseus
GCVSFEDVAVYFSWEEWKLLDDSQRLLYQTVMTDIFELVSSLRLELSGISDITQVESCGDLSAPALRFTTPCLWTGCWIKV

SEQ ID NO: 11559 - protein, 81 aa, Cricetulus griseus
EKQFSFQNLLTFEDVAIIFSKEEWECLNTSERYLYRGVMLENYSNLVSVGLSGSKPELVTCLEQYKEPWMVNIEDSEVLEP

SEQ ID NO: 11560 - protein, 81 aa, Cricetulus griseus
ARGKSKSKASVTFGDLAIYFSREEWEWLSPIQKDLYEDVMLENYQTLVSLGLVCRRPNIITLLEKGKAPWMVEPSRRRRGP

SEQ ID NO: 11561 - protein, 81 aa, Peromyscus maniculatus
MGLVLFEDVAVHFTRREWQELDAAQRTLYRDVMLENYSNLLFLEPRMAKPKLIFNLERGHGPWSLAEASVPSFAGVHKVSA

SEQ ID NO: 11562 - protein, 81 aa, Peromyscus maniculatus
FQGLLTVRDVIVDFSQEEWECLDSSQRALYIDVMLENYSNLVSVGQQVIYSLFLKEKLKEKKQKEMADSPVNMSQGLLTFR

SEQ ID NO: 11563 - protein, 81 aa, Mesocricetus auratus
PQGLLSLRDVSVDFSQEEWECLDFDQRALYMDVMLENYNNLLFVDFHHVCGKWETVLHQGTKHFIHDNENIQEKSYTCHES

SEQ ID NO: 11564 - protein, 81 aa, Mesocricetus auratus
PKVPVTFDDVAVHFSEQEWGNLSEWQKELYKNVMRGNYESLVSMDYAISKPDLMSQMERGERPGMQEQEDSEEGETPTDPS

SEQ ID NO: 11565 - protein, 81 aa, Mesocricetus auratus
PQSLLSFRDVAVDLSQEEWECLNCAQRALYMDVMLENYNNLLFVGNHCTFGKYETVLDQGTKHIVHDHMNIQEKPSQYNEI

SEQ ID NO: 11566 - protein, 81 aa, Mesocricetus auratus
VKGLVTFEDVCVDFTWEEWQNLDDAQRKLYRDVMLETYRSLESLGHCITKPEVIFKLEQGTWPWRVEDAPEQRWPDVQKVN

SEQ ID NO: 11567 - protein, 81 aa, Mesocricetus auratus
SQGLVTIKDVSLCFSQEEWRSLDPSQTDFYGEYVMQENCGIVVSLRFPIPKLDMLSQPGGEEQWVPDHQNLEGRDTLKVMY

SEQ ID NO: 11568 - protein, 81 aa, Mesocricetus auratus
EEGCVSFEDVAVYFSWEEWKLLDDSQRLLYQTVMTDIFELVSSLRLELSGISDITQVESCGDLSVPALRFTTPCLWTGCWI

SEQ ID NO: 11569 - protein, 81 aa, Ictidomys tridecemlineatus
GPVSFKDVAVDFTQEEWQQLDPDEKVTYRDVMLENYSNLVSVGYHIIKPDVIIKLEQGEEPWIVEGEFPPQSYPDEVWQVE

SEQ ID NO: 11570 - protein, 81 aa, Ictidomys tridecemlineatus
NFWILRLPPGSKGEVPKEWGKLEDWQKELYKHVMRGNYETLVSLDYAISKPEVLSQIEQGKEPCTWRRAGPKVPDVPVDPS

SEQ ID NO: 11571 - protein, 81 aa, Marmota monax
AQESVTFRDVAVLFSQDEWLHLDSAQRTLYREVMLENYSSLVSLGIPFSTPKVICQLQQGEDPCMVEREAPPDTCPDFKTL

SEQ ID NO: 11572 - protein, 81 aa, Marmota monax
AQESVSFKDVTVDFSQEEWQHLDSAQKTLYMDVMLENYCHLISVGCDITKPDMILKLERGEEPWMSFAGHACLEENWKAED

SEQ ID NO: 11573 - protein, 81 aa, Marmota monax
VTFEDVVVTFTLGEWTLLDPSQKQLYRDVMWDTFKNLASIKKERGDQTTEDVHQNPRREISQEEGRCCEHKESNQCGESVS

SEQ ID NO: 11574 - protein, 81 aa, Heterocephalus glaber
MMFSDVSIDFSQEEWECLTDDQRDLYRDVMLENYSNLVSMAGLCISKPNVISYLEQGKEPWLVDRELRRAQWPESRYETKK

SEQ ID NO: 11575 - protein, 81 aa, Heterocephalus glaber
TVTFEDVAVNFTMEEWTLLNPSQKKLYRDVMRETFRNMTAIADSLACREPLIGHLSQNVPLIAHTALKPYKYLGSEESHYK

SEQ ID NO: 11576 - protein, 81 aa, Cricetulus griseus
MLENYNNVISVEHHFSKPNVISQLEEVEDFWPVERESPQETFPGQKRVPHIIMDICEPQFAGSELGSGHREEQPVVLATDT

SEQ ID NO: 11577 - protein, 81 aa, Cricetulus griseus
SQESVTFQDIAVDFTEKEWPLLDSSQRKLYKDVMLENYSILTSLGYQVGKPSLISHLEREEELRMEERGMQLGASPDWGTP

SEQ ID NO: 11578 - protein, 81 aa, Cricetulus griseus
VEGSVSFEDVAVDFTQQEWYRLDSTQRNMHKDVMLETYSHLASVGLCVAKPDMIFKLERGEELWVLEEESSDHDYSGPLSL

SEQ ID NO: 11579 - protein, 81 aa, Cricetulus griseus
MLENYRNLVFLGLAVSKPYLVTCLEQRKEPWNVKRQKTMVLFPAMFPHYDQDFSPEQNIKYSFQELINGSHRNYGLDNVYF

SEQ ID NO: 11580 - protein, 81 aa, Cricetulus griseus
NLENLLRNRNFWVLRLPPGSKGEAPKVPVTFVDIAVYFSEDEWKNLDEWQKELYSNLVKENYKTLMSLGKDASPPLVRALC

SEQ ID NO: 11581 - protein, 81 aa, Cricetulus griseus
VIYDDVHINFTQEEWALLNSSQKSLYKDVMLDTYRNLTAIGYSCEDHNIEEHCQSSRRHRRKSPISQAQSRLLHLLGRVAP

SEQ ID NO: 11582 - protein, 81 aa, Peromyscus maniculatus
MATLGVSPTFGYQVGKPNLISHLEQEEELRMEERDIQWGTSPDWGTSAKIKWSIVMEDIFGEETSNGVTLEKSHLLEKSSE

SEQ ID NO: 11583 - protein, 81 aa, Peromyscus maniculatus
KVPISFKDLAVRFSEEEWRILQEGQREFYRDVMRENYETLVSVGTSELLPLSAFLSPTEPGGATAGEGHHDKGQEPPLERG

SEQ ID NO: 11584 - protein, 81 aa, Peromyscus maniculatus
MAELKEEWDYLDPARRSLYKDVMMDSYGNLVSLDVLNRNKNEEPTVKEEIEEDIDPPGVIVTRIKSEIDQDPIGRETFELV

SEQ ID NO: 11585 - protein, 81 aa, Peromyscus maniculatus
RPRALKFADVAVYFSPEEWGCLRPAQRLLYREVMRETYGLLGALETRTRQKNEEKEVFPPKEAPRKGKRGRKPSKPRLVPR

SEQ ID NO: 11586 - protein, 81 aa, Peromyscus maniculatus
LQETVTFRDVAVVFSEEELGLLDAAQKQLYRDVMLENFRTLLSVAHQPFKPDLIAQLEKEEKLCMEETQGGGYSGSEGGHA

SEQ ID NO: 11587 - protein, 81 aa, Peromyscus maniculatus
MNTVTYDDVRIDFTWEEWTLLDPSQKNLYKDVMLETYRNLTSIGYIWEDHNIEEYCQSSRGHERQERSQTEEIPSVYTQCD

SEQ ID NO: 11588 - protein, 81 aa, Peromyscus maniculatus
YQELVSFEDVTVAFTQEEWSSLNPAQRSLYRDVMLENYQNLVTVGYQLIKPSLVSWLEQEEFSTGQKIVFPEWKMQLENKC

SEQ ID NO: 11589 - protein, 81 aa, Peromyscus maniculatus
MDAVTYEDVHVTFTQEEWALLDPSQKRLYKDVMFETYQNLTDIGYKWEDQNIEEHCQSSRRHGRYIICHSGHKPCDPKGYG

SEQ ID NO: 11590 - protein, 81 aa, Peromyscus maniculatus
MEEWILLDPSQKNLYKDVMLETYRNLSIIGYSSEDHNIEEHCQNSRRHERHERSQTGDKPSVYPQYGKAFTYHSHLQMHER

SEQ ID NO: 11591 - protein, 81 aa, Peromyscus maniculatus
MEEWALLDPSQKNLYNNVMLETYMNLSAIGYTWEDHKVEEHCQSSQRHGRHERSYTGDQSSEWTLCVNSFAYQSHLQRHER

SEQ ID NO: 11592 - protein, 81 aa, Ictidomys tridecemlineatus
MPLTFQDVAVYFSPAEGQQLGPQQRALYRDVMLENYGNVASLGFPVPKPELISQLEQGEELWVMDLLGAEESEVLRNCRTD

SEQ ID NO: 11593 - protein, 81 aa, Ictidomys tridecemlineatus
TLGPVSFKDVTVEFSGEEWQHLDLAQRSLYRDVMLENYFNLISVGCPVPKPEVIFNLEQAEPRVWDEEASGQHCADGDIGF

SEQ ID NO: 11594 - protein, 81 aa, Marmota monax
MLENCRNLASLGCHVDKHSLISQLEQEDKTVTEERGILPSTCPDLDTVLKTKWLTPKKHVFRKEQTKSIKMERSHRGVKIN

SEQ ID NO: 11595 - protein, 81 aa, Heterocephalus glaber
PQGSVTFRDVAIGFSQEEWKWLQPAQRDLYRCVMLENYGHLVSLGLSIFKPVVVSLLEQGNEPWLGKGDMSRDLFSVSQSN

SEQ ID NO: 11596 - protein, 81 aa, Heterocephalus glaber
FQEFVTFEDVAVYLTREEWGRLDPVQRDLYREVMLENYGNVVSLGFPISTPDGISQLEQDLQVFDLETKNREVLRGDSSDG

SEQ ID NO: 11597 - protein, 81 aa, Heterocephalus glaber
SIVFKDVAITFSRREWRKLEPFQKELYKDVLQENLRNLEFLECEPKGELEVSVQNCNVFMEDLTLEKIIEECFKDDGCGLI

SEQ ID NO: 11598 - protein, 81 aa, Heterocephalus glaber
LKESVTFKDVAVDFTREEWHHMDSAQRSLYRDVILENYSHLVSLVYQVSKPEVIFKLEQGEEPWISEGEIQRLFCSDWKTR

SEQ ID NO: 11599 - protein, 81 aa, Heterocephalus glaber
EAVTFEDVAMNFSREEWALLDPSQKKLYRDVMWETLRNLAAIGESFSSRRPLIGHLSADGPIMANTQLKSYEQHGFQEKLS

SEQ ID NO: 11600 - protein, 81 aa, Mus caroli
SQVSVTFEDVAVLFTRDEWKKLVPSQRSLYREVMLENYSNLASLGFPFTKPKVISLLQQGEDPWKVEEEGPGGFSLGLKCS

SEQ ID NO: 11601 - protein, 81 aa, Mus musculus
VSFEDVAVHFTQDEWDLLDPFQKSLYRDVMLETCRNLAAIGYIWEEQNVEDDCKNFGRIQRHVISDSEYLLDEQEGYGNKP

SEQ ID NO: 11602 - protein, 81 aa, Mus musculus
MDAVTYEDVHVNFSQEEWALLDPSQKSLYKDVMLETYWNLTCIGYKWEDHNIEDQHQSSGRHGRCINCPSAYGKKQCTNLF

SEQ ID NO: 11603 - protein, 81 aa, Mus musculus
LLHGCCSLETHSIRDKNAVTYGDVHVNFTQEEWALLDPSQKKLYKDVMLETYRNLNAIGFNWDDKNTEEHCPSTRRWRRYP

SEQ ID NO: 11604 - protein, 81 aa, Mus musculus
MDLVTYDDVHVNFTQEEWALLDASQKSLYKGVMVETYRNLTAIGYSWEEHTIEDHFQTSRSHGRYERRSSAEQHSEFIQCG

SEQ ID NO: 11605 - protein, 81 aa, Mus musculus
MEEMLSFRDVAVDFSAEEWECLEPAQWNLYRDVMLENYSHLVFLGLAFSKPYLVTFLEQRQEPLNEKRQVATTMHPDIKPY

SEQ ID NO: 11606 - protein, 81 aa, Mus musculus
KKEMLSFWDVAIDFSPEEWECLEPAQWDLYRDVMLENFSHLVFLGLAVSKPFLVTFLEQIQGPWDMKRQGTAPVYPGIIPN

SEQ ID NO: 11607 - protein, 81 aa, Mus musculus
FQGLLTFRDVAVDFSQEEWECLDSAQRALYIGVMLENYSNLVSVGIIVCKADLVPHLEQIYIPWNVKIKEMVAKPGRESYR

SEQ ID NO: 11608 - protein, 81 aa, Cricetulus griseus
WEEMLSFWDVAIEFSPEERECLEPAQWNLYRDVMLENYSHLNFLGATPNDYNVYNKTIECNSVSVQHQRIHTKEKPYKCKE

SEQ ID NO: 11609 - protein, 81 aa, Cricetulus griseus
RGAFCRFSTCLTHGKCIEEPFWLQPTRSDSTAKQLIPTLLIFLLTGYDVTKPNVIIKLEQGEEPWMMEGDCHAQSHLEISK

SEQ ID NO: 11610 - protein, 81 aa, Cricetulus griseus
EKQFSFQSLLTFEDVAINFSKEEWECLNTSQRDLYRFVMLENYSNLVSVGLSVSKPELVTCLEQNKEPWMVNIEDSEVLEP

SEQ ID NO: 11611 - protein, 81 aa, Peromyscus maniculatus
KVPVTFVDIAVYFSEDEWKNLDEWQKELYSNLVKENYKTLMSLDTDGPVSKPDAPVQAEPREEPCVWEQQHPEEREIPVAA

SEQ ID NO: 11612 - protein, 81 aa, Peromyscus maniculatus
SAKLVTFEDVAVYFTQTEWDSLSPEQRALYRDVMLENYRNLASMGFPLLKPALISQLEEGKDLENLSQLATGTDSQGLWTE

SEQ ID NO: 11613 - protein, 81 aa, Peromyscus maniculatus
MEEMLSFCDVAIEFSAEERECLKPAQWNLYRDIMLENYSNLDFLGLAVSKPHLVTFLEQTQGPGDVKRQATDSVHPGTIPN

SEQ ID NO: 11614 - protein, 81 aa, Peromyscus maniculatus
MQNMLSFKDVAINFSAEEYECLDSAQWNLYRDVMLENYSNLVFLGLSFSKPLLVRFLEKNQELRKSQAAAVRQGKKPYKCK

SEQ ID NO: 11615 - protein, 81 aa, Peromyscus maniculatus
AMNAVTYDDVHVDFTWEEWALLDPSQKRLYKDVMLETYGNLTAIGYKWKDHHIEEHCESSRRHGRHGRSHTGEKPSEYAQS

SEQ ID NO: 11616 - protein, 81 aa, Peromyscus maniculatus
GQVAFTFEDVAVIFTQEEWGQLAPAQRTLYQEVMLENRGLLVSLGYPVPRPELMCRLEHGQELWPVMKDLFPSIHAGNNGK

SEQ ID NO: 11617 - protein, 81 aa, Peromyscus maniculatus
AMELVSFEDIAVYFTWQEWQDLDIAQKLLYRDVMLENYSSLVSLGCCMVKPELILTLEHEFGLWRVADTSVWNLPDVRNLS

SEQ ID NO: 11618 - protein, 81 aa, Mesocricetus auratus
SKGSVSFKDVTVDFTQEEWQQLDPAQKALYRDVMLENYCHFISVGFHITKPDMIRKLEQGEELWTERIFPSQSYLEDEDVL

SEQ ID NO: 11619 - protein, 81 aa, Mesocricetus auratus
VQDLVTFKDVAVLFTQEEWGRLSSAQRALYRDVMLENYSNLASLGLSGSKPDVFFHPEKADKCTPEHASEGVVLGGITMTM

SEQ ID NO: 11620 - protein, 81 aa, Mesocricetus auratus
SQGVLTFGDVSVDFTPEEWQCLDSAQRALCIDVLLENYKNLIYVEKYCKYHPVHIHVKTENESCQCDELGKVLHDPSTCAL

SEQ ID NO: 11621 - protein, 81 aa, Mesocricetus auratus
TEDAVTYDDVHINFTQEEWALLNPSQKSLYKDVMLDTYMNLSAVGYSWDDHSIEEHCQSSRRPIRCLQSHKTTLHEGKHHE

SEQ ID NO: 11622 - protein, 81 aa, Mesocricetus auratus
GSLENDGVCFSEQEWENLEDWQKELYRNVMESNYETLVSLKVLGQPEEAAAELGAEMVGDLVEEGTHLDRTMVKQEVLYKP

SEQ ID NO: 11623 - protein, 81 aa, Mesocricetus auratus
AQGLVTFRDVAVDFSQEEWDFLDSAQKSLYRDVMRENYSHFVSLGPSISKRDAITLLDEGGKEPEIIVREGRRYCPDLESR

SEQ ID NO: 11624 - protein, 81 aa, Mesocricetus auratus
PEGILTFEDLAIDFSHGEWECLDSAQKALYRDVMLENYSNLVSVGITVSKPELINSLEQSKEPWDVNTRETEDKEQCCLIF

SEQ ID NO: 11625 - protein, 81 aa, Mesocricetus auratus
MLFKDVSVVFTQKEWQLLDTAQRRLYREVMLETYRHLQAVGCNVTKPELIRKLERGEGPWESPGCSLSEVQRANNMTTSEE

SEQ ID NO: 11626 - protein, 81 aa, Mesocricetus auratus
PADRDAVTYDDVHIGFTQEEWVLLNPSQKSLYKDVMLDTYRNLTAIGYRWQDHNIEEHCENSRRHRRKFSCTTKPYESLQN

SEQ ID NO: 11627 - protein, 81 aa, Mesocricetus auratus
FQSEVVFRDVTVDFSQEEWECLNSSERDLYKDVMLENYSHLVALGCSISKPDVITLLEQGKEPWMIVRDEKRRWSQELEPR

SEQ ID NO: 11628 - protein, 81 aa, Mesocricetus auratus
PKVSGSLENDGVCFSEQEWENLEDWQKELYRNVMESNYETLVSLKVLGQPEEAAAELGAEMVGDLVEEGTHLADRTMVKQE

SEQ ID NO: 11629 - protein, 81 aa, Marmota monax
MLENYSNLVSMGFYIPKPQVISLLEQGKEPWMVGRELTRGLCSDLESMCESKLLSLKKEVYEIESCQREIMGLTKPGLEYS

SEQ ID NO: 11630 - protein, 81 aa, Heterocephalus glaber
ESVSFEDVAVDFTQEEWILLDPTQRNLYSDVMLENYQNLASMEWKVGLKTKESALHQDFLRGQTSRKIYMAGSHNGAELCD

SEQ ID NO: 11631 - protein, 81 aa, Heterocephalus glaber
MLETYNNLVALGHCSTKPAVIFKLEQGSGPCMVEEAPSRCFPDVQKVNGRIQTNQENQEKHFWQVVTTSAEKKVELVKPFN

SEQ ID NO: 11632 - protein, 81 aa, Heterocephalus glaber
EEVSFEDVAVNFTMEEWALLDPSQKKLYRDVMWETFRNVADIGKNNILSHLCSKRALVIAYQFYTSVNIKPVGTKPNESFG

SEQ ID NO: 11633 - protein, 81 aa, Heterocephalus glaber
MFLPLTFEDVAIYFSEQEWQDLEMWQKELYKGVMRTNYETLVFLDGALSKPELISWIEQGREPFRSWGESQPPGNMALPSA

SEQ ID NO: 11634 - protein, 81 aa, Heterocephalus glaber
SQGPVTFEDMAMYLTREEWRPLDPTQRDLYRDVMQENYGNVVSLDFEIRSENEVNPKQEISEDVEFGTTSEGPGGNVEENP

SEQ ID NO: 11635 - protein, 81 aa, Mus caroli
MEGLLSFRDVAIDFSAEECECLEPAQWKLYRDVMLENYSNLVFLGLAFSKPYLVTFLEQRREPWNVKEAATVAAHPGIKPF

SEQ ID NO: 11636 - protein, 81 aa, Mus caroli
VTLEDVAVNFTLEEWTMLNASQKELYKDVMQDTLRNLSYIGEGNKWEHQNIENECETLWRKLRTSCQEKSLWRYNSQLLET

SEQ ID NO: 11637 - protein, 81 aa, Mus caroli
AVTFMDVAVVFSEEELRLLDAAQRKLYHDVMLENFRNLLAVGGQSPNKIESLHATGVRCLSLGRLPCWQMTSHDVNKLART

SEQ ID NO: 11638 - protein, 81 aa, Mus caroli
GPLTFKDVALDFSLEEWECLSFAQRSLYMDVMLENYNNLLFVENHCLRGKYRKVLDQDSQYIVHEHMNIQEKSSKWDKLSK

SEQ ID NO: 11639 - protein, 81 aa, Mus caroli
VKGLVSFEDVSVDFTWDEWQDLDDSQRKLYRDVMLETYSSLESLGHCITKPEVIFKLEQGAGPWRVEDVPKQSRPDVQKVT

SEQ ID NO: 11640 - protein, 81 aa, Mus caroli
MEAVTFGDVAVHFSREEWQCLDSGQRALYREVMLENHSSVAGLAGFLVFKPELISRLEQGQEPWVLDLQGAEGAEAPRICQ

SEQ ID NO: 11641 - protein, 81 aa, Mus caroli
MLSFWDVAIDFSPEEWECLEPAQWDLYRNVMLENFSHLVFLGLAVSKPFLVTFLEQRQGPWDMKRQGMATVYPGIIPYDPN

SEQ ID NO: 11642 - protein, 81 aa, Mus musculus
EDAVTYDDVHVNFTGEEWKLLDPSQKSLYKDVMLETYWNLTVIGYTWETHHIEGHCQSSRRNERFSLHCQLPWASRIASWV

SEQ ID NO: 11643 - protein, 81 aa, Mus musculus
DAMTFDDVHVNFTKEEWNLLEPSQMNLYKDVMLETYWNLTSIGYKWEDHHIEEPCQSSRRHTRPHEGARFHDTESSVQPPK

SEQ ID NO: 11644 - protein, 81 aa, Cavia porcellus
TGQSISKPDVIDLLEQGKEPWVIRREKKRRPYTDLNLQYKIISYLKIPTHEKDKSSAQHQSIYPRDKLYKCTKCQKKFSSS

SEQ ID NO: 11645 - protein, 81 aa, Cavia porcellus
EMALLTFRDVVINFSLEEWECLDPVQRTLYRDVMLENYRNISSLGLAVSKPHLIICLEQSKDPWTLQTQKRAATPPAVVKS

SEQ ID NO: 11646 - protein, 81 aa, Cricetulus griseus
SHSMGAVTCNDVLTNFPQEEWALLYPSEKSLYKDVMLDTYGNLNVIGCSWEGHNIEENCQTSRSHRREMPHLYPLEEEMGR

SEQ ID NO: 11647 - protein, 81 aa, Cricetulus griseus
GCVSFNDVAIYFLREEWTLLDGSQRRLYHHVMMEVFVLMSSLGLIPSGTHDIAQLASSRDRFIPALRFLTPRVKVEKIPSG

SEQ ID NO: 11648 - protein, 81 aa, Cricetulus griseus
PSDNSGDGLAAARYPTQGPDLPKPAVISQLEQGAELWVTERGGTRACHPGKNPTKWEQDHPEKELSPITERDGFERAISCH

SEQ ID NO: 11649 - protein, 81 aa, Peromyscus maniculatus
VMDAVTYEDVHINFTCEEWALLGPTQKSLYKDVTLETYRVRHHRPSSGSLPILFSGQIVKAEGGEYRRKEVEEENSPEAAV

SEQ ID NO: 11650 - protein, 81 aa, Peromyscus maniculatus
SQVSVTFEDVAVLFTRDEWKKLDHSQRSLYREVMLENYSNLASLGFPFTKPKMISVLQQGEEPWKAEKESHGGSSLGCNSS

SEQ ID NO: 11651 - protein, 81 aa, Peromyscus maniculatus
MAELKEWDYLDPARRSLYKDVMMDSYGNLVSLDVLNRNKNEEPTVKEEIEEDIDPPGVIVTRIKSEIDQDPIGRETFELVG

SEQ ID NO: 11652 - protein, 81 aa, Peromyscus maniculatus
MRPVQKELYKTVTLQNYWNMVSLGLTVYRPTVIPILEEPWMVIKEIVEGPSPESETKAEAHIPLKDLPTFKQDGTQTVKQD

SEQ ID NO: 11653 - protein, 81 aa, Peromyscus maniculatus
MDVLAFEDVAVKFSQEEWILLDPSQKKLYRDVMLETCSYLTFIGIKWENQNIEEQCKHSWRYLRNYMVDAVCEDKEGGQFR

SEQ ID NO: 11654 - protein, 81 aa, Peromyscus maniculatus
PELVSFADVAVYFSPQEWGCLRPAQRALYREVMRETYGLLGALAASVTFHSQGFLGSLHSGDTSDKKEEGCKEGAERPAET

SEQ ID NO: 11655 - protein, 81 aa, Peromyscus maniculatus
WLCNLEKGILTFEDVAIDFSQEAWECLDSTQWALYRDMILENYSNLVSVGLTITKPELINSLEQSKEPWKVTLKASKNSDL

SEQ ID NO: 11656 - protein, 81 aa, Peromyscus maniculatus
MGSVSFEDISLDFTWDEWQDLDSAQRTLYRDVMLENYSSLMFLGHCTTKPELIFKLEHGFGPWSLAEASIQSLPGVHKMTV

SEQ ID NO: 11657 - protein, 81 aa, Peromyscus maniculatus
DMRLVSFEDVAVDFTWQEWQELDAAQRTLYRDVMLENYRSLVWLGHCLAKPELISKLEQGLVPWSGAEATEQCLPDVHKWS

SEQ ID NO: 11658 - protein, 81 aa, Peromyscus maniculatus
RTNAVTYDDVHIDFTWEEWALLDLSQKNLYKDVMLETYRNLTTIGYNWKDHNIEEHYQSSRRHGRPERSLTGEKPCEYTQR

SEQ ID NO: 11659 - protein, 81 aa, Mesocricetus auratus
VTRLYKTVTFKDVAVDLTQEEWQQMKPAQRNLYRDVMLETYSNLVTVGYQATKPDVIFKLEQEEEPWVLEEEMFWRHSPGE

SEQ ID NO: 11660 - protein, 81 aa, Mesocricetus auratus
SQGLVTFGDVAVVFSQEEWEWLSSEQRSLYWRVMLDNYRNLASLGLCASKPDMIALLEQGKDPCVLKRKTARGLRPDLEAV

SEQ ID NO: 11661 - protein, 81 aa, Mesocricetus auratus
MAMYLTREEWRPLDPTQRDLYRDVMQENYGNVVSLDFEIRSENEVNQKQELSEDVEFVTMSEEPIGDAEKNPESEEVFESG

SEQ ID NO: 11662 - protein, 81 aa, Mesocricetus auratus
MDFVTFEDVIVNFTQDEWALLDSSQKNLYREVVGEIFMNLASMGERWDQNIEDWYRNQGRILSNHIIERFGNSKQGSHCGE

SEQ ID NO: 11663 - protein, 81 aa, Mesocricetus auratus
SQEPLTFKDVAVDLSPEEWGQLAPAFRDLYREVMLENYRNLVSVGYQLSKPSVISQLEKGEGPWMAESQGPEDPMLETKET

SEQ ID NO: 11664 - protein, 81 aa, Mesocricetus auratus
AQGLVTFRDVAVDFSQEEWDFLDSAQKSLYRDVMRENYSHFVSLAGPSISKRDAITLLDEGGKEPEIIVREGRRYCPDLES

SEQ ID NO: 11665 - protein, 81 aa, Ictidomys tridecemlineatus
LELLTLEDVAVAFTREEWQLLGPGQKDLYRDVMLENYSNLVSVGYPVSKPDALSKLEQGEEPWTEDEMHTWICPENDKVDH

SEQ ID NO: 11666 - protein, 81 aa, Heterocephalus glaber
RNRNFWILRLPPGSKGEEWGKLEDWQKELYKHVMRGNYETLVSLDYAISKPEVLSQIDQGKDPCTWRRTGPKIPDVPVDPS

SEQ ID NO: 11667 - protein, 81 aa, Heterocephalus glaber
EAVTFEDVTVNFTMEEWALLNASQKKLYRDVMGETFMNIAAIGRAWDNQEVEEEYKKYWRNLRNEQVVKHYQYKAWTQYEE

SEQ ID NO: 11668 - protein, 81 aa, Heterocephalus glaber
VTFEDVFVYFSQEEWELLEEAQRFLYHDVMLENFALVATLAAALCQIPCNCPVGEGQKAQVSGREDTTLVTVEKGFCFPAN

SEQ ID NO: 11669 - protein, 81 aa, Mus caroli
MLETYSNLVSLGYDVTKPNMIIKLEQGEEPWTVEGDRHAQRHLEISKVYDPREGIEEIGEKHLQCGDDPHCWRAEKGAAFD

SEQ ID NO: 11670 - protein, 81 aa, Mus caroli
GSVSFEDVAVNFTVEEWALLDPSQKKLHKDVMEETFRNLAAIGKTQDQNIDEDHRYSRRNQRNDVVERLLEHSKGTESKEI

SEQ ID NO: 11671 - protein, 81 aa, Neotoma lepida
RPRALKFADVAVYFSLEEWGCLRPAQRMLYRDVMRETYGLLGALGCAGPKPALISWLERNTDAWEPAALDPQEYRRWVTFQ

SEQ ID NO: 11672 - protein, 81 aa, Mus musculus
EEDCLSFEDVAVYFSWEEWTLLDDSQRLLYQTVMSEILTLMSSLGLIPSGIHEMTQLKSWGEPSVPALRFLTPGCWIKVDS

SEQ ID NO: 11673 - protein, 81 aa, Mus caroli
SKGWLSFRDVAIDFSPEECECLDAAQWDLYSDVMLENYSNLVSLGLAFSKPYLVTFLEKRQQSWDVKQQATVATYPGTKPY

SEQ ID NO: 11674 - protein, 81 aa, Mus musculus
SQGLLTFRDVAVDFSQEEWECLDSAQRALYIDVMVENYSNLVSVENYCICDTVHQPVRTEKESCPCNELNEMLHEPSNCAL

SEQ ID NO: 11675 - protein, 81 aa, Cavia porcellus
MLENYSNLLSLGILFSKPEVISQLEQTEDSQVVGTGALRGLCRGWESLFETTISKEANQEAMKNFLMDSPLNFKFGKTYIN

SEQ ID NO: 11676 - protein, 81 aa, Cavia porcellus
FQEAVTFGDVAVHFSREEWQCLDSGQRALYREVMLENHSSVAGLAGFLVFKPELISRLEQGQEPWVLDLQGAEGTEASRTF

SEQ ID NO: 11677 - protein, 81 aa, Cricetulus griseus
FQDLLTFKDVSVDFSREEWQCLDTSQRALYVDVMLENYNNLVSVENYYICDPVHQHKKTEKKSCQCTEFGKILHDPSTCAL

SEQ ID NO: 11678 - protein, 81 aa, Cricetulus griseus
FQGVLTFRDVAVDFSQEEWGCLDSAQRALCIDVMLENYSNLLYVENYSKCDPVRHHVKTEKESCQCNELGKVLHDPSTCAL

SEQ ID NO: 11679 - protein, 81 aa, Cricetulus griseus
MLETYSNLVTVVGSSISKPDLITLLEQEREPWMVVKEGTNRPSPDLESDCEAQKRSPGNHNINPSKESIKHISKTSDLQGS

SEQ ID NO: 11680 - protein, 81 aa, Cricetulus griseus
PSKSHGLDPEASAQTRAYLSLFSGEEYQEAVTFGDVAVHFSREEWQCLDSGQRALYREVMLENHSSVAGLGEATPGDPLQT

SEQ ID NO: 11681 - protein, 81 aa, Cricetulus griseus
MQAQDFLAFEDVAVKFSQEEWILLDPSQKKLYRDVMLETCINLTSLGIKWEDKNIEEQYKHSWRYLRSYMVDAINEHKEGG

SEQ ID NO: 11682 - protein, 81 aa, Cricetulus griseus
DAVAYDDVLIKFTQEEWALLNNSQKNLYKDVMMDTYRNRSDIGIFKGMKKFILERNHMNVFNIVKSLHVTVVTNSIKEHKL

SEQ ID NO: 11683 - protein, 81 aa, Cricetulus griseus
EPVTFEDVAVDFTSEEWALLDSSQKKLYRDVMKETFFNLISIEKTLEKNIEEDYEDLSRNMGTPVLGEDCGYECDTECDKK

SEQ ID NO: 11684 - protein, 81 aa, Peromyscus maniculatus
SEGTVTFKDVAIDFTPEEWKQLDPTQRNLYRNVMLENYNNLITVGSPVTKPDVIFKLEQEEEPCVVEKEVLKRHCPGEIWA

SEQ ID NO: 11685 - protein, 81 aa, Peromyscus maniculatus
SQGLLTFGDVALDFSQEEWECLDSAQRALYIDVMLENYSNLVSVENHCMCGKFNKVLDQDSNYIVHQLVNIQEKSYKYNQL

SEQ ID NO: 11686 - protein, 81 aa, Peromyscus maniculatus
LQETVTFRDVAVVFSEEELGLLDAAQKQLYRDVMLENFRTLLSVAHQPFKPDLIAQLEKEEKLCMEETQGGSEGGHAVHSA

SEQ ID NO: 11687 - protein, 81 aa, Peromyscus maniculatus
PFKTVTFKDVAVDLTQEEWQQMKPAQRSLYRDVMLETYSNLVTVGCQVNKPDVILKLEQEEEPWVLEEEMFWRHSPEARRG

SEQ ID NO: 11688 - protein, 81 aa, Peromyscus maniculatus
NAVTYNDVHVDITQEEWALMDPSQRNLYKDVMVETYMNLTAIGYNWEDLEVEEHCQNSLKHGRHEKTQTGEKSYEYNQCSK

SEQ ID NO: 11689 - protein, 81 aa, Peromyscus maniculatus
SQGVLTFRDVTVNFLKDEWDCLESAQRALYIDVMLENYKNLVFVENYWNCDPVYQHVKTEKESCQCTELGKVLHDPSICAL

SEQ ID NO: 11690 - protein, 81 aa, Peromyscus maniculatus
NAVTYDDVHIDFTWAEWTLLDPSQKNLYKDVMLETYRNLTTIGYSWEDHDIEDHCKSSRRHERQERIHIGEQSSEHTECVK

SEQ ID NO: 11691 - protein, 81 aa, Peromyscus maniculatus
ESVTSEDVAVKFSMEEWALLSPSQKKLYRDVMQETFRNLAAIGMEQEDQNFEKDYRCSQRNPKSQMGKSLCEHNEDNQCVE

SEQ ID NO: 11692 - protein, 81 aa, Peromyscus maniculatus
SAVTYDDVHMDFSVEEWALLDSSQKNLYKDVMIETCRNLTAIGYSWEDHNTKKHCQSFRRQGRNERNHTGDKLTENTQCVK

SEQ ID NO: 11693 - protein, 81 aa, Peromyscus maniculatus
DSVTFEDVAVNFTVEEWALLDPSQKKLHRDVMEETFRNLAAIGKPQKDQHIDNDHRYSRRNQRNEVVERLLEHNKDNECEE

SEQ ID NO: 11694 - protein, 81 aa, Peromyscus maniculatus
ESVTFEDVAVHFTMEEWIMLDLSQKDLYKDVMKEILRNMVSIGNIRKHQKIENEYQNSERKRSCQLVEKLHDCKEGHKCAE

SEQ ID NO: 11695 - protein, 81 aa, Peromyscus maniculatus
DMNAVTYDDVHVGFTWEEWTLLDRSQKNLYKDVMLETYRNLTTIGYSWEDHNIEEHCQSSRRHERHERSHNAEKPSVYTQC

SEQ ID NO: 11696 - protein, 81 aa, Peromyscus maniculatus
YEGLLTFRDLDVDFSQEEWECLDSAWRTLYIDVMLENYRNLIFVEKHRICGKYESIMDQGSNSTVYQHVNIQKKSYNNNDL

SEQ ID NO: 11697 - protein, 81 aa, Peromyscus maniculatus
MDPSQRNLYKDVMVETYMNLTAIGYNWEDLEVEEHCQNSLKHGRHERTHTGEKPYQCNQCGKAFAWPRYLQVHKRSHTGEK

SEQ ID NO: 11698 - protein, 81 aa, Ictidomys tridecemlineatus
MFFLFLRAGIPFSKPKLITQLEQGKETWREERKCLLSTCPAEAKPELQPGPLCPPDFSSQKFPVQQVLCNHPPWIFTCLCA

SEQ ID NO: 11699 - protein, 81 aa, Mesocricetus auratus
MASPSPLLEPKEEWDYLDPARRSLYKDVMMDSYGNMLSLDVLNRNKGEEPTVKEEIEEDTEPPGIMVTRIKSEIDEDPICT

SEQ ID NO: 11700 - protein, 81 aa, Marmota monax
MTEALQPSSQVQVLFHFSLTGYHIIKPDVIIKLEQGEEPWIVEGEFPPQSYPDEVWQVEDPMEKLQEDEDMFFINKTLGEE

SEQ ID NO: 11701 - protein, 81 aa, Marmota monax
NRVSPFKDMILCFSEEDWSLLDPAQTGFYGEFIIGEDYGVSMPANDPAAQPDLLQGEENGPRVPELQDLQGKEEPQVSYLD

SEQ ID NO: 11702 - protein, 81 aa, Marmota monax
LVMFEEVSVCFTSEEWACLGPIQRALYWDVMLENYGNVTSLEWETMTENEEVTSKPNISQRADAQKGISKRLQGSVSQVPG

SEQ ID NO: 11703 - protein, 81 aa, Marmota monax
FQELVSFNDVTVGFTQEEWQHLDPSQRSLYREVMLENYSHLVSVGYCVTKPEVIFRLEQGEEPWISEAEFPSQSFPELWKA

SEQ ID NO: 11704 - protein, 81 aa, Marmota monax
NEMVTFKDVAVVFSGEELELLDSAQWKLYQDVMLENFRNLLSVGGRIQTELETFPEAGPHEELSWQQIWEQIASDSTFSQD

SEQ ID NO: 11705 - protein, 81 aa, Heterocephalus glaber
AGHPPEMAVCKPEGRGAEEWEKLGPAQKDLYKDVMLENYSNLASIGYQAPKPDICKLEKEEGAWSGKGKRSSQNHLSKLTR

SEQ ID NO: 11706 - protein, 81 aa, Heterocephalus glaber
RLAPVTFSDLAIYFSQEEWEWLSPTQKELYEEVMLENYRNLVSVGLCLRRPNVITLLEKGKEPWIMEPPRRRWCPDLASKC

SEQ ID NO: 11707 - protein, 81 aa, Mus caroli
VCGSVTFKDVAVDFSQEEWACLDATQKVLYRDMMLETYSNLVAVVGHCISKPDLIVLLEQEKEPWMTVKEETDRPSPDLEA

SEQ ID NO: 11708 - protein, 81 aa, Mus caroli
KPELVSFADVAVYFSPQEWGCLRPAQRALYREVMRETYGLLGALGFPGPKPALISWMEQGSEAWSPAAQDPEEGERLGGAP

SEQ ID NO: 11709 - protein, 81 aa, Cavia porcellus
PKALVTFVDLAVYFSQEEWEWLSPSQKDLYEEVMLENYRNLVSMGLCLRRPNVITLLEKGKEPWMVEPLRRRWALASKSEA

SEQ ID NO: 11710 - protein, 81 aa, Cricetulus griseus
SLGPLSFKDVAVAFTQEEWRQLGSEEKTTYRDVMLENYSNLISVGYHIIKPDVIIKLEQGEEPWIVEGTFSPQSYPDEIWQ

SEQ ID NO: 11711 - protein, 81 aa, Cricetulus griseus
MLSFWDVAIEFSPEERECLEPAQWNLYRDVMLENYSHLDFLGLAVPKPHLVTFLEQKQEPSGVKRQAAATVHPGTTPNDYN

SEQ ID NO: 11712 - protein, 81 aa, Cricetulus griseus
GKQFSFLGLLTFKDVAINFSKEEWEFLNTSQRDLYRDVVLENYSNLVSVGLSKSKPELVTCLEQNKEPWMVTIEEAEGMEP

SEQ ID NO: 11713 - protein, 81 aa, Cricetulus griseus
VSVTFEDVAVLFTRDEWKKLDHSQRSLYREVMLENYSNLASLGFPFTKPEMISVLQQGEEPWKIEKGSHSSSLGCNSSLQT

SEQ ID NO: 11714 - protein, 81 aa, Cricetulus griseus
EKQFSFQSLLTFKDVAIKFSKEEWECLNTSQRDLYRFVMLENYSSLVSVGLSGSKPELVTCLEQNKEPWMVNKEESEVLEE

SEQ ID NO: 11715 - protein, 81 aa, Cricetulus griseus
LSESKPELVTCLEENKEPWMVNIDEAVGLGQDVFCYTIQEMIPKEGTQDTCQREMPGCLGNNSPGELHIRKFSVYTCKGCG

SEQ ID NO: 11716 - protein, 81 aa, Cricetulus griseus
FQDLLTFKDVSVDFSREEWQCLDSSQRALYVDVMLENYNNLVSVENYYICDPVHQHKKTEKKSCQCTEFGKILHDPSTCAL

SEQ ID NO: 11717 - protein, 81 aa, Cricetulus griseus
MIFEDVAVNFTSGEWTLLDSSLKKLFRDLMKETFMNLISIEKTQEENIEEEYQSLGRNLGTQVVEKDSDNEHENQCEENQQ

SEQ ID NO: 11718 - protein, 81 aa, Cricetulus griseus
PAALEAPRDVTVDFPQEEWECLDSAQRALCIDVMLENYNNLVFVGEHILLLEFLTHLLLKRSPVSVMSLAKCLMTPPHVHF

SEQ ID NO: 11719 - protein, 81 aa, Cricetulus griseus
NAVTYDDVHVNFTWDEWALLDPSQKNLYKEVMLDTYKNLIDTAYNCEDNNVEEPDQISTQQGRNNKINNEEESSQYTQCDK

SEQ ID NO: 11720 - protein, 81 aa, Cricetulus griseus
DMLSFWDVAIYFSAEEWECLGPAQWNLYRDVILENYNNLVFLGEEFFHDKFLIIVSMNLATSENIWSCFIKAISGDVSGAK

SEQ ID NO: 11721 - protein, 81 aa, Cricetulus griseus
LSESKPELVTCLEENKEPWMVNIDEAEGLEPALFCPPIQEILPKECTQDTCQREVSGVLRNNITGELHMKKFSVCRDKGCG

SEQ ID NO: 11722 - protein, 81 aa, Cricetulus griseus
QVPISFKDLAVRFSEEEWRLLQEGQREFYRDVMRENYETLVSVGTSELLPLSAFLSPTEPGGATGGERHHDKGQEPPLEHG

SEQ ID NO: 11723 - protein, 81 aa, Cricetulus griseus
TCAAEQRGLEGERRQKLKMQGLVTFSDVTVTFSKEEWECMDSAQWNLYTDVMLANYNNLVFVGENILLLEFLTCLLFVVTS

SEQ ID NO: 11724 - protein, 80 aa, Cricetulus griseus
NAVTYDDVRVNFTPDEWAILDPFQKNLYKEVMLDTYKNLTDIGYNLKDHNIEEPDQISTQHGSLLHHERVHIEEKPCECI

SEQ ID NO: 11725 - protein, 81 aa, Castor canadensis
PKVPVTFDDVAVYFSEQEWGKLEDWQKELYKHVMRGNYETLVSLDYAISKPEVLSQIEQGKEPCTWRRAGPKVPEVPVDPS

SEQ ID NO: 11726 - protein, 81 aa, Peromyscus maniculatus
SKGSLSLKDVTVDFTQEEWQQLDPAQKALYRDVMLENYGHLISVGFHITKPDMIRKLEQGEELWTERMFPSQNYLEDEDVL

SEQ ID NO: 11727 - protein, 81 aa, Peromyscus maniculatus
GEMPLTFQDVAVYFSRAEGQQLGPQERALYRDVMLENYGNVASLGFPVPKPELISQLEQEEELWVLDLLGAEEPEVLRSCQ

SEQ ID NO: 11728 - protein, 81 aa, Peromyscus maniculatus
PQSQLTFRDVAVDLSQEEWECLDCVQRALYMDVMLENYNNLVFVENHCLCDKYEKVLDHGTKHIVYDHVNIQEKPFQCNEL

SEQ ID NO: 11729 - protein, 81 aa, Peromyscus maniculatus
AMNTVTYDDVHVDFTCEEWTLLDPSQKILYKDVMLETYRNLTAIGYSWEDHNVEEHHQSSRRHERHKRSHTREKPSQYTQC

SEQ ID NO: 11730 - protein, 81 aa, Peromyscus maniculatus
SGSQDAVTYEDVHVNFTPEEWALLDSSQKSLYKEVMLETYRNLTSIGYKWEDLNIEEHCQSSRRLKRYIIGHSRYKPCDRE

SEQ ID NO: 11731 - protein, 81 aa, Peromyscus maniculatus
TKGLLTFWDVAVDFSQEEWECLDSAQRTLYIDVMLENYSNLVYVENYCICDPVHQHVNNEKESCQCNELDKVLHDPSTCAL

SEQ ID NO: 11732 - protein, 81 aa, Mesocricetus auratus
PQGLLSLRDVSVDFSQEEWECLDCEQRALYMDVMLENYNNLLFVEFHRLGCKWETVLHQGTKHFVHDRENIQEKSHTCNES

SEQ ID NO: 11733 - protein, 81 aa, Mesocricetus auratus
MLENYSNLLFLGHCKTKPELIFNLEQRLGSWIVGEASNQSIPEFQGMNTLSKICSETKTRNVWQVAVDSDTSKELTGIGKA

SEQ ID NO: 11734 - protein, 81 aa, Mesocricetus auratus
HMGLLTFQDVAVDFTQEEWECLDSAQRTLYIDVMLENYSNLVSLGIISCKADLVPCLEQIQMACNVKKEEMVARPALIVLI

SEQ ID NO: 11735 - protein, 81 aa, Mesocricetus auratus
MLENYSSLMFLGYCMTKPELIFKLEHEFEPWTIVEASIQSLPGVHKVSTPIENHQEYHKGLLWQVEITNSQTSNEEIVEAE

SEQ ID NO: 11736 - protein, 81 aa, Mesocricetus auratus
TQVSYSPAAVGSLSEEEERECLNSAQWNLYREVTLENYSNLVFLGLSFSKPLLVRFLEKNPELQNVHPGKKPYKCKECGKA

SEQ ID NO: 11737 - protein, 81 aa, Mesocricetus auratus
ARVAVMFSDVSIAFSQEEWEYLDLAQRDLYKDVMMENYRNVASLGCFISKPDVISLLEQGKEPWKVVRKRRRNPDLETKDK

SEQ ID NO: 11738 - protein, 81 aa, Mesocricetus auratus
QVPISFKDLAVRFSEEEWRLLQEGQREFYRDVMRENYETLVSVGTSELLPLSAFLSPTEPGGATAGESHHDKGQEPPLERG

SEQ ID NO: 11739 - protein, 81 aa, Heterocephalus glaber
SQKLLNFKDISVDFNQEEWGQLAPAHRNLYREVMLENYRNLVSVGYHFSKPSVISQLEKGEEPWMTEKEDLGDPSTDLKSK

SEQ ID NO: 11740 - protein, 81 aa, Heterocephalus glaber
LQQATERWTGVPNYNSIQQGRMAMSQESLSFRDVFVDFTLEEWQQLDSVQKNLYRDVMLENYSHLVSVGYLVGQPDAISLG

SEQ ID NO: 11741 - protein, 81 aa, Mus caroli
GETPLTFQDVAVYFSRAEGQQLSPQERALYRDVMLENYGNVASLGFPGPKPELISQLEQEEELWVLDLLGAEEPEVLRRCQ

SEQ ID NO: 11742 - protein, 81 aa, Mus musculus
YVELVSFEDVTVKFTWEEWQNLNDAQKMLYRSVMLETYNSLLSLGQCIPKPELIFKLEQGEEPWTAEEPANKTLPVFCSVD

SEQ ID NO: 11743 - protein, 81 aa, Cavia porcellus
PKVPISFEDVSVYFTKAEWKFLDFKQKALYKQVMLDNYRNLASLGLACSKPHLVAQLERGEGPWAGGRLQSPGAARRNPRQ

SEQ ID NO: 11744 - protein, 81 aa, Cavia porcellus
LRDLVTFEDVAVDFTQEEWALLDASQRSLYREVMLENCRNLASLGCHVDKPSLISQLEQEDQAMTEERGNLPGTCPDLETV

SEQ ID NO: 11745 - protein, 81 aa, Cricetulus griseus
DLVSFEDVTVNFTWEEWQNLDDAQRVLYRNVMLETYSSLASLGLCIPKPELIFKLEQGAEPWTAEESANQRLPGFCNVDGT

SEQ ID NO: 11746 - protein, 81 aa, Cricetulus griseus
YQEFVTFEDVAVHLTREEWGCLDPLQRELYREVMLENYGNVVSLGFPVSMPDGISQREQDLQVFDLETKNREVIRDDCSDG

SEQ ID NO: 11747 - protein, 81 aa, Cricetulus griseus
CQVPVTFRDVAMYFCREEWECLSPSQRTLYREVMLENFRNFIELGYCGPRPDLISHLEQWDEPWVEDQDIPKFLEARKGVC

SEQ ID NO: 11748 - protein, 81 aa, Cricetulus griseus
MHVNFTWEECTLLDSSQKNLYKDVMLETDDQIINWLLEFRSSVMYLTKDFEQLINIILRLPWLKRSQTVVEEYLAFLGNLV

SEQ ID NO: 11749 - protein, 81 aa, Cricetulus griseus
QDAVTYEDVHVNLTHEEWALLDPSQKNLYKDVMLEIYWNLISVGYKWEDHNIEEYCQSSRRHGRYIIFRDTKVASTQEDLY

SEQ ID NO: 11750 - protein, 81 aa, Cricetulus griseus
IPVYKPAVISLLEQGKDPWMVHKEGSSDASPDWDYVFKGIELSSKQDICEESAKVLRTERSHLSYSPDCANLEEDRAIEDW

SEQ ID NO: 11751 - protein, 81 aa, Castor canadensis
GSVSFTDVTVDFTQEEWEQLDPSQRILYMDVMLENYSNLLSVEVWKADDQMESDHRNPDEQARQFVILKNQTPVEERGNLF

SEQ ID NO: 11752 - protein, 81 aa, Castor canadensis
YQEFVTFEDVAVHLTREEWGCLDPVQRDLYREVMLENYGNVVSLGFPVPKRDGLSQLEQDLQAFDLETKNRQVLNNDCPDG

SEQ ID NO: 11753 - protein, 81 aa, Peromyscus maniculatus
RPRALKFADVAVYFSPEEWGCLRPAQRLLYREVMRETYGLLGALGCAGPTPALISWLERNTDDWEPAALDPQEYRRWATFQ

SEQ ID NO: 11754 - protein, 81 aa, Peromyscus maniculatus
FQESVTFQDIAVDFTEKEWPLLDSSQRKLYKDVMLENYSNLTSLGYQVGKPNLISHLEQEEELRMEERDIQWGTSPDWGTS

SEQ ID NO: 11755 - protein, 81 aa, Peromyscus maniculatus
MEEMLSFWDVAIDFSPEERECLEPAQWNLYRDVMLENYSNLVFLGLIVSKPHLVTFLEQRQEPSYVQRQAAANVHPGTTPN

SEQ ID NO: 11756 - protein, 81 aa, Peromyscus maniculatus
GETGKVPVTFDDITLYLLQEEWMTPNQPQKDFFASNKLTAPLGPTAANPELFHEFGQGTEPWLGNIQGQRRLLNHHPGKTH

SEQ ID NO: 11757 - protein, 81 aa, Peromyscus maniculatus
CQVPVTFRDVAVYFCREEWDCLSPSQRTLYRDVMLENFRNFIELGYCGPRPDLISHLDQWDEPWVEDWDRPEFLEAQKGVC

SEQ ID NO: 11758 - protein, 81 aa, Peromyscus maniculatus
ARVSVMFSDVSIAFSREEWEYLDLSQRDLYKDVMMENYRNVASLGYFISKPDVISLLEQGKEPWKVVRRRRRNPDLETKDE

SEQ ID NO: 11759 - protein, 81 aa, Peromyscus maniculatus
MLTFRDVTVDFSQEEWECLDSAQRSLYIDVMLENYNNLVFVENDCICDPAHQHVNNEKESCQCNELGKVLHDPSTCALYRT

SEQ ID NO: 11760 - protein, 81 aa, Peromyscus maniculatus
MDAVTYEDVHVNFTHEEWALLDPSQKRLYKDVMQETYWNLTIIGYKWEDTNIKEHGQSSRRHGRYIICHSGYKPCEHTGCG

SEQ ID NO: 11761 - protein, 81 aa, Peromyscus maniculatus
TVNAVTYNDVHVNISQEEWALMDPSQRNLYKDVMLETYMNLTAIGYNWEDVEVEEYCQISQKHGRHERSHTKEKSYGYIEC

SEQ ID NO: 11762 - protein, 81 aa, Peromyscus maniculatus
ETLLSFRDVTVDLSKEEWECLDCAQRALYIDVMLENYNNLVFVGNHCICYKYEKVLDERSKHTVHQHVCTQAKPCNESGKT

SEQ ID NO: 11763 - protein, 81 aa, Peromyscus maniculatus
DAVIYNDVHVDFTWEEWTLLDPSQKNLYKDVMLETYRNLTTIGYNWEDHNTEEHCHNIEEHCQSSRRHERHERSQAEEKPS

SEQ ID NO: 11764 - protein, 81 aa, Peromyscus maniculatus
FKELVVFRDVAVEFCREEWECLDPRQRSLYRDVMLETYGNFVSLGLAISKPSVISLLEQGKEPWMVEQAGWYPDLLSVNET

SEQ ID NO: 11765 - protein, 81 aa, Peromyscus maniculatus
SQLPENFEDMAMYISQEWGHQDPSKRALSRDMVQDSYENVGTLESCIPGQEVLSTQAEQEGKPWDPSVPSYKGDGSPREPV

SEQ ID NO: 11766 - protein, 81 aa, Peromyscus maniculatus
KCLLTFRDVAVDLSKEEWECLDCAQRALYMDVMLENYNNLVFVGQNQRVQKEHKNTELDKSFDCQHKLTLKGTNSGKKAYQ

SEQ ID NO: 11767 - protein, 81 aa, Mesocricetus auratus
ARVAVMFSDVSIAFSQEEWEYLDLAQRDLYKDVMMENYRNVASLAGCFISKPDVISLLEQGKEPWKVVRKRRRNPDLETKD

SEQ ID NO: 11768 - protein, 81 aa, Ictidomys tridecemlineatus
MARCFISKPDVISLLEQGKDPWKIMKKGKRQYSDLETRCETKKLSSENDIYEINLSQWKLMERIKNHGLKGLILKNDWESK

SEQ ID NO: 11769 - protein, 81 aa, Ictidomys tridecemlineatus
YQNLVTFEDVAVDFTQEEWILLDQMHRDLYRDVMLENYQNLASVGCEPIKPSLIYWLEQEEDLWTVQSGDLQEWKMLLNTK

SEQ ID NO: 11770 - protein, 81 aa, Ictidomys tridecemlineatus
AQDCVTFEDVAIYFSQEEWRLLDEAQRLLYLGVMLQNFVLASSLGCGHGTEDEEILSEQKVSVAVSQVRTSKAGSSMQKTY

SEQ ID NO: 11771 - protein, 81 aa, Ictidomys tridecemlineatus
LQDLVTFKDVAVEFSQEEWALLDPSQRTLYRDVMLENCRNLASLGCHVDKHSLISQLEQEDKTVTEERGILPSTCPERSHR

SEQ ID NO: 11772 - protein, 81 aa, Ictidomys tridecemlineatus
EDVAVNFTQEEWALLDPSQKNLYRDVMQEVLRNLASIDKWEDHNVEDQNTYPGINLRPIISHSANKLYENEEYGGKLHERK

SEQ ID NO: 11773 - protein, 81 aa, Marmota monax
SQELVTFEDVAVYFIRKEWKRLEPAQRDLYREVMLENYGNVFSLDGESRTKNDQEISEDTGSRGVLLRRFQKDISQGLKFE

SEQ ID NO: 11774 - protein, 81 aa, Marmota monax
SQGLVTFKDVALDFSQEEWEWLDPSQKDLYREVMFENYRNLVWLGLSISKPNMISLLEQGKEPWMVERKMSHDQCADWESW

SEQ ID NO: 11775 - protein, 81 aa, Marmota monax
LQCPVSFEDVSVDFTWEEWKALDDSQRNLYKDVMLETCSSLVSLGHSIIKPERIFKLDRGSGPWMAKEAPHQHLPDVHKVN

SEQ ID NO: 11776 - protein, 81 aa, Marmota monax
TLGLLSFNDVSLEFSWEEWQLLDSAQRYLYREVILENYSNLLSVGYHGTKPDLIFRLEQGEEPWILNAKMSTQNCPEVWED

SEQ ID NO: 11777 - protein, 81 aa, Marmota monax
MLENYSNLVSLGYSASKPEVITLLEQGKEPFIVIGDVQGRRCAGLFSRYKTKKLPSGKDADEASSSKSETTERRKTVGLKG

SEQ ID NO: 11778 - protein, 81 aa, Marmota monax
ELLTFMDIAIDFTEEEWECLQPGQKNLYRDVMLENYRNFAFLAMTPNHTQVYSPEKGLKHIFHEVISAKYRSCDLEYLPKK

SEQ ID NO: 11779 - protein, 81 aa, Marmota monax
MVSFEDVSVDFTWEEWQDLDDAQRILYRDVMLETYRSLVSLGHCVAKPEVIFKLEQGAGPWTVGEAPHQCLPDVQKVNGLN

SEQ ID NO: 11780 - protein, 81 aa, Heterocephalus glaber
PKVPVTFSDVAVYFSEQEWGELEDWQKELYKHVMRGNYETLVSLDYAISKPDILAQMERGEEPCPCPTAPWSQDKGSREAA

SEQ ID NO: 11781 - protein, 81 aa, Heterocephalus glaber
DVAIEFSQEEWKGLDPAQRTLYRDVMLENYRNLVSLVSSNQRNPSSIKNNISHEYENDFLQSPFFTQEQVMHISTKLYKRN

SEQ ID NO: 11782 - protein, 81 aa, Heterocephalus glaber
MEEWALLDPSQKELHRDVMWENFRNVAAVGRNWDNQQQIEDEHQNYRKNLRSAEVDKCCQYKLWYQCGEIVFMTPDTNVHM

SEQ ID NO: 11783 - protein, 81 aa, Mus caroli
PQDLLTFRNVAVDFSEEEWEYLNSSQRALYMDVMWENYSNLVFVENHCICGKYEEDMDQSSNHIIYQHANIEEKSYKYHEL

SEQ ID NO: 11784 - protein, 81 aa, Mus caroli
VCGSVTFKDVAVDFSQEEWACLDATQKVLYRDMMLETYSNLVAVVGSCISKPDLIVLLEQEKEPWMAVKEETDRPSPDLKT

SEQ ID NO: 11785 - protein, 81 aa, Mus caroli
KPGAVSFADVAVYFSPEEWRCLRLAQRALYRKVMRETYGLLASLEVGGDKPALICWVEEESEVWGPCAQEPEVAMCKTEVH

SEQ ID NO: 11786 - protein, 81 aa, Heterocephalus glaber
PKVPVTFDDVAVHFSEQAEWGNLSEWQKELYKNVMRGNYESLVSMDYAISKPDLMSQMERGERPAMQEQEDSEEGETPTDP

SEQ ID NO: 11787 - protein, 81 aa, Mus caroli
KPGAVSFADVAVYFSPEEWRCLRPAQRALYREKSDAPNQRSSAGWRKSPKCGDPVPRIQRWPCARQNSTQIAGPRREGRDQ

SEQ ID NO: 11788 - protein, 81 aa, Mus musculus
PQGLLTFKDVALDFSLEEWECLSFAQRSLYMDVMLENYNNLLFVENHCIRGKNGKVLDQDSQYIVHEHMNIQEKSSKWDKL

SEQ ID NO: 11789 - protein, 81 aa, Mus musculus
SKHLLTFRDVAVDFSQKEWECLDSAQRALYIDVMVENYSNLVFVEKYSVRDTVHQHVRTEKESRQCNELGEMLHEPTNCAP

SEQ ID NO: 11790 - protein, 81 aa, Mus musculus
SQEQVSFKDVCVDFTKEEWYLLDPAQKVLYRDVILENYSNFVSVGHCVTKPDVIFKIEQGEDPWIPENGFQCHPERKWKVD

SEQ ID NO: 11791 - protein, 81 aa, Mus musculus
SQGALTFMDVAIEFSKEEWECLNSAQRALYRDVMLENYNNLVSVGVAVSKREVIICLEQNKEPWIVDAEETQLCLVNILRI

SEQ ID NO: 11792 - protein, 81 aa, Mus musculus
MEAVTFGDVAVHFSREEWQCLDSGQRALYKEVMLENHSSVAGLAGFLVFKPELISRLEQGQEPWVLDLQGAEGTEAPRICQ

SEQ ID NO: 11793 - protein, 81 aa, Mus musculus
KKGLATEFLTSLLEELVSFEDVTVQFTQEEWALLDPLQRTLYRNVTLENWKNLASLGSLLIIPHISFHDLIPWILRRQAAP

SEQ ID NO: 11794 - protein, 81 aa, Cricetulus griseus
EMGLVSFEDIAVEFTWQEWQDLNEGQRTLYRDVMLENYSNLLFLGHCKTKPELIFNLEQRLGSWIVGEASDQSIPEFQGMN

SEQ ID NO: 11795 - protein, 81 aa, Cricetulus griseus
MAFEDVAVYFSQEEWVFLDAAQRALYRHVMLENFALVDSIGLSISRPRVIIQLQRGEEPWVSNRTNTGPGRGTRRRPSLGS

SEQ ID NO: 11796 - protein, 81 aa, Cricetulus griseus
AQGSVTFRDVAVDFSKDEWDFLDSAQKSLYRDVMRENYSHFISLDLESRFKTNTSSADKDIYEVYSLQWELMEKIRSHSPQ

SEQ ID NO: 11797 - protein, 81 aa, Cricetulus griseus
MVLVSFEDIAVDFTWEEWQDLDAAQRTLYRDVMLENYSSLVSLGHCMTKPELIFNLERGLGPWSTADASVWNLSGVNKMSS

SEQ ID NO: 11798 - protein, 81 aa, Cricetulus griseus
FRGLLSFKDVSVELSCEEWQLLDSAQQHLYREVILENYSNLLSVGYLGSKPDLIFKLEQGKEPWIINAKISTQICPEDWKE

SEQ ID NO: 11799 - protein, 81 aa, Cricetulus griseus
AAAGERAGLAPVPVADEEWRHLVPVQRALYKTVMLETYETIISLGPEKKVHLTFLFVADQETKPESLAASEGTLGESHRQQ

SEQ ID NO: 11800 - protein, 81 aa, Cricetulus griseus
LINAVTYNDVHINFTQEEWALLDPSQKSLYKDVMLETYRNLTAIGYSCEDHNIEEHCQSSTRHRRYERRHSREKPSEYSQC

SEQ ID NO: 11801 - protein, 81 aa, Cricetulus griseus
PQGLLTFWDVAVDLSQEEWECLDSAQRTLYVDVMLENYSNLVFVEDLKQTHSVSVTAASVSVSPYDLYLVDVCGSCSLGVL

SEQ ID NO: 11802 - protein, 81 aa, Cricetulus griseus
IQGVLTFSDVAVDFSQEEWECLDSGQRALYIDVTLENCSNLLSVENYRKCNPVHQHVKTEKESCQCNELGKVLHDPSTCAL

SEQ ID NO: 11803 - protein, 81 aa, Cricetulus griseus
QFSFQNLLTFEDVAIIFSKEEWECLNTSERYLYRGVMLENYSNLVSVGLSVSKPELVTCLEQYKEPWMVNIEESEVLEPVG

SEQ ID NO: 11804 - protein, 81 aa, Cricetulus griseus
MADSPVTMSQEWECLDSAQRTLYINVMLENYNNVVSVENYYIQDPVHQQGKTEMESCQCNQFGKILHDPSTCALYRISEIT

SEQ ID NO: 11805 - protein, 81 aa, Peromyscus maniculatus
MNAVTYDDVHVGFIWEEWALLDPSQKNLYKDVMIETYRNLTTIGYSWEDNNIEEHCQSSRRHGRHERNHTGVKSCGYTQSG

SEQ ID NO: 11806 - protein, 81 aa, Mesocricetus auratus
GLLTFMDVAVYFPQEEWECLDSAQRALCIDVMLENYSNLVFVENYCRCDLVHHHVNTEKESCQCSQLDKVFHDPSTCALHR

SEQ ID NO: 11807 - protein, 81 aa, Mesocricetus auratus
APLPLTFEDVAVYFSEQEWQYLEAWQKELYKQVMRANYETLVSLDNGLPKPELISWLELRRELFGTLGEEQKLGKGVRSSI

SEQ ID NO: 11808 - protein, 81 aa, Mesocricetus auratus
PKVPVAFDDVSIYFSTPEWEKLEEWQKELYKNIMKGNYESLVSMDYAMSQPDVLSQIQPEGEHSADDQPRPEASEIPADAS

SEQ ID NO: 11809 - protein, 81 aa, Mesocricetus auratus
GVSSSAVAGTAARRPWNLPGLTDHPDLLTCAAEQRVLEGERRQTLRMQVLMTFRDVTVNFSKEEWECLDSAQRTLYFQVHL

SEQ ID NO: 11810 - protein, 81 aa, Mesocricetus auratus
IVVHMAFRDVAVDFSQEEWSLLSPAQRSLYREVMLENYSNLVSLGIPFSKPTLITQLEQSKETWPEERKCPQVACQGEWER

SEQ ID NO: 11811 - protein, 81 aa, Mesocricetus auratus
FKGPVTLRDVTVEFTKAEWELLTPAQKSLYKNVMLENYRHLLAVGYRVVKRSVISKLKQGKEPWVSERELPNQRRDDKQQN

SEQ ID NO: 11812 - protein, 81 aa, Mesocricetus auratus
RVTFGDVLVDFSWEEWELLDEPQRLLYLNVMLENFSLVATLGCWCGADSKEAPCEESVSTEAVPQAGTAEPSLGMPTAHPC

SEQ ID NO: 11813 - protein, 81 aa, Mesocricetus auratus
SETGNAVTYDDVHISFTSKEWALLDPSQKSLYKDVMLEIYSHLTAIGYKWEAHDSEDHGQRFRRQRRHKRSHTEVKTYKCS

SEQ ID NO: 11814 - protein, 81 aa, Mesocricetus auratus
MTKGLDFKDVVIYFSREEWECLHRSHRSLYQDVMLENYSNLLSLGLADTKPRVISLLEQGKEPWMVMRNETKEWLPDWVSG

SEQ ID NO: 11815 - protein, 81 aa, Mesocricetus auratus
MDVTIDFGREEWQHLDPDQRSLYRDVMQETYSHLHSVELQQIGDQKETYQQIGNKSGSDVIFIKKTLDTKGHHGCKVIRKI

SEQ ID NO: 11816 - protein, 81 aa, Mesocricetus auratus
YKEPVIFKDVAVHFSQKEWQLLDPAQKDLYRDVMLENYGNLIFVECYIFKPRLITRLEQGIDIFAKGNHVHRDRRRGEARV

SEQ ID NO: 11817 - protein, 81 aa, Mesocricetus auratus
SQGLLTFKDVSVDFSQEEWQSLHSAQRALYIDVMLENYNNLVSVENYYMCDPVHQHGKTEQESCQCNQFGKILHDPSTCAL

SEQ ID NO: 11818 - protein, 81 aa, Mesocricetus auratus
FRGLLSFKDVSVELSCEEWQLLDSAQQHLYREVTLENYSNLLSVGYLGSKPDLIFKLEQGKEPWIINAKMSTQSCPEDWKE

SEQ ID NO: 11819 - protein, 81 aa, Mesocricetus auratus
PISFKDLAVRFSEEEWRLLQEGQREFYRDVMRENYETLVSVEPGGATAGESHHDKGQEPPLERGSQGGQPQQSLHLTALVQ

SEQ ID NO: 11820 - protein, 81 aa, Mesocricetus auratus
SQEQVSFKDVCVDFTKEEWYLLDPAQKVLYRDVILENYSNFVSVGYCVTKPDVIFKIEQGEDPWIPENGFQCHPERKWKAD

SEQ ID NO: 11821 - protein, 81 aa, Mesocricetus auratus
SVTFEDVAVNFTLEEWAMLDPFQKDLYKDVMQETLRNLASIGNNWEHQNIEHEYENLWRKLSQLLERLCEYTEGRQCAEIF

SEQ ID NO: 11822 - protein, 81 aa, Ictidomys tridecemlineatus
LTGLVTFEDVAVYFSLEEWERLDADQRSLYQEVMQENYGILVSLGYPIPKPDLIFHLEQGEEPWVPDSPHPEEGDIVTGVY

SEQ ID NO: 11823 - protein, 81 aa, Ictidomys tridecemlineatus
SQEQVSFKDVCVDFTKEEWSLLGPAQKILYRDVILENYSNLVSVGYCVTKPEVIFKIEQGEEPWILEKEFPSQCHSERKWK

SEQ ID NO: 11824 - protein, 81 aa, Ictidomys tridecemlineatus
AQGQVNFEDVFLYFSQAEWELLDEAQRHLYRDVMLENFALMASLGHASSMFHRVASLELGSEPWQPDWVDIIPAIAREILG

SEQ ID NO: 11825 - protein, 81 aa, Marmota monax
ETATNEDLSVDCTQKKWKGPAVRQRALYRNTILENYSIMNSLAGENRMESSEFTPKQTISKGSESSDRSPGGLFGVTSMGP

SEQ ID NO: 11826 - protein, 81 aa, Heterocephalus glaber
VSVSFTDVTVDFTQEEWEQLDPSQRILYMDVMLENYSNLLSVEVWKADDQMEREHRNPDEQARQFTVLKNQTPFEERGNLF

SEQ ID NO: 11827 - protein, 81 aa, Heterocephalus glaber
SQRAVSFEDVTVDFSREEWQHLDLAQKSLYRDVMLENYFNLISVGCQVPNLEVIFSWEPGEEPCSLGSENSSQSYPSGNTG

SEQ ID NO: 11828 - protein, 81 aa, Heterocephalus glaber
QGSVTFDDVAIHFSWDEWHLLDEAQRCLYHDVMMENLALITSLDTHQHEKLQFGQKCFRSNGGRFLFVNRSKFHVSWEHFT

SEQ ID NO: 11829 - protein, 81 aa, Mus caroli
AVTFRDVAVVFSEEELGLLDAAQRKLYHDVMLENFRNLLAVGGQSPNKMEIVDATGLRCLSLGKLLCWGITSHNINKLARA

SEQ ID NO: 11830 - protein, 81 aa, Mus caroli
DALTYDDVYVNFTQEEWALLNPSQKSLYKDVMLETYRNLNAVGYNWEEHNIEEHCQSSRRHGSECGKAFTCANYLCRNDRS

SEQ ID NO: 11831 - protein, 81 aa, Mus caroli
PQGQLTFKDVAVDFSQEEWECLDCAQRALYMEVMLENYNNLFFVENHCMYPKFVNMLDQELQHIVHEHVNIQVKSYECHEL

SEQ ID NO: 11832 - protein, 81 aa, Mus caroli
SQGLLAFKDVAVEFSQEEWGCLDSAQRALYINVMLENYNNLVSVENYCIRDTVEQHVNTEKESCQYNELGKILHEHFKCTL

SEQ ID NO: 11833 - protein, 81 aa, Mus caroli
MEDMLSFWDVVIYFSAEEWEYLGPAQWKLYRDVTLENYNNFVFLDLVSSTPYLVRFLEQIQEPSDVKSQADISMYSGGKCY

SEQ ID NO: 11834 - protein, 81 aa, Mus caroli
LKVTVTFRDMAVYFCKGKWGCLSPSQGTFHHDVMLENVRNLNVLGCCGRRPGLISRLEQWDELWVEDWDKSEFLEGQKSVC

SEQ ID NO: 11835 - protein, 81 aa, Mus caroli
MEPVTFEDVAVNFSLGEWALLDSSQKKLYRDVMTETFMNLISIGKTEEKENIEDNYQNLRKNVRTLVVERSCDYGDVSQCG

SEQ ID NO: 11836 - protein, 81 aa, Mus caroli
MANAVTYEDVHVNFTQEEWALLDPSQKKLYKDVMLETYRNLNAIGFNLKDKNTEEHWQRSRRQRYERSQSAEKSSEYTQPG

SEQ ID NO: 11837 - protein, 81 aa, Neotoma lepida
EGCVTFKDVAIYFSEEEWTLLDDSQRLLYQRAMMEIFVIMTSLGKGIPSCQNMSLMGLASFLQRDVFSQSYTMFSESFPIV

SEQ ID NO: 11838 - protein, 81 aa, Mus musculus
MLENYRNLVSVAGYQLSKPTVISQLEKGEGPCMAESQGPEDPILDVKNKLETKESTAEDDISVKLDHGITRGRLIEDDIVC

SEQ ID NO: 11839 - protein, 81 aa, Mus musculus
TVRSQEAMTFKDVAMDFTPEEWGKLDPAHRAVMLENYRNLVSLWLPISKPDNYNSEDGKELSKLEKSPKCSDSAIRLHIHP

SEQ ID NO: 11840 - protein, 81 aa, Mus musculus
IQSDLCLLCARLKGMCHHYPEPVTFEDVAVNFTLGEWTMLDSSQKKLYRDVMKETFLNLISIGKTEEEDTEEEYQNPKGNL

SEQ ID NO: 11841 - protein, 81 aa, Mus musculus
MTKLQEAVTFRDVAVVFSEEELGLLDAAQRKLYHDVMLENFRNLLAVGGQSPGKTTHLHTTGLRFLSLGRLPCWQVTSHDA

SEQ ID NO: 11842 - protein, 81 aa, Mus musculus
CLTFEDVAVNFTLEEWDLLDPSQKQLYTDVMQETFKNLIAIGQIEEVQRSKDVDEDSRRNLRRGLVELLYKPSEGRQCDGI

SEQ ID NO: 11843 - protein, 81 aa, Cavia porcellus
GCSITKPHVITLLEQGKEPWMLMQDEKRWSLDLGSRCDTKKLFEEKDFYEINLSQWEIMERVRSCGFEDSFFRKDCEYKMF

SEQ ID NO: 11844 - protein, 81 aa, Cricetulus griseus
NDLLIFKDVAVDLSQEEWECLDCAQKELYMDVMLENYTNLVFVENHFMCDKYEKVSDQDMKNVLYELVNIQEKSYKCNVFG

SEQ ID NO: 11845 - protein, 81 aa, Cricetulus griseus
DSVTFEDVAISFTVEEWALLDPSQKKLHRDVMEETFRNLAAIGRTQDDQHIDNDHRYSRRNQRNEVVERLLERNKSSECKE

SEQ ID NO: 11846 - protein, 81 aa, Cricetulus griseus
MLENYSNLLSVGLPIPKPQVISLLEQGKEPWMIGKELTRGLCSALESMCESKLLSLKKEVYEIESCQRELMGLKKHGLEYP

SEQ ID NO: 11847 - protein, 81 aa, Cricetulus griseus
LIRWQVLQLNNLAYGANKVSNNHHNVSKDHKTVNQFLFQSLLTFKDVALNFLREEWECLNTSQRNLYRDVMLENYGNLVSV

SEQ ID NO: 11848 - protein, 81 aa, Cricetulus griseus
GNQFCFQSLLTFKDVAINFSKEEWECLHTSQKALYRDVILENYSNLVSVGLSESKPELVTCLEENKEPWMVNIDEAEGLGQ

SEQ ID NO: 11849 - protein, 81 aa, Cricetulus griseus
EFVTFEDVAIFFSKEEWRLLAEAQRQLYLRVMLENFALVTSLEDGKDVLAVLNIIPPQALPIGEQPNLITECGERFQTSKG

SEQ ID NO: 11850 - protein, 81 aa, Cricetulus griseus
GNQFSFQSLLTFKDVAINFSKEEWECLHTSQRNLYRDVMLENYSNLVSVGLSESKPELVTCLEQNKEPWMVNIDEAEGLGQ

SEQ ID NO: 11851 - protein, 81 aa, Cricetulus griseus
YQDSLTFDDVAVDFTQEEWVIMDQTQRDLYREVMLENYQNLFSAGCEVSKPSLISWLEEEDLETLQTEDWELQDTLREQSF

SEQ ID NO: 11852 - protein, 81 aa, Cricetulus griseus
EKQFSFQSLLTFEDVAINFSKEEWECLNTSQRDLYRFVMLENYSNLVSVGLSVSKPELVTCLEQNKEPWMVNIKDSEVLEP

SEQ ID NO: 11853 - protein, 81 aa, Peromyscus maniculatus
VCGSVTFRDVAVDFSQEEWACLDATQRVLYRDMMLETYSNLVTVDLESCYNTENISPENHTYDINLPTQSIKQLSKNFDLQ

SEQ ID NO: 11854 - protein, 81 aa, Peromyscus maniculatus
MLENFRNFIELGYCGPRPDLISHLDQWDEPWVEDWDRPEFLEAQKGVCPGGRQSTDRKRARILASAHERTHPRTGAKRGAT

SEQ ID NO: 11855 - protein, 81 aa, Peromyscus maniculatus
SATTAVTYDDVHIDFTWEEWILLDPSQKNLYKNVMLETYRNLTAIGYSWEDYNIEEHYQSSEGHARFKKCHTGTKPCEYIQ

SEQ ID NO: 11856 - protein, 81 aa, Mesocricetus auratus
MEDILSFWDVVIYFSAEEWECLGPAQWKLYRDVMLENYNNLVFLGLASYKPYLVTFLEQRQGPSDVKRQTAAVMQAGKTCY

SEQ ID NO: 11857 - protein, 81 aa, Ictidomys tridecemlineatus
GWVPALFDEVAIYFSDEEWEVLTEQQKALYREVMRMNYETVLSLEFPFPKPDMITRLEGEEECGNSDEWQLQRGTSTENEE

SEQ ID NO: 11858 - protein, 81 aa, Heterocephalus glaber
MLDCDQRMMYWDVMLDNYRNLISVGSPVTKPKVILKVEQGQDPWLAEEENLHGSYPEADCLLDEPEKHQESKDNFLKSVLF

SEQ ID NO: 11859 - protein, 81 aa, Heterocephalus glaber
MLENYSNLVSAGILFAKPKVISQLEQTGDPQMEGTGTPPGMCLGWESLFEATISKEENQEAMKKFLVDHPLDFSLGKTYID

SEQ ID NO: 11860 - protein, 81 aa, Heterocephalus glaber
MLENYSHLVSLGYPITKPDLIASLEQGVLGIIKREIPSSSCSEDGQAEDQLERHQENQNRYLKQAIPIDEKYVAKEGGREC

SEQ ID NO: 11861 - protein, 81 aa, Heterocephalus glaber
MLENYRNLVALGHQVYKPAVITQLEQEELWTRGGGHPVGAPLGDQSHRMSVPRSSVHAKWIVGKVIGTAMQKTAKVRVTRL

SEQ ID NO: 11862 - protein, 81 aa, Heterocephalus glaber
MEEWALLDPSQKKLHRDVMWENFTNVTAIGRNWDNQQQIEDKYQNFRKTLSSPNYDKIQERNDSRVNTYTYIKWGKSLNSH

SEQ ID NO: 11863 - protein, 81 aa, Heterocephalus glaber
QMPVTFEDVALYLSREEWGRLDHTQQNFYRDVLQKKNGLALGFPFSRPFWAPQVPGKVETSSSSRQTGAEEESDAGSGAVE

SEQ ID NO: 11864 - protein, 81 aa, Heterocephalus glaber
MRPSDALAITSYPEHARFSLPRLRRLRLLRYCIAKPEVIFKIEQGEEPWILEKGFPNHYNPERKWKADDLLESSQENQGEH

SEQ ID NO: 11865 - protein, 81 aa, Mus caroli
VTFRDVAVVFSEEELGLLDAAQRKLYHDVMLENFRMLLSVGGQSPGKTTNLHTTGLRFLSLGGRLPCWQVTSHDANKLAGA

SEQ ID NO: 11866 - protein, 81 aa, Mus caroli
VCGSVTFRDVAVDFSQEEWACLDATQKVLYRDMMLKTYSNLVAVVGSCISKPDLIVLLEQEKEPWMTVKEETDRPSPDLEA

SEQ ID NO: 11867 - protein, 81 aa, Mus caroli
MNGMTYDDVHVNFTGEEWALLSPSQKRLYKDVMLETYRNLTAIGYSWEDRNIEEHFQRSRRHGRHERSHTGENPSVYTQCN

SEQ ID NO: 11868 - protein, 81 aa, Mus caroli
VAFDDVAINFTQEEWALLNPSQKNLYRDVMEEVFRNLTSIEKGWEDQNVEDEDKNPQTNLRHIIANSGYNLYESEESSEKP

SEQ ID NO: 11869 - protein, 81 aa, Mus caroli
LQEMVTFRDVAVVFSEEELGLLDAAQWKLYQEVMLENFRMLLSVAHQPFTPGLIAQLESREQLWMVEAEAHAGGLSGHAVE

SEQ ID NO: 11870 - protein, 81 aa, Mus caroli
MEEMLSFWDVAIDFSPEEWECLEPAQWDLYRDVMLENFSHLVFLGLAVSKPFLVTFLEQRQGPWDMKRQAAATVYPGIIPN

SEQ ID NO: 11871 - protein, 81 aa, Mus caroli
CERLVSFEDVTVDFSQEEWRHLDSAQRRLYQDVMLEIYSHLLAVGYLVPSPGAIFRIKKRKEARTGEAKLPHPCWCQEVES

SEQ ID NO: 11872 - protein, 81 aa, Mus caroli
MDALTYDDVHVNFTREEWALLNPTQRNLYKDVMLEIYRNLKAVGYDWEDQNTEEHCQSSRRHGSYTLYHNGYKSCEYRDIE

SEQ ID NO: 11873 - protein, 81 aa, Neotoma lepida
LWKFRDVSADYFQEEWECMESYWRDLCIDVMFENYSNLKYHIWGKYMNILNQESKYIIYHPVNIQKKSHKFNDTGKMAPKF

SEQ ID NO: 11874 - protein, 81 aa, Neotoma lepida
IPFSKPKLITQLEQGKETWQEERKCPQVACPAHAKLELCPGPVCPPDLTNQKFPVQHVLSDRSPRIFTSLCAKSHVDSGDF

SEQ ID NO: 11875 - protein, 81 aa, Mus musculus
MLENYQNLATVGGQMFKPSLISWLEKKVELTVIEQGILQEWEMHLKTKRTALQQDRFWSDMSNGMQLGREHSGGEPGDPVQ

SEQ ID NO: 11876 - protein, 81 aa, Mus musculus
MNLVTYDDVHMNFTQEEGALLETSQKNLYKDVMLETYRNLSAIGNYTRNNVNLTNITCANERPPKGDPHSSLGTAADPRRH

SEQ ID NO: 11877 - protein, 81 aa, Mus musculus
NMDLITYDDVHVNFTQEEWALLDPSQKSLYKGVMLETYRNLTAIGYIWEEHTIEDHLQTSRSHGRHERSCSAEQPSEFIQC

SEQ ID NO: 11878 - protein, 81 aa, Mus musculus
CQVLLTFMDVALEFSKEEWECLDSAQRALYRDVMLENYNNLVSVGVAVSKSEVITFLEENKDPWIVDRNGTERRTPDQEAP

SEQ ID NO: 11879 - protein, 81 aa, Cricetulus griseus
PDSVTFEDVAVYFTKEEWTLLDGFQRSLYREVMLENYQNLASAEVKMDLETKETELQLDSYWSDISNETQLARLTKVGSHN

SEQ ID NO: 11880 - protein, 81 aa, Cricetulus griseus
LEDMLSFWNGAIEFSPEERECLDPAQWSLYRDVMLENYSKLLFLGLAVPKPHLVTFLEQRQESSGVKRQAAATMHPGRIPN

SEQ ID NO: 11881 - protein, 81 aa, Cricetulus griseus
KYELMINILCCESHLSSWKSVETLTFKDVAVIFTLEEWALLDPSQMKLYRDVMKETFRNLLFIEVKWCPIWVNVEKSSARL

SEQ ID NO: 11882 - protein, 81 aa, Cricetulus griseus
VEGSVSFEDVAVDFTQQEWARLDSTQRNMHKDVMLETYSHLASVGLCVAKPDMIFKLERGEELWVLEEESSDHDYSGPLSL

SEQ ID NO: 11883 - protein, 81 aa, Cricetulus griseus
DMKIKSLEALYLPIKAFVATGDYNGHVGLGVKCSKEDLVTFSDVTVTFSKEEWECMDSAQWNLYTDVMLENYNNLVFVVAM

SEQ ID NO: 11884 - protein, 81 aa, Cricetulus griseus
DVLTYDDVHINFPQEEWVLLNPSQKSLYRDVMLDTYSNLTDIGYKWENHNIEEHCQTSRIHRRHLQRQEKIHTGEKQYENL

SEQ ID NO: 11885 - protein, 81 aa, Cricetulus griseus
MLSFQDVAIDFSAEERECLDPDQWDLYRDVMLENYSNLEFLGLASSKPYLVTFLEQSQGSNDMKRQTTSTLQTGKQRFIGK

SEQ ID NO: 11886 - protein, 81 aa, Cricetulus griseus
LSGLLTFWDVAVDFSQEEWECLDSAQRTLYIDVMLENYSNLVSLENYYKCDPVHQHVKTEKESCQCNELGKVLHDPSKCAL

SEQ ID NO: 11887 - protein, 81 aa, Cricetulus griseus
EEKVAFEDVAVNFTSGEWALLDSFQKKLYRDVMKETFLNLISIEEAVEENIGEDYKDLSRITRIQVIEKNCGYACGHECDK

SEQ ID NO: 11888 - protein, 81 aa, Cricetulus griseus
CWGLLTFRNVTVDFSQEEWECLDSSQRALYMDVMWENYSNLVFIENHCICGKYEKVLDQGSKHIVHEDVNTQEKSHKWYEL

SEQ ID NO: 11889 - protein, 81 aa, Peromyscus maniculatus
MASPSPLLEPKEEWDYLDPARRSLYKDVMMDSYGNLVSLDVLNRNKNEEPTVKEEIEEDIDPPGVIVTRIKSEIDQDPIGR

SEQ ID NO: 11890 - protein, 81 aa, Peromyscus maniculatus
MDTVTYEDVHVNFTHEEWALLDPSQKSLYKDVMLDTYWNLTSIGYKWEDHNIEEHCQSSRRHGSRCVICHSGYNPYQHKGY

SEQ ID NO: 11891 - protein, 81 aa, Peromyscus maniculatus
SEEMVTFKDVAVVFSEEELELLDAAQKKLYCDVMLENFRNVVSLGHQIVTPDVSLQLKRENMLWMLTMVSWSCESAGARNL

SEQ ID NO: 11892 - protein, 81 aa, Peromyscus maniculatus
MMEEEWALLDLSQKNIYKDVMLETYINLTAIGYRWEDLNIEEHCQSPRRHGRYERSHTGEKPYECNQCDKGFSPHSHFQKH

SEQ ID NO: 11893 - protein, 81 aa, Mesocricetus auratus
GCVTFEDVAVYFCQEEWELLDEAQRLLYLNVMLENLALTASLVCWHEAETEETTCAPSVSPAEEPHIRVPKEDLPKQKTHP

SEQ ID NO: 11894 - protein, 81 aa, Mesocricetus auratus
MDFLAFEDVAVKFSQEEWILLDPSQKKLYRDVMLETCGNLTSLGIKWENKNIEEQYKHSWTYLRSYMVDAISEHKEGDQFQ

SEQ ID NO: 11895 - protein, 81 aa, Mesocricetus auratus
MNTVTYDDVHIDFTWDEWALLDPSQKSLYKNVMLETYRNLTAIGYKWEDHNIEEHCQRSRRNGRHERRHTGEKQYECSQCG

SEQ ID NO: 11896 - protein, 81 aa, Mesocricetus auratus
MGAVTYDDVHINFTQEEWALLNPSQKRLYKDVMHDTYSNLTATGYSLEDHYIEEHCQSSRRCRRHLQRHKKVHIGEKPYES

SEQ ID NO: 11897 - protein, 81 aa, Ictidomys tridecemlineatus
TGIPVSFEDVTVDFSREEWQQLDSTQRCLYQDVMLENYSHLLSVGFEVPKPEVIFKLEQGEEPWMLEGETPHQSYSGGKFG

SEQ ID NO: 11898 - protein, 81 aa, Ictidomys tridecemlineatus
PQESVTFKDVAVDFTREEWHHVDPAQRNLYRDVMLENYSHLVSLGYQVSKPEVIFKLEQGEEPWISEGEIQRPFCSVVSFN

SEQ ID NO: 11899 - protein, 81 aa, Ictidomys tridecemlineatus
MCPAQRTLYREVMLENYSHLVSVGYCVTKPKVIFKLEQGEEPWSLEDRFLSHKYPGYYKVDVHIKGNQDKQGKPLWQVIFI

SEQ ID NO: 11900 - protein, 81 aa, Ictidomys tridecemlineatus
SKEPVVFKDIALYFTQSEWKLLKPAQKALYKDVMLENYSNLASLVGCHVFKPTLITRLEQGIDPTLEDRPAPGGPPREEAK

SEQ ID NO: 11901 - protein, 81 aa, Ictidomys tridecemlineatus
VTFSDVAIDFSHEEWAWLDSAQKDLYKDVMVQNYENLVSLAGLSITKPYVITLLEDGKEPWMVEKTLSKGMLLDWESRWEN

SEQ ID NO: 11902 - protein, 81 aa, Marmota monax
LVTFEDVAVNFTQEEWILLDQTHRDLYRDVMLENYQNLASVGKTAIIPCCQLIKPSLISWLEKETDLWAVQRRDLQECEMR

SEQ ID NO: 11903 - protein, 81 aa, Marmota monax
PKVPVSFEDVAMYFTKTEWKLLDLKQRILYKQVMLENYGHLVSLGFAFSKPRLVSQLERGEGPWVADSLRGQAEAESHAGE

SEQ ID NO: 11904 - protein, 81 aa, Marmota monax
AQASLTFEDIAVNFSSKEWQSLTYFQRHLYKDVMLENYGNMVSLGFSFPKPPLISHLEQEAEPCVQDLQYGRFLSCSFPVP

SEQ ID NO: 11905 - protein, 81 aa, Marmota monax
RVVFEDVAIYFSQEEWGHLDEAQRFLYCEVMLENLTLLSSLGCWYGAEAEKAAPEQGVSVGAPQVRTPKPGSSTQNAQPSE

SEQ ID NO: 11906 - protein, 81 aa, Marmota monax
MEPLTFRDVTIDLSQEEWDCLDPAQQNLYKDVMLENYQNLFFLAVYSHQVQDFLPEQGSKHLSQKVIKGRHGSQGIENLHL

SEQ ID NO: 11907 - protein, 81 aa, Marmota monax
LQGSVSFEDVAVDFTQEEWNRLDPTQRTLYRDVMLENYSHLVSLGYPITKPDVIASLENGVLEIIKREIPSSSCTEDEQAE

SEQ ID NO: 11908 - protein, 81 aa, Marmota monax
MLETYRSLVSVGLCISKPDVVHLLEQEKEPWTMPGEVVRGLCPDLECVGVTKESSPHRDMHEEKLSQAAVMERLTSRDPEC

SEQ ID NO: 11909 - protein, 81 aa, Marmota monax
QDSMALQDVIIYFTQEEWALLDPSQKKLYRDVMSEIFSNLSSLGKLLQDKNCEDCYRNFGGKLSNNNGEQACESKEHLHCG

SEQ ID NO: 11910 - protein, 81 aa, Marmota monax
SEESVTFKDVAVDFTQEEWGQLDSPQRALYRDVMLENYQNLLALGPPVCKPDVISHLERGEEPWQVHSKVTGRTCSEWEPM

SEQ ID NO: 11911 - protein, 81 aa, Marmota monax
AEGSVVFNDVSIDFSQEEWECLDPAQRDLYRDVMLENYSNLVSMGFYIPKPQVISLLEQGKEPWMVGRELTRGLCSDLESM

SEQ ID NO: 11912 - protein, 81 aa, Marmota monax
LQNLVTFEDVAVDFTQEEWILLDQMHRDLYRDVMLENYRNLASVGCEPIKPSLIYWLEQEEDLWTVQSGDLQEWKILLNTK

SEQ ID NO: 11913 - protein, 81 aa, Marmota monax
EKMPVTFEDVAVNFTWEEWDCLDASQRALYQVVMSETFKNLESVGGIFLPKSDVVTKLEQEERQKRADLHQPNREGLPSGD

SEQ ID NO: 11914 - protein, 81 aa, Heterocephalus glaber
LQGSVSLKDVTVDFTEEEWQQLDTAQKALYMDVMLENYCHFISMGFHITNPETIHELEQGEELWTERIFPSQSYLKDEKPE

SEQ ID NO: 11915 - protein, 81 aa, Heterocephalus glaber
MQETYSHLLSVGYQVPEPEVFMLEQGEEPWASQGDSSHQSCPEKLQQICDQIESYQQTGNKSFSDVAFIKKMMTIKNHHEY

SEQ ID NO: 11916 - protein, 81 aa, Heterocephalus glaber
LTFEDVAVDFTMEEWALLDPSQKKLHRDVMWENFRNVASIEIDKCCKYNTDLKSCELHEFEQNLSNCNRHGETSTPFQSVQ

SEQ ID NO: 11917 - protein, 81 aa, Heterocephalus glaber
MEEWVLLNPSQKKLYRDVMEETFRNIVAIGRAWDNQEVEEDYKNYWRNLRNEEVEKCFQNKGWNQFEEIFLCTPDANVDKK

SEQ ID NO: 11918 - protein, 81 aa, Heterocephalus glaber
AVTFEDVAVNFTMEEWTLLNPSQKKLYRDVMRETFRNLAAVGRAWDNQEVEEEYKNYWRNLRNEEVEKCYQNKGWNQCEEM

SEQ ID NO: 11919 - protein, 81 aa, Neotoma lepida
PSGSVTFRDVAVDFSQEEWEFLDSAQKSLYRDVMWETYSNFISLDLEFRFKTNTSSAAKNIYEVYSLQWELMEKIKSYSSQ

SEQ ID NO: 11920 - protein, 81 aa, Mus caroli
SQRLLTFGDVAVDFPQEEWECLDSAQRALYIDVMLENYTNLVSVENYCISDTVHQHVKTEKESCQCNELGEMLHEPSNCAL

SEQ ID NO: 11921 - protein, 81 aa, Neotoma lepida
DGTVIKVKVLMNLSTLNWLLLKRDLARGFLISCPRANAIIHASLLDVATDFRQEEFCYLDSTQRTLPGNDKLKTYTNLVSA

SEQ ID NO: 11922 - protein, 81 aa, Mus musculus
PQGLLTFKDVALDFSLEEWERLSFAQRTLYIDVMLENYNNLLFVENHCIRGKYRKVLDQDSQYIVHEHMNIQEKSSKWDKL

SEQ ID NO: 11923 - protein, 81 aa, Mus musculus
MDALTFDDVHVHFTREEWSLLDPSQKRLYKDVMLENYRNLTAIGYNWKDHNIEEHSQNDRRNGRHERTPAGEKPYEYAQWD

SEQ ID NO: 11924 - protein, 81 aa, Mus musculus
LSFRDVAIDFSAEERECLDSAQWNLYKEVMLENYSHLVFLGSKPYQCKQCGKAFGWKSLLVQHQRIHTGEKPYICKECGKA

SEQ ID NO: 11925 - protein, 81 aa, Mus musculus
KVPVTFVDIAVYFSEDEWKNLDEWQKELYSNLVKENYKTLMSLDTDGPVSKPDPPVQAEPREEPCVWEQHHPEEREIPVTA

SEQ ID NO: 11926 - protein, 80 aa, Mus musculus
MVLVSFEDVAVDFTWEEWQALDAAQRTLYRDVMLETYSSLVSLGHCMAKPELIFNLEQGLGPRSTAGASVWNLSGRTEDS

SEQ ID NO: 11927 - protein, 81 aa, Mus musculus
MLENFRNLNELGCCSRRPGLITRLEQWDEPWVDDWDRSEFPDGQKSFCPGSRKVAHSRIGAGRGAALRKSALTSGKVRLPR

SEQ ID NO: 11928 - protein, 81 aa, Mus musculus
MEEMLSFRDVAIDFSAEEWECLEPAQLDLYRDVMLENYSNLVFLGLASSKPYLVTCLEQIQEPSDVKRGAATSMLPGVLGG

SEQ ID NO: 11929 - protein, 81 aa, Mus musculus
VTFEDVAVDFTQEEWILLDTKQRNLYREVMLENYQNLATLGCQLIKSRYSFCLEAEELRVVKKRVHQDWAIQLNPRGTMFQ

SEQ ID NO: 11930 - protein, 81 aa, Mus musculus
MASPSPPLEPKEEWGYLDPAPRSLYKDVMMDSYGKLVSLDVLNRNKDEEPTVKEELEKDIEPQGVIVTRIKSEIDQDPVGS

SEQ ID NO: 11931 - protein, 81 aa, Mus musculus
TESRISFEDVAVDFSWDQWQLLSPTQKSLYRDVMLENCSSLVFLGNQTTKPDVTFKLDQQESRIMDEECLSQNFLEIWLDS

SEQ ID NO: 11932 - protein, 81 aa, Mus musculus
SQRLLTFGDVAVEFPQEEWECLDSAQRALYIDVMLENYSNLVSVENYCISDTVHQHVKTEKESCQGNELGEMLHEPTNCAL

SEQ ID NO: 11933 - protein, 81 aa, Mus musculus
DAVTYEDVYVKFTHEEWALLDPSQKSLYKDVMLETCRNLTAIGYKLQDDNIEEHCPSSRGCGRYNIYGYKPCEHKGYGKKQ

SEQ ID NO: 11934 - protein, 81 aa, Cavia porcellus
SHLPTFAQDLVTFRDVAVLFTQEEWGRLNPPQRALYRDVMLENYSNVVSLAGLLGPKCSMFSQLGKEEEWVPEVAAGSSCL

SEQ ID NO: 11935 - protein, 81 aa, Cavia porcellus
EDVAVYFSREEWAYLNPRQKALYRNVMLDNFSSLVALGFCGPRPDLVSHLEQWDELWLEDSERAELREPQSGPCPGEHHGV

SEQ ID NO: 11936 - protein, 81 aa, Cricetulus griseus
MVFSDVSLDFSQEEWECLGPAQRDLYRDVMLENYSNLLSVGLPIPKPQVISLLEQGKEPWMIGKELTRGLCSALESMCESK

SEQ ID NO: 11937 - protein, 81 aa, Cricetulus griseus
VSVTFEDVAVLFTRDEWKKLDHSQRSLYREVMLENYSNLASLGFPFTKPKVISLLQQGEDPWKVEKEGPGGSPLGLKHNHR

SEQ ID NO: 11938 - protein, 81 aa, Cricetulus griseus
CERWMSFEDVTVTFSQEEWQQLDSAQRRLYQDVMLEIYSHLLAVGYPIPSPGVIFRIERGKEAQAGKAEFPGQQCQEKSGI

SEQ ID NO: 11939 - protein, 81 aa, Cricetulus griseus
KEELVTFEDVAVDFTQEEWQYLNPPQRTLYRDVMLETYSNLVSVGSEDQGGIYHLSSLEQQVTKPDLIIKLETPPFIYFFS

SEQ ID NO: 11940 - protein, 81 aa, Cricetulus griseus
PFKTVTFKDVAVDLTQEEWQQMKPAQRNLYRDVMLETYSNLVTVGCQATKPDVIFKLEQEEEPWVLEEEMFWRHSPEVWEV

SEQ ID NO: 11941 - protein, 81 aa, Cricetulus griseus
GVLTFSDVAVNFSQEEWECLDSGQRALYIDVMLENYSNLLSVENYYKCDSVHQHVKTEKESCQFNEPGKVLRDPSTCALYR

SEQ ID NO: 11942 - protein, 81 aa, Cricetulus griseus
GAVTFGDVAVDFSEEEWACLDAAQRAFYRDLMLETYSNLVTVVGSSISKPHLITLLEQEREPWMVVKEETDRPSMDLESDY

SEQ ID NO: 11943 - protein, 81 aa, Cricetulus griseus
LTLGDVAVVFSWEEWQLLSHAQRDLYWDVMPEICRSLASMAGEIREIVEHLQHHLKDRIIRMSIEQCYKHRKFRNVFNQSK

SEQ ID NO: 11944 - protein, 81 aa, Cricetulus griseus
MDLLTFGDVALDFSQEEWECLDSSQRALYIDVMLENYSNLVSVENHGMGGKPKKVLNQDSNHNVQQHGNTQENFCKSNQLG

SEQ ID NO: 11945 - protein, 81 aa, Cricetulus griseus
SQGLLSFRDVSVDLSQEEWECLDCAQRALYMDVMLENYSNLLFVENHRICDKCEKLLHPGTKHFIHDHEYVQEKTCKCDEL

SEQ ID NO: 11946 - protein, 81 aa, Cricetulus griseus
EQWRHLDSTQKEQYWDFMLETYGKMVSGGISNSKPDLTNIADYGEELAGLQLHISEKIPRLTCKEDRQENDKENLNLENHR

SEQ ID NO: 11947 - protein, 81 aa, Cricetulus griseus
EKQFSFQSLLTFEDVAISFSKEEWECLNTCHRDLYRGFLLENYSNLVSDYWAGLGCLPTQSLLTFVDVAINFSKEEWECLN

SEQ ID NO: 11948 - protein, 81 aa, Ictidomys tridecemlineatus
GHVTFEDIAVYFSQEEWGLLDDAQKHLYHDVMLENCTLVASVGCWHRVEKTAHSEQILSIGMSQARTPAPSPSISNAHPCQ

SEQ ID NO: 11949 - protein, 81 aa, Ictidomys tridecemlineatus
ELVTFEDVAVNFTLEEWALLDPSQKKLFKDVMQETFWNLTTIGKDVLVADSSLAMPQTKHERTLTAEKPHVCKHCGKAFSS

SEQ ID NO: 11950 - protein, 81 aa, Marmota monax
LQGMVSFEDVSVDFTWEEWQDLDDAQRTLYRDVMLETYSSLVFLDVQIVDDVVENSQENHGRHLWQVVVNSSTSAKERLEL

SEQ ID NO: 11951 - protein, 81 aa, Marmota monax
MLENYQNLVAVGCQLIKPSLISCLEAEEELRTVERGVIQEWAALRQDVFWLKMTSGIQLASCHNGEELYDFKPHGEIFKGH

SEQ ID NO: 11952 - protein, 81 aa, Marmota monax
MDFSQQEWECLNPFQKTLYRDVMMENYGNLVSLGHSISKPDVITLLEQGKEPWMIVKKETRKWRKDLESRYEKISSEKVHL

SEQ ID NO: 11953 - protein, 81 aa, Marmota monax
SLGLVSFEDVSVDFTWEEWQNLDDAQRTLYRDVMLETYYSLVSLGHCIIKPEVIFKLEQGAEPWMVEEHPNQTLSDVQKVD

SEQ ID NO: 11954 - protein, 81 aa, Marmota monax
MLENYENLTIVGTECQLLKPSLISWLEQEESKIVKGRVLQEWKMGLKIKGASLQQNFLREQISSEILRARRHNGGELCDCK

SEQ ID NO: 11955 - protein, 81 aa, Heterocephalus glaber
QVLVSFEDVTVDFSREEWQQLDSTQRCLYHDVMLENYSHLLSLGFEVPKPEIIFKLEHGEEPWMWEDTPHHDCSGGTFGMK

SEQ ID NO: 11956 - protein, 81 aa, Mus caroli
DLVTYDDVHVNFTQEEWALLDPSQKNLYKDVMLETYRNLSAIGYIWEVHTSEDHFQTSRSHGRHERSCTAVQPSEFIQCGK

SEQ ID NO: 11957 - protein, 81 aa, Mus caroli
QREFLRCRGFLIVRGGVQDALTYDDVYVNFTQEEWALLNPSQKSLYKDVMLETYRNLNAIGFSWEDHTIEEHYQSSRRHER

SEQ ID NO: 11958 - protein, 81 aa, Mus caroli
NGLLTFKDVAVDFSEEEWECLDHAQRRLYLNVTLENYRNLFFVENHHICHKYENVQDTQHIVDEHVNIHEKSYKCHKLGKI

SEQ ID NO: 11959 - protein, 81 aa, Mus caroli
MLSFWDVAMYFSAEEWEYLGPAQWKMYRDVILENYSNLVFLGLASTKPYLVTFLEQRQELSDVKRPAATTKYSGGKSYTCK

SEQ ID NO: 11960 - protein, 81 aa, Mus caroli
MEQLTFRDVAIDFSGEEWECLDSEQQNLYTDVMLENYRNLVFLGLAVSKPYLVTCLEQRKEPWNVKRQKTTALFPAMFSHH

SEQ ID NO: 11961 - protein, 81 aa, Mus caroli
MGLVSFEDVAVDFTWQEWQELDAAQRTLYRDVMLENYSSLVSLGHCVTKPELILRLEHGFQPWSIGDTSVWRLPGVLEVYT

SEQ ID NO: 11962 - protein, 81 aa, Mus caroli
TQGQLSFSDVAIEFSQEEWECLDHAQRALHRDVMLENYSNLVSLGVTLPNLNAMSKLEQNKGPWTVESEAISTRKSNGKEY

SEQ ID NO: 11963 - protein, 81 aa, Mus caroli
PISFKDLAVRFSEEEWRLLQEGQREFYRDVMRENYETLVSVGTSELLPLSAFLSPAEAGGATSGESHQDKGQKTHLEHSSQ

SEQ ID NO: 11964 - protein, 81 aa, Neotoma lepida
SQGLVTIKDVSLCFSQEEWRSLDPSQTDFYGEYVMQENCGIVVSLRFPIPKLDMLSQLEGGEEQGVPDPQDLEGRDILKVT

SEQ ID NO: 11965 - protein, 81 aa, Mus musculus
KPGTVSFADVAVYFSPEEWRCLRPAQRTLYREVMRETYGLLASLEVGGDKPALICWVEEESEVWGPGAQEPEVAMCRTEVH

SEQ ID NO: 11966 - protein, 81 aa, Mus musculus
SQGVLTFMDVAIEFSKEEWECLDSAKRALYRDVMLENYINLVSVGVAVSKQEVIICLEQNKEPWIVDGEKTEVREPALDCN

SEQ ID NO: 11967 - protein, 81 aa, Mus musculus
MEDMLSFWDVAIYFSAEEWDCQGPAQWDLYRDVTLENYSNLVFLGLASSKPYLVTFLEQIQEPSDVKRQAAITVHPGGKCY

SEQ ID NO: 11968 - protein, 81 aa, Mus musculus
GSVSFQDVAVTFTVEEWALLDPSQKKLHKDVMEETFRNLAAIGKTQEGQNIDEDHRYSRRNQRNEVVERLLEHSKGTESKE

SEQ ID NO: 11969 - protein, 81 aa, Mus musculus
TNGRLTFKDVAIEFSQEEWECLDSAQRTLYRDVMLEIYSILVSVGLSVSKLELLTCFEQNEEPSIAGIKELKGIEPVLSCF

SEQ ID NO: 11970 - protein, 81 aa, Mus musculus
KLQEALTFQDVEVTFSQEEWGCLNSAQRNLYRDVILENYGNVVSVVGSSPKPALISWLEARKPWGVNICTVQLKRDADAAP

SEQ ID NO: 11971 - protein, 81 aa, Cricetulus griseus
YQELVSFKDVTVDFTQEEWTSLNPAQRSLYREVTLENYQNLASAEWKMQLETKCLAPQQGVLKGSSISNGMQMTESQNGRE

SEQ ID NO: 11972 - protein, 81 aa, Cricetulus griseus
SIGDLDLQPLRELSVALLLPYPSLEDHDQVHSHFLSTEFFRDLGADETIQSLSESKPELVTCLEENKEPWMVNIDEAEGLE

SEQ ID NO: 11973 - protein, 81 aa, Cricetulus griseus
GSVSFEDISLDFTWDEWQDLDAAQRSLYRDVMLENYSSLMFLGYCMTKPELIFKLERGFGPWSVVEASLQSLPGVHKMTTP

SEQ ID NO: 11974 - protein, 81 aa, Cricetulus griseus
FQELVVFRDVAVEFCKDEWECLGPDQRSLYRDVMLETYSNFVSLGLAVSKPSVISLLEQGKEPWMVEQAGWYPDLLSVNET

SEQ ID NO: 11975 - protein, 81 aa, Cricetulus griseus
NAMTYNDVHIDFTWEEWSLLDTSQKNLYKDVMLETYKNLADMEYSKEHHSTEEECRSSKRHQRHERRQSGEMSSEYTQCVN

SEQ ID NO: 11976 - protein, 81 aa, Cricetulus griseus
FQGRLTFKDVSVDFTQEEWQCLDSSQRALYVDVMLENYNNLVYVENYYICDPVHQHKKTEKESCQCAEFGKILHDPSTCAL

SEQ ID NO: 11977 - protein, 81 aa, Cricetulus griseus
MASPSPLLEPKEEWDYLDPTRRSLYKDVMMDSYGNMVSLDVLSKNKDEEPTVKEEIEEDIEPPGVIVTRIKSEIDQDPIAT

SEQ ID NO: 11978 - protein, 81 aa, Cricetulus griseus
FQGVLTFSDVAVDFSQEEWECLDSAQRALCIDVMLENYSNLVFVEEYCKCDPVHQHVKTEKESCQCNELGKVLHDPSTCAL

SEQ ID NO: 11979 - protein, 81 aa, Cricetulus griseus
LTFEDVAIYFSEQEWQYLEAWQKELYKHVMRTNYETLLNPPESQHSFGLILGEKEEVSFRHDQGVDLVNAQTRSLGALVST

SEQ ID NO: 11980 - protein, 81 aa, Cricetulus griseus
PEKLLQRLLTFGDVAVDFPQEEWECLDSAQRALYIDVMLENYNNLLSVGVNPLIVHIFEVGRHTPLKTIFWLEVTPSYLLL

SEQ ID NO: 11981 - protein, 81 aa, Cricetulus griseus
EKVAFEDMVVNFTSGEWALLDSSQKKLYRDVMKETFLNLISIEEAIEENIGENCKDLSRNTRSQAIDKYYICTCDHECNKN

SEQ ID NO: 11982 - protein, 81 aa, Peromyscus maniculatus
DVNAVTYADVHINFTREEWALLDPSQKKLYKDVMLETYRNLTAIGYSREDHNTENHFQSSRRCGRHERNRTGEKVSENTEC

SEQ ID NO: 11983 - protein, 81 aa, Peromyscus maniculatus
QEHVSFKDVCVDFTKEEWYLLDPAQKVLYRDVILENYSNFVSVERKWKVDELLESSQENQDEHFWPFMLTNKIIHVEGGGT

SEQ ID NO: 11984 - protein, 81 aa, Peromyscus maniculatus
AEGSVSFEDVAVDFTQQEWHRLDSTQRNMHKDVMLETYSHLASVGLCVAKPDMIFKLERGEELWILEEESSGRNYSGPLSL

SEQ ID NO: 11985 - protein, 81 aa, Peromyscus maniculatus
ARLPLTFEDVAIYFSEQEWRHLEAWQQELYKHVMRANYETLVSLDNGLPKPQLISWIELGRELFGSWGEEDKLENGIRSSI

SEQ ID NO: 11986 - protein, 81 aa, Peromyscus maniculatus
YKEPVIFKDVAVYFSQKEWQLLEPAQKDLYRDVMLENYENLISVEYYIFKPRLITRLEHGVDLFAEENSVPRERQQQREAG

SEQ ID NO: 11987 - protein, 81 aa, Peromyscus maniculatus
LHNALTYDDVHINFTWEELTLLEPFQKNLYKDVMMETYRNLTIIGYSWENHNIEAHFQNSRRHVRHEISQTGEKKPFIYTK

SEQ ID NO: 11988 - protein, 81 aa, Peromyscus maniculatus
MEEMLSFWDVAIEFSAEERECLEPAQWNLYRDVMLENYSNLVFLGLAVSKPHLVTHLEQRQESSDVKRQAAANVQPGTTFN

SEQ ID NO: 11989 - protein, 81 aa, Peromyscus maniculatus
SVTFEDVSVNFTLEEWAMLDSSQKNLYKDVMQENLRNLAYIGNKWEHQNIENEYENLWRKLSNQLLERLCEYTEGHPSAAE

SEQ ID NO: 11990 - protein, 81 aa, Mesocricetus auratus
LKEPVTFRDVAVDFTQEEWGQLDPTQRSLYRDVMLETFGHLLCVGPDLPKPAVISQLEQGAELWVTERGGTRVCHPGWILE

SEQ ID NO: 11991 - protein, 81 aa, Mesocricetus auratus
MLSFWDVAIEFSPEEREYLEPAQWNLYRDVMLENYSNLDFLGLALPKPHLVTFLEERQEPSGVERQAAATVQPGTTPNDYV

SEQ ID NO: 11992 - protein, 81 aa, Mesocricetus auratus
WSQGLLTFRDVDISQEEWMCLDSAQRALYIDVMLENYSNLVFVENYCKCDPVHQHVNNEKESCQCNELGKMLHDPFACALY

SEQ ID NO: 11993 - protein, 81 aa, Mesocricetus auratus
GYGSVSFEDVAVDFTQQEWHRLGSTQRTAHKDVMLETYSHLASVGLCVAKPDMIFKLEWGEELWILEEESSGYDYSDKNFE

SEQ ID NO: 11994 - protein, 81 aa, Mesocricetus auratus
PQVKVTFEDVAVLLSQEEWARLGPAQRGLYRNVMMETYGNVVSLGLPGSKPVVISQLERGEDPWVLDGQETEQSLGSDHSE

SEQ ID NO: 11995 - protein, 81 aa, Mesocricetus auratus
EGSELQGSPLQRMTWWGMDAVTYNDVHVDFTREEWTLLDPSQKNLYKDVMLETYTNLTAIGFKWEDHNIQEHCQSSRRHGR

SEQ ID NO: 11996 - protein, 81 aa, Mesocricetus auratus
VQEPVTFKDVAVAFTQEEWGQLDIVQRTLYRDVMLETYGHLLSVGNQIAKPEVIYLLEQGEEPWSVEQAYPQSTCPDWMRN

SEQ ID NO: 11997 - protein, 81 aa, Mesocricetus auratus
QDSVTFEDVAVYFTKEEWNLLNGFQRNLYRDVMLENYQNLATVEVKMDLETKETELQLDTFWSDISNETQLARLTKAGSHN

SEQ ID NO: 11998 - protein, 81 aa, Ictidomys tridecemlineatus
EPVTFEDVAVNFTLEEWALLDPSQKKLFRDVMQETLWNLTTIGKGDIVSSLSQSENRYHLSQVLERLCEQKEDSQCGKIID

SEQ ID NO: 11999 - protein, 81 aa, Ictidomys tridecemlineatus
MAEEFVTLKDVAMDFTLEDWEQLGLDQVDLFWDTALDNYQNLFLLNPPRPSLISYPDGGEELEDLVEGSPEAAGPDMTETK

SEQ ID NO: 12000 - protein, 81 aa, Ictidomys tridecemlineatus
QGVVVVFSDVTVDFSREEWEYLDSVQRVLYRDVMLENYSNLVSVGLSISKPAVITLLEQGHEPWTGGPVPAKSQSLHKWQK

SEQ ID NO: 12001 - protein, 81 aa, Ictidomys tridecemlineatus
PKVPVAFDDVSIYFSTPEWEKLEEWQKELYKNIMKGNYESLISMDYAMNQPDVLSQIQPEGEHNTENQTAPEASEIPADPS

SEQ ID NO: 12002 - protein, 81 aa, Marmota monax
GVPGKSGVVSKRALELKSSVNMAASQNLPQQGRHGNACEIPVSFEDVTVDFSREEWQQLDSTQRCLYQDVMLENYSHLLSV

SEQ ID NO: 12003 - protein, 81 aa, Marmota monax
YEPLTFRDVAIDFSEEEWECLDPAQQNLYREVMLETYSNLVFVEKTYQCEECNTLKNFTQHHSVHTGDMPCKECEKTSNKS

SEQ ID NO: 12004 - protein, 81 aa, Marmota monax
VTFEDVAIYFSQEEWRLLDEAQRLLYLSVMLQNFVLTSSLGKALTLTLVSLSSFSPKQIHLFQALQSVKFSSFLAYVLWTP

SEQ ID NO: 12005 - protein, 81 aa, Marmota monax
MQENYGILVSLGYPIPKPDLIFHLEQGEEPWVPDSPHPEEGDIVTGVYTGAWFWNDDIEDHEEEDDEDFLAEMAEEENEPP

SEQ ID NO: 12006 - protein, 81 aa, Marmota monax
MVGFQVTKPDVIFKLEQEEEPWVIEEEMFWRHSPEVWEVDEQIKKQQETLVRKVTSISKKTVIKEKVVECKKVAKIFPLSS

SEQ ID NO: 12007 - protein, 81 aa, Heterocephalus glaber
MLETYNNLVALGHCSSKPAVIFKLEQGSGPCMVEEAPSQSFPDVQKVNGLIQTNQENQEKHFWQVVTTSADEKVELGKRFN

SEQ ID NO: 12008 - protein, 81 aa, Heterocephalus glaber
MMENYGNLISLGHSISKPDVITLLEQGKEPWMVGREETRKLGEDLESRYEKVSYGKVHLFRKHSSVTLHQRINNSEKSFEC

SEQ ID NO: 12009 - protein, 81 aa, Heterocephalus glaber
KPGAVKFADVAVYFSPEEWGCLRPAQRALYRDVMRETYGLLSALGFPGPKPALISWMEQESEAWSSAAQDPEEGESLVGAL

SEQ ID NO: 12010 - protein, 81 aa, Heterocephalus glaber
AVTFEDVAVTFTMEEWALLDSSQKKLYRDVMWETFSNVSAIGRNWDDQQIEDEWQQCWRKNLRCEEVVEGHQNKSWHQHEE

SEQ ID NO: 12011 - protein, 81 aa, Neotoma lepida
QVPISFKDLAVRFSEEEWRLLQEGQREFYRDVMRENYETLVSVGTSELLPLSAFLSPAEPGGATVGESHHDKGQEPPSEHG

SEQ ID NO: 12012 - protein, 81 aa, Mus musculus
TENAVTYYDVLVSFTQEEWALLDPSQKSLYKDVMLETYRNLTAIGYNWEEDNIEEDCENSGRPTRHLQRDGPSNTGEKPFE

SEQ ID NO: 12013 - protein, 81 aa, Mus musculus
TQGQLSFSDVAIEFSQEEWECLDHAQRALHRDVMLENYSNLLSLGVTLPNLNAMSKLEQYKGPWTVESEAIRTRKSNGKEY

SEQ ID NO: 12014 - protein, 81 aa, Mus musculus
PVTFEDVAVNFSLGEWALLDSYQKKLYRDVMMETFMNLISIGKTEEESMDVNYPQLQRNLRIQVVEKFCDYEHSSQCGKTH

SEQ ID NO: 12015 - protein, 81 aa, Mus musculus
MDALTYDDVHINFTPEEWALLDHTQRNLYTDVMLETYKNLVAIGYKPEDKIIEHLQNFRIPGRHKGSLTREKPYEYTQCGK

SEQ ID NO: 12016 - protein, 81 aa, Mus musculus
LLGSELFRDVTITFSQEEWECLEPVQRDLYRDVMLENYTHLVSLGLAISKPEVIAILEQGKEPWIEERATTGGLCSALESG

SEQ ID NO: 12017 - protein, 81 aa, Mus musculus
MNAVTYEDVHVNFTQEEWALLDPSQKTLYKDVMLETFRNLNAIGFNWEAQNIEEYCQSSRRHRRCERSQSAEKPSEYTQRD

SEQ ID NO: 12018 - protein, 81 aa, Mus musculus
KKEMLSFWDVAIDFSPEEWECLEPAQWDLYRNVMLENFSHLVFLGLAVSKPFLVTFLEQRQGPWDMKRQGAATVYPGITPN

SEQ ID NO: 12019 - protein, 81 aa, Mus musculus
PMTFDDVAIIFSPEEWECLDSAQRDLYRDVMVENCRNLLSVEASRHGTKGFSSKKDMKRFFQEELRRRLSKCGADIFHPRK

SEQ ID NO: 12020 - protein, 81 aa, Mus musculus
DSGCLQERKIAAEMMLVDCLTDDQSSYLAQTSMPAIFQELVSFEDVIVDFTQEEWSSLNPDQRNLYRDVMLENYQNLATVG

SEQ ID NO: 12021 - protein, 81 aa, Peromyscus maniculatus
MNTVTYDDVHIGFTWEEWTLLDPSQKNLYKDVMLETYRNLAIIGYSWEDHNIEEHYQNSRRHERHERRHTGEKPHESNQCN

SEQ ID NO: 12022 - protein, 81 aa, Peromyscus maniculatus
MNAVTYEDVHVNFTREEWTLLDSSQKSLYKDVMLETYRNLTIIGYSWEDHNIEEHYQSSRRHERHERSHTQEKPSEYSHCV

SEQ ID NO: 12023 - protein, 81 aa, Peromyscus maniculatus
SQGLLTFRDVTVNFSQEEWECLDTSQRALYIDVMLENYNNLLFLEKYFKCDSVPQHVKTECESHHYNELEKTLPDPSIYAH

SEQ ID NO: 12024 - protein, 81 aa, Peromyscus maniculatus
AVTYDDVHIDFTWEEWILLDPSQKNLYKNVMLETYRNLTAIGYSWEDYNIEEHCQSSGGHARYHPRHKTFLNIGEHYECIL

SEQ ID NO: 12025 - protein, 81 aa, Peromyscus maniculatus
EARLASFWDVSVELSSEEWQLLDPAQQQMYREVTLENYSNLLSVGYLDTKPELIFKLEQGKEPWVINAKMSTQSCPEGWKK

SEQ ID NO: 12026 - protein, 81 aa, Peromyscus maniculatus
HKKSMVFSDVSLDFSQEEWECLGPAQKDLYRDVMLENYSHLLSVGLHIPKPQVISLLEQGKEPWMIGKELTRGLCSALESM

SEQ ID NO: 12027 - protein, 81 aa, Peromyscus maniculatus
MSAVTYNDVHVDFSVEEWALLDSSQKNLYNDVMLETYRNLRAIGNSLEDHNNEKHCQSSGRHGRNERNHTGEKLAVNTQCV

SEQ ID NO: 12028 - protein, 81 aa, Peromyscus maniculatus
PQSLLSFGDVAVDFSQEEWEYLDYDQRTLYMDVMLENYSNLVFVENHRIYGKYEKDLDQGTKHIAHEDVIIQEKSYKCNEL

SEQ ID NO: 12029 - protein, 81 aa, Peromyscus maniculatus
SQGLLSFRDVAVDISQEEWECLDCAQRALYMDVMLENYNNLLFVENHRICGKYEKVLHQVTKHFIHDHENIREKSYKCNEL

SEQ ID NO: 12030 - protein, 81 aa, Peromyscus maniculatus
MNTVIYDDVHVDFTWEEWTLLDPSQKNLYKNVMLETYRNLTIIGYSWEDHNIEEHCPSSRQHERNERSQTTEKPSKPCECN

SEQ ID NO: 12031 - protein, 81 aa, Peromyscus maniculatus
SLLTFRDVAVDFSQEEWECLDCAQRALYMDVMLENYNNLVFVGENQRVHIGNKEQKNTDLDKSFDSQHKLTLEQIKSRMKL

SEQ ID NO: 12032 - protein, 81 aa, Mesocricetus auratus
GELPATFEDVAVYFTQEEWGLLGKQQKELYRDVMQMNYELLVSLAEPPAAEPDLITELKRRAAPWMKDPNGLKSGKSRSLG

SEQ ID NO: 12033 - protein, 81 aa, Mesocricetus auratus
FQNSLTFDDVAVDFTQEEWVLMDQTQRDLYREVMLENYQNLFSAGCEITKPSLISWLEEDLQIGQREDFQEWEMQDTLREQ

SEQ ID NO: 12034 - protein, 81 aa, Mesocricetus auratus
MEPLTFKDVAIDFSGEEWECLNSEQQNLYKDVMLENYRNLVFLGLAVSKPYLVTCLEQRKEPWNVKKQKTMVLFPAMFPHY

SEQ ID NO: 12035 - protein, 81 aa, Mesocricetus auratus
PQGLLTFKNVTVDFSQEEWECLDSSQRALYMDVMWENYSNLVFVENHCICGKYEIVLNQGSKRIVHEDVNTQEKSHKCYEL

SEQ ID NO: 12036 - protein, 81 aa, Mesocricetus auratus
SKGSVSFKDVTVDFTQEEWQQLDPAQKALYRDVMLENYCHFISVGFHITKPDMIRKLEQGEELWTERIFPSQSYLDEDVLV

SEQ ID NO: 12037 - protein, 81 aa, Mesocricetus auratus
HMGLLTFQDVAVDFTQEEWECLDSAQRTLYIDVMLENYSNLVSLGIISCKADLVPCLEQIQMACNVKKEEMVARPENHQMC

SEQ ID NO: 12038 - protein, 81 aa, Mesocricetus auratus
NAVTYDDVHVKFTKEEWDLLDPSQKKLYSNVMLETIRNLTDIGYNWEDNNIEEDSPSSKRHDSHLERYERLHIEEKTSESI

SEQ ID NO: 12039 - protein, 81 aa, Mesocricetus auratus
SAGILTFEDVAIDFSQEEWECRDSAQKSLYQDVMLENYSNLVSVGLTVSKPELINSLEQSKDPWDVNIGETEDKEQKWSLV

SEQ ID NO: 12040 - protein, 81 aa, Mesocricetus auratus
MDPSQKKLYEDVMLETYRNLTTIGYSWEDHHVEEYYQSSRRYERNERSQTGEKPSVYTQCVKAFAYDTHLQRHETTHTGEK

SEQ ID NO: 12041 - protein, 81 aa, Mesocricetus auratus
EVGDMSFWDVAIYFSAEEWECLDPAQWNLYRDVMLENFSNLVFLGLVSCKPYLVTFLEQRQGPSDVKRQAAASMPTGTKCY

SEQ ID NO: 12042 - protein, 81 aa, Mesocricetus auratus
SQESVTFQDIAVDFTEKEWPLLDSSQRKLYKDVMLENYSNLTSLGYQVGKPSLISHLEQEEEVRMEERGIQLGSSPDSGTP

SEQ ID NO: 12043 - protein, 81 aa, Mesocricetus auratus
MEPVSFDDVAVNFTSGEWVLLDSSQRKLYRDVMKETFMNLIFIGKIQEDNIDVVYQKLQRNLRIQVIEQYDDYEYGSQFGK

SEQ ID NO: 12044 - protein, 81 aa, Mesocricetus auratus
LTGLLTFKDVSVDFSQEEWQCLDSAQRTLYIDVMLENYNNLVYVENYYMCDPIHQHGKTEKESCQCNQFGKILHDPSTCAL

SEQ ID NO: 12045 - protein, 81 aa, Mesocricetus auratus
MAFHDVAVAFNQMEWELLSPSQRILYREVMLENYSHLVSLGKALLFQFSEFTCGHLNMLCSLERPNWTLQVDSSIGRVFRR

SEQ ID NO: 12046 - protein, 81 aa, Mesocricetus auratus
DTVSYDDVHIDFTQEEWALLNPSQKSLYKGVMLDTYRNLSVIGYSWDDHNFDEHCESSRRNRRNEPSHTGEKPCTQNQCHC

SEQ ID NO: 12047 - protein, 81 aa, Ictidomys tridecemlineatus
MLENFRNLLSVGHQSFKPDVISQLEREEKLWMEEIHTHPGGRNQSRVESRHEAGWKCLSLGELSCWQIGRHVVNGMTESQD

SEQ ID NO: 12048 - protein, 81 aa, Ictidomys tridecemlineatus
QIQESVTFRDVAVLFSQDEWLHLDSAQRTLYREVMLENYSNLVSLGIAFSKPKVISQLEAEYPQAVRNGVPQSTCLGWENL

SEQ ID NO: 12049 - protein, 81 aa, Ictidomys tridecemlineatus
MVTFKDVAVVFSEEELGLLDCAQRKLYRDVMLENFRNLLSVAHQPFKPDLIAQLEREEKLLIVEAKIQRDGYSGSISQPKT

SEQ ID NO: 12050 - protein, 81 aa, Marmota monax
TEGQLAFRDVAIEFSQEEWKCLDPTQRALYRDVMLENYRNLVSLGIFLPDLGVISMLEEGKEPWTLKNEVKIARNPSGWGC

SEQ ID NO: 12051 - protein, 81 aa, Heterocephalus glaber
EGVNFKIVTVDFTHEDQGTWNPAVRTPDRGVTLENHRDLVSWDLATAFGRRESTLKQGIFDEELSHGVKIEKLTRDDPWLS

SEQ ID NO: 12052 - protein, 81 aa, Heterocephalus glaber
EEEEIRSRELEDGPTDMQKVRICSEGGWVPALFDEVAIYFSDEEWEVLTEQQKALYWEVMRMNYETVLSLEFPFPKPDMIS

SEQ ID NO: 12053 - protein, 81 aa, Heterocephalus glaber
MYFSQEEWELLDTTQKALYNDVMQENYENVISVALFGLPKPKVISCLEQGEEPWVQGSLDFKDSPRESPTEFKLRKDTENH

SEQ ID NO: 12054 - protein, 81 aa, Heterocephalus glaber
LTFQDVAVYFSRAERRQLGPGQRALYRDVMLENYGNVASLGFPIPKPELISQLERGEELWVLDLLGAEETEVLRTYQTDSE

SEQ ID NO: 12055 - protein, 81 aa, Mus caroli
LNSAVTYDDVNVNFTREEWALLDSSQKSLYKDVMLETYRNLTAIGYNWEGHNIEEHCQSSRRHARTHKRTHTGEKSYECDQ

SEQ ID NO: 12056 - protein, 81 aa, Mus caroli
TKDPLSFTDVAIDFSADEREYLDSAQWNLYKEVMLENYSNLVFLGLAFSKPHLVTFLEQSSDLWSVKRKASAAIPLGSKAH

SEQ ID NO: 12057 - protein, 81 aa, Mus caroli
MDALTFDDVHVHFTREEWCLLDPSQKRLYKDVMLENYRNLTAIGYNWKDHNIEEHSQNDRRYGRHKRSSAGEKPCEYIKWY

SEQ ID NO: 12058 - protein, 81 aa, Mus caroli
DAVTFDDVHVNFTKEEWNLLDLSQMNLYKDVMLETYWNLNSIGYKWEDHHIEEPCQSSGGHVRSHRWKKLYECHQCGKAFA

SEQ ID NO: 12059 - protein, 81 aa, Mus caroli
VQEPVTFRDVAVSFSQDEWLHLDPAQRTLYQEVMLENYSNLASLGILFSKPKVIAQLEQAEDFQMVESGMFQGVYLGWKSL

SEQ ID NO: 12060 - protein, 81 aa, Mus caroli
TGDWEMAAALLAAGSQEEWRSLDPSQTDFYGEYVMQENCGIVVSLRFPIPKLDMLSQQEGGEDQWAPGPQDVEGRDILKVT

SEQ ID NO: 12061 - protein, 81 aa, Neotoma lepida
SQGLLTFQDVTVDFSQEEWECLDSAQRTLYIDVMLENYNNLVSVENYWICDAIQKHVKTEKESCQYNELGKVLHEPSTCTL

SEQ ID NO: 12062 - protein, 81 aa, Mus musculus
FSQEEWECLDSAQRALYIGVMLENYSNLVSVGIIVCKADLVPHLEQIYIPWNVKIKEMVAKPGRESYRMCSESEIVFYQDS

SEQ ID NO: 12063 - protein, 81 aa, Mus musculus
MEAVTFKDVAVVFTKEEFRLLDSAQRTLYQDVMVENFRNLLSVEYQLFKRDKPYLEREEKPQMRRAAPRERDSGINGQSAR

SEQ ID NO: 12064 - protein, 81 aa, Mus musculus
PQGLLTFKDVALYFSLEEWECLSFAQRTLYMDVMLENYNNLLFVENHCIRGKYRKVLDQDSQYVVHEHMNIQEKSSKWDKL

SEQ ID NO: 12065 - protein, 81 aa, Mus musculus
VAFDDVAINFTQEEWALLDPSQKNLYRDVMEEVFRNLTSIEKGWEDQNVEDEDKNPQTNLRHIIANSGYNLYESEESSEKP

SEQ ID NO: 12066 - protein, 81 aa, Mus musculus
PQSQITFKDVAMHFSQEEWECLDCAQRALYMDVMLENYNNLFFVENHCMCPKFENMLDQDLQHIIHKHANIQVKSYECHEL

SEQ ID NO: 12067 - protein, 81 aa, Mus musculus
ALCASQPDMITSLEQGRDPWMMKRKMRKGQHLDLKAMQETKEFPPKDLSEETLFLAVLRKQLLPHRPKCSMVRAAWEGGAV

SEQ ID NO: 12068 - protein, 81 aa, Mus musculus
AGDALTFDDVHVHFTREEWSLLDPSQKRLYKDVMLDTYRNLTTIGYNWEDHNIEEQCQSGRRHGRHQTSHAGEKHCEYTQY

SEQ ID NO: 12069 - protein, 81 aa, Mus musculus
VRSQEAMTFKDVAMDFTPEEWGKLDPAHRAVMLENYRNLVSLWLPISKPDNYNSEDGKELSKLEKSPKCSDSGQPPFQKAE

SEQ ID NO: 12070 - protein, 81 aa, Mus musculus
TNGLLTFKDVAIEFSKEEWECLDSAQRTLYRDVMLEIYSILVSVGLSISKPELLTYLEQNEEPYIAKGIEPVLSCFHNKEL

SEQ ID NO: 12071 - protein, 81 aa, Dipodomys ordii
RLQEPVTFRDVAVDFTQEEWGQLDLTQRTLYREVMLETFRHLLSVGPELPKPEVISQLEQGAELWIERGVTQGYNPVWALG

SEQ ID NO: 12072 - protein, 81 aa, Dipodomys ordii
SKSLENDGVCFSEQEWENLEEWQKELYRNVMQSNYETLVSLKVLGQPEEEAELGTEMLGDLEEEGPHGTHLVDGAMGKQEG

SEQ ID NO: 12073 - protein, 81 aa, Dipodomys ordii
AVTQLTFEDVAVDFTPEEWRCLTPAQRALYRDVMLDTYRNLVSVGVSPPSMSVILPLEFQEEPWVAQSHVTTLGGLNGWEG

SEQ ID NO: 12074 - protein, 81 aa, Dipodomys ordii
SLGLVSFEDVSVDFSWEEWKDLDDAQRTLYKDVMLEIYSNLVSLGHCVPKPEVIVKLEQGAEPWLGEALDKNITDVQQVDG

SEQ ID NO: 12075 - protein, 81 aa, Dipodomys ordii
QAYANFEDVVFSFTPEEWGFLDEAQRQLYLNVMLETFALVTSVGCGHEVDGWASSVPRVSLGGKSHVTSPQICPPTQKTHS

SEQ ID NO: 12076 - protein, 81 aa, Dipodomys ordii
TPKEAFTFQDVAVDFTEEEWAMLDASQRKLHRDVMWESISHLLAVGVDLCESDVLSQLELREMWRERREFLRALKPESELQ

SEQ ID NO: 12077 - protein, 81 aa, Cricetulus griseus
MGLLTFRDLDVDFSQEEWECLDPAWRSLYVDVMLENYRNLVFVEKYRVRGKYENIMDQVSKNIAFQHVNTHKKSYRYTDLG

SEQ ID NO: 12078 - protein, 81 aa, Cricetulus griseus
SIKDMSFWDVAIHFSAEEWECLGPTQWNLYRDVMLENFSNLVFLGLASCKPYLVTFLEQRQETSDVKRQEAAAMPTGAKCY

SEQ ID NO: 12079 - protein, 81 aa, Cricetulus griseus
MTYDDVHINFTWEEWTLLDTPQKMLYKGYIWEDHTIEDHCAISKSHERHERSQTGEQTSVYTKCVKAFAYNSHLQRHKRTH

SEQ ID NO: 12080 - protein, 81 aa, Cricetulus griseus
EYVQESVIFKDVAIDFTLEEWRLVDPTQRKLHKNVMLESYKNLLSLVSKPDMISHLENGKHPWAVVREISRASYGDLKTKS

SEQ ID NO: 12081 - protein, 81 aa, Cricetulus griseus
VSFEDVAVHFTQEEWDLLDASQKSLYGDVMLETCRNFTAIGYEWEDQTVGEHCEDPEINLRHIDSRSECTQYEHEEFEQKP

SEQ ID NO: 12082 - protein, 81 aa, Cricetulus griseus
MACSKVSNHHHNGNQFCFQSLLTFKDVAINFSKEEWECLHTSQKDLYRDVMLENYSNLVSVGENQSFSDCSLGLGMSINFY

SEQ ID NO: 12083 - protein, 81 aa, Peromyscus maniculatus
SQDLVTFGDVSVNFTQEEWEWLNDAQRDLYRKVTLENYKSLVSLAGIPVYKPAVISLLEQGKDPCVVQKEGARDASPDWDY

SEQ ID NO: 12084 - protein, 81 aa, Peromyscus maniculatus
MEEMLSFWDVAIEFSAEEKECLEHAQWNLYRDVMLENYSNLVFLGLAVSKPHLVTFLEQGQESSDVKGQAAAIVHPGITTN

SEQ ID NO: 12085 - protein, 81 aa, Peromyscus maniculatus
VTYEDVHVNFTHEEWALLDPSQKNLYKDVMLETYWNLTIVGYKWEDHNIEEHYPNSTRHSRMMKFRLTLNFRHFCFHLKLL

SEQ ID NO: 12086 - protein, 81 aa, Peromyscus maniculatus
FKELVEFRDVAVEFCREEWECLDPHQRSLYRDVILETYGNFVSLGLAIFKPSVISLPEQGKEPWMVEQAGWYPDLLSVNET

SEQ ID NO: 12087 - protein, 81 aa, Peromyscus maniculatus
ADSVTFEDVAVYFTKEEWNLLDGFQRNLYRDVMLENYQNVATVERKMELEKLQLDSFWSDISNETQLARLTKAGSHNGGKL

SEQ ID NO: 12088 - protein, 81 aa, Peromyscus maniculatus
MVTFKDVAVAFSEEELRLLDPAQRKLYQEVMVENFQNLLSVGINNQSELRAVQDGGSHEALSCWQIWQRVIDNLTRCQDSM

SEQ ID NO: 12089 - protein, 81 aa, Peromyscus maniculatus
KENAVTYDDIHIDFTREEWTLLDPSQKNLYKDVMLETYRHLTTIGYSWEDHNIEKYCESSRRHKSTVQRHKRTNTNENPYE

SEQ ID NO: 12090 - protein, 81 aa, Peromyscus maniculatus
NTVTYDDVHVDFTWEEWTLLDPSQKTLYKDVMLETYRNLYTLGYSWEDDNIEEHHQISRSHERHERRHTGEEHSLYTKYGK

SEQ ID NO: 12091 - protein, 81 aa, Peromyscus maniculatus
EQDAVTYEDVHVNFTHEEWALLDPSQKSLYKDVMMETYWNLTCVGYKWEDHNIEEHCQCCRRNGSRCVICHSGHNPCEHKG

SEQ ID NO: 12092 - protein, 81 aa, Peromyscus maniculatus
FQGLLTFRDVTVNFSQEEWKCLDTAQRALYIDVMLENYNNLLFLEKYFKCDSVPQHVKTECESHQYNELEKTLPDPSIYAH

SEQ ID NO: 12093 - protein, 81 aa, Peromyscus maniculatus
MDPSQRNLYKDVMLETYMNLTAIGYNWEDVEVEEYCQISEKHGRHERSHTKEKSYGYIECGKAFVCHSHPQRHKRTHTREK

SEQ ID NO: 12094 - protein, 81 aa, Peromyscus maniculatus
AQGCMAFNDVAIYFLREEWTLLDDSQRRLYHHVMMEVFVLMSSLGLIPSGTRNITQLESSDPFIPALRFLTPRIVVEKIPC

SEQ ID NO: 12095 - protein, 81 aa, Ictidomys tridecemlineatus
QDLVTFRDVAVDFSQEEWNCLDSSQRHLYSNVMLENYNILVSLGWESMYETKELMPKQELYEEQSSQNIMEKLTSFGFEYS

SEQ ID NO: 12096 - protein, 81 aa, Mesocricetus auratus
AEDFVTLKDTAMDFTLEDWEELELELNKRDPFWDLTLSNCQDLFLLNPPKPSLVSQPDIREELEATVRGGGLEATDTGGTI

SEQ ID NO: 12097 - protein, 81 aa, Mesocricetus auratus
KVPVTFVDIAVYFSEDEWKNLDEWQKELYSNLVKENYKTLMSLDADGPVSKPDAPVQAEPREEPCVWEQHHPEEREIPVAA

SEQ ID NO: 12098 - protein, 81 aa, Ictidomys tridecemlineatus
AQGLVTFRDVIIEFSQEEWKCLEPAQRDLYRDVTLENFSHLVSLGLSISKPDVISLLEQGKEPWILANDMTGPWYPDLKSR

SEQ ID NO: 12099 - protein, 81 aa, Ictidomys tridecemlineatus
APGLIAFEDIAVYFSREEWMLLDTAQRALYRHVMLGNFALVASLGLSASRPRVVIQLEHGEEPWVPSGTDTALGRNAHRKS

SEQ ID NO: 12100 - protein, 81 aa, Marmota monax
MLETYRNLVSLGLAISKPDVISFLEQGKEPWMEERVVSGSLCTVLKSRYETKVSPPEQHVHEVKSPRWEIMERLASYGLRC

SEQ ID NO: 12101 - protein, 81 aa, Marmota monax
SQRMLKMENVALTFSPGWTQLNSSQMNLYRDERQENCGHLVSLGGKIQATIQDLPPAKEHLEKPGQKLYHLGEDIAQISAG

SEQ ID NO: 12102 - protein, 81 aa, Marmota monax
KVPVTFVDIAVYFSEDEWKNLDEWQKELYNNLVKENYKTLMSLDTDGPVPKPDAPAPVEPREEPCVWEQRHPEEREIPVDT

SEQ ID NO: 12103 - protein, 81 aa, Heterocephalus glaber
EPWAITFADVAVYFSPEEWGCLQPTQRALYRDVMRDTYVLLSALGGGGAKPALISWVEREAELWDPDAQDPEVPKWPTEAD

SEQ ID NO: 12104 - protein, 81 aa, Heterocephalus glaber
QGLVIFEDVALHFSQEEWGLLTVAQRSLYRDVMLENFALISSLGKSSSLTTSTSFPGEGFVHTEAPSGSLRGLLGERPDEC

SEQ ID NO: 12105 - protein, 81 aa, Mus caroli
SVTFEDVAVDFTQEEWILLDTKQRNLYREVMLENYQNLATLGLVMAALRTVENNRDLECQLIKSRYSFCLEAEELRVVKRR

SEQ ID NO: 12106 - protein, 81 aa, Mus caroli
SQGLVTFGDVAVVFSQEEWEWLSSEQRSLYWKVMLDNYRNLASLGLCASKPDMITSLEQGRDPWMMKRKMRKGQRLDLKAM

SEQ ID NO: 12107 - protein, 81 aa, Mus caroli
PQGQLTFKDVAVDFSQDEWEYLDCAQRALYVDVMLENYKNLFFVESHHLTHKYENILDEDTQCIVHEHMNLQSYKCHELGK

SEQ ID NO: 12108 - protein, 81 aa, Mus caroli
MDAVTYEDVYVKFTHEEWALLNPSQKTLYKDVMLETCRNLTAIGYKLQDDNIEEHCPSSRGCGRYNIYGYKSCEHKGHGQK

SEQ ID NO: 12109 - protein, 81 aa, Mus musculus
YRNVMFENYQNLATVGGQMFKPSLISWLEKKVELTVIEQGILQEWEMHLKTKRTALQQDRFWSDMSNGMQLMFPPKKCTPE

SEQ ID NO: 12110 - protein, 81 aa, Mus musculus
CERRLVKLRTPNMDLVTYDDVHVNFTQEEWALLDASQKSLYKGVMVETYRNLTAIGYSWEEHTIEDHFQTSRSHGSPDILW

SEQ ID NO: 12111 - protein, 81 aa, Mus musculus
MNAVTYEDLHVNFTQEEWALLDPSQKKLYKHVMLETYRNLNAIGFNWEAQNIEEHCQSSRRHRRCERSQSAEKPSEYTQRD

SEQ ID NO: 12112 - protein, 81 aa, Mus musculus
MENMLSFWDVVIYFSAEEREYLGPPQWKLYRDVMLENYNNLVFLGLASSKPYLVRFLEQIQEPLDVKSQVAISMYSGGNSS

SEQ ID NO: 12113 - protein, 81 aa, Dipodomys ordii
MLENYSHLVSLGYQVSKPEVIFKLEQGEEPWISEREIQRPFCPDQKTRPEAKSSNLLQSTSEVSRHQDERSHAALQDGWDV

SEQ ID NO: 12114 - protein, 81 aa, Mus caroli
LEELVSFEDVTVQFTQEEWALLDPLQRTLYRNVMLENWKNLASLGQHLDKPNLISQLEQEGKVITEDRGIIPGIHPDLETV

SEQ ID NO: 12115 - protein, 81 aa, Mus musculus
NMDLVTYDDVHVNFTQEEWALLDASQKSLYKGVMVETYRNLTAIGYSWEEHTIEDHFQTSRSHGRHERRSSAEQHSEFIPC

SEQ ID NO: 12116 - protein, 81 aa, Cricetulus griseus
ESVTFEDVAVHFTMEEWAILDPSQKELYKDVMKEILRNMVSIGNIRKHQKIENEYQNSGRKLRCHLVEKLHDCKEDHECAE

SEQ ID NO: 12117 - protein, 81 aa, Cricetulus griseus
EEWQHLDPDQKALYRDVMLENYCHFVSVGFPITKPDMIRKLEQGKELWTERIFPSQSYLEDEDVPVKFKDCLDKHPESTVL

SEQ ID NO: 12118 - protein, 81 aa, Cricetulus griseus
PDFGIIDQTSGTILLLAYFQHLLTFGDVAVDFPQEEWECLDSAQRALYIDVMLENYNNLLSVGENILLLEFITHHLFVLTS

SEQ ID NO: 12119 - protein, 81 aa, Cricetulus griseus
KPELVSFADVAVYFSPHEWGCLRPAQRALYREVMRETYGLLGALGFPGPKPALISWMEQESEAWSPAAQDPAEGESLGGAL

SEQ ID NO: 12120 - protein, 81 aa, Cricetulus griseus
MAFRDVAVDFSQEEWSLLSPAQRSLYREVMLENYSNLVSLGIPFSKPKLITQLEQGKETWQEERKCPQVACQAQAKLELCP

SEQ ID NO: 12121 - protein, 81 aa, Peromyscus maniculatus
VKIEDVADVAVSFILEEWGHLDQSQKSLSRDGRKDNCESITPVDYESREGNPELVVPQVSDGADPHWVAAESTGRSGAPSQ

SEQ ID NO: 12122 - protein, 81 aa, Peromyscus maniculatus
VCGSVTFRDVAVDFSQEEWACLDASQRVLYRDMMLETYSNLVTVVGCSISKPDLIALLEQEREPWMVVKEETDRPSPDLES

SEQ ID NO: 12123 - protein, 81 aa, Peromyscus maniculatus
PGLGVTFEDVAIHFSQEEWVLLDKAQRLLYCSVMVENLALVASLGSRPGMGDEEVTSEHAGPTDGVMSKTSPSTQQTHLFE

SEQ ID NO: 12124 - protein, 81 aa, Peromyscus maniculatus
QTAVTYDDVHIDFTWEEWILLDPSQKNLYKNVMLETYRNLTAIGYSWEDYNIEEHCQSSGGHARFKKCHTGKKPCEFSQCA

SEQ ID NO: 12125 - protein, 81 aa, Peromyscus maniculatus
MGLVSFEDVAVDFTWQEWQELDAAQRTLYRDVMLENYSSLVSLGHCVTKPELIFRLEHGFGPWSIGETSLWSLPGVLEVYA

SEQ ID NO: 12126 - protein, 81 aa, Peromyscus maniculatus
LQDPLTFQDVTVDFSQEEWECLDTTQRALYIDVMLENYSNLVSVENYCKYDPVHQHVKTEKESCQCNELGKMVHDPCTCAC

SEQ ID NO: 12127 - protein, 81 aa, Peromyscus maniculatus
VTFGDVAVNFTQEEWTLLDPFQKNLYINVMLETCSNLVSVGIKSEYQTIEEQYKHPGRNLRSIISNLGYTHKFEEYGKKQY

SEQ ID NO: 12128 - protein, 81 aa, Mesocricetus auratus
PQGLLSLRDVSVDFSQEEWECLDYDQRALYMDVMLENYKNLLFVEFHRICCKWKTVLHQGTKHFIHDHETIQEKSYTYNES

SEQ ID NO: 12129 - protein, 81 aa, Mesocricetus auratus
PKVPMTFDDLAVYFSELEWATLEDWQKELYRRVMTDNYETLVSLDYAISKPDILTWIEKGEQPFPAGPCGQGRGSEEKAVC

SEQ ID NO: 12130 - protein, 81 aa, Mesocricetus auratus
MGLLTFRDVSVDFSQEEWQFLDSSQRTLYIHVLLENYNNLLYVENYCICDPVHHHVKTEKESCQWNDLDKVLHDPCTCALH

SEQ ID NO: 12131 - protein, 81 aa, Mesocricetus auratus
MAFEDVAVYFSQEEWMFLDAAQRALYRHVMLENFALVDSIGLSVSRPRVIIQLQRGEEPWVPNRTNPGPGRSTCRRPSLGS

SEQ ID NO: 12132 - protein, 81 aa, Mesocricetus auratus
MNGLLSFRDVAVDLSQEEWECLDCAQRDLYMDVMLENYNNLLFVENHRICAKCEKVLHQGTKHFIHVHANIQGKTCKCNEL

SEQ ID NO: 12133 - protein, 81 aa, Mesocricetus auratus
KTVTFKDVAVDLTQEEWQQMKPAQRNLYRDIVNSLVIENFTSNEFWSSILEVWEVDGQMEKQQETLVRKVTSIFKKSLIKE

SEQ ID NO: 12134 - protein, 81 aa, Mesocricetus auratus
LLSFEDIAVDFTWEEWQDLDAAQRALYRDRALYRDVMLETYSSLVSLGHCMNKPELISKLEQGLGPWNVEESSDRSFPGLS

SEQ ID NO: 12135 - protein, 81 aa, Mesocricetus auratus
MVFSQEEWKCLDSAQRALYINVTLENYNNLSLSRPYTAKKVPRQGEYDQCSENTYSLLKKPVSTREKPYQCGKCKKCFSTA

SEQ ID NO: 12136 - protein, 81 aa, Mesocricetus auratus
SKRQLSFRDVAVDFSPEESECLDPAQWDLYSDVMLENYSNLVSLGLAFSKPYLITFLEQRKQPWNMKQQATVAIYPGSKPY

SEQ ID NO: 12137 - protein, 81 aa, Mesocricetus auratus
HSEEWECLDSAQWAFYIDMMLENYSSLVLVENYFICDPIHHHVKTEKESCHCDELDKLLHAPSTCVLNRTSESTENSNKYT

SEQ ID NO: 12138 - protein, 81 aa, Ictidomys tridecemlineatus
DSVSIEDVAVEFTQEELTLEDPTQRKTHNDVTVKNCKNLATVELDMQLKTKDSALQQNFLTEHTSSDIQLESVTFEDVAVD

SEQ ID NO: 12139 - protein, 81 aa, Mesocricetus auratus
DMDAVTYHDFHVNITQEEWDLLYTSPRNLYRDLILEANMKINSIGYAWEDTNIEEHFESPQRHQRSETSPTGEETSVNIPC

SEQ ID NO: 12140 - protein, 81 aa, Marmota monax
MLENYSHLVSLGYPITKPDVIASLENGVLEIIKREIPSSSCTEDEQAEDQLENHQENQNRHLRQAISIDEKNVSKERAHEF

SEQ ID NO: 12141 - protein, 81 aa, Marmota monax
SISFEDVTVNFSREEWQHLDPVQRRLYWDVTLENYHHLISVGENIRKTQQQEISGEVAFHCERFDQPTGEDSLCSILEELW

SEQ ID NO: 12142 - protein, 81 aa, Heterocephalus glaber
MASPSSPLEPKEEWDYLDPAQRSLYKDVMMENYGNLVSLDVLNRDKDEEPAVKQEIEELEEVEPQGVIVTRIKSEIDQDPM

SEQ ID NO: 12143 - protein, 81 aa, Heterocephalus glaber
VTFEDVALDFTQEEWVLLDQSHRDLYREVMLENYENLTSRGKNPVVSFGLLGRRWRLCTSCVTAWVMWTLCPLGNERDIAS

SEQ ID NO: 12144 - protein, 81 aa, Heterocephalus glaber
MELLIFRDMAIHFSPEQWECLEAALQNMYRDVMLETYGNLVSLGFAGSTLNPITFLEQSREPRNVKRQETLAVYPGGHLQR

SEQ ID NO: 12145 - protein, 81 aa, Mus caroli
MLSFWDVAIDFSPEEWDCLEPAQWDLYRDVMLENYSHLVFLGLAVSKPFLVTFLEQRQGPWDMKRQGMATVYPGIIPNDPN

SEQ ID NO: 12146 - protein, 81 aa, Mus caroli
MATSEPAESDAEWEQLEPVQRNVYKDTKLENCSNPDSMGNQDTKQDIVSKLEEEEPSSGKGKKTSPSSLDKIARPKKAGTS

SEQ ID NO: 12147 - protein, 81 aa, Mus caroli
MAAVTYEDVHVNFTHEEWVLLDPSQKSLYKDVMLETYWNLTAIGYKLEDLNSEEHPQRSRRYGRHKICHSEYKPCELKGHG

SEQ ID NO: 12148 - protein, 81 aa, Mus caroli
LQESVSFEDVSVDFTQEEWNQLDPIQRSLYRDVMLENYSHLVSLGYPITKPEVITSLEQGVLGIIKREIPSSSCTEDGQAE

SEQ ID NO: 12149 - protein, 81 aa, Mus musculus
DMGLVSFEDVAVDFTWQEWQELDAAQRTLYRDVMLENYRSLVWLGHCLAKPELISKLEEGFEPWGVAEATEQCLPCAEDQT

SEQ ID NO: 12150 - protein, 81 aa, Peromyscus maniculatus
VCGSVTFRDVAVDFSQEEWACLDATQRVLYRDMMLETYSNLVTVVGSSVSKPDLIALLEQEREPWMVVKEETDRPSPDLES

SEQ ID NO: 12151 - protein, 81 aa, Peromyscus maniculatus
PQESVTFKDVAVDFTQEEWHHVDPAQKILYRDVMLENYSHLVSLGCQVSKPEVIFKLEQGEEPWISEREIQRPFCPAFCLN

SEQ ID NO: 12152 - protein, 81 aa, Peromyscus maniculatus
MLENYNNMVSVERHFSKPNVISQLEEVEDFWPVEREIPQDIFPESSGPSLDPGINSFPDESPLTKINVVEVLTLNKDVAGP

SEQ ID NO: 12153 - protein, 80 aa, Peromyscus maniculatus
MVSEGPPSPCGEEPWEQDAVTYEDVHVNFTHEEWSLLDPSQKHLYKDVMLETYWNLTCIGYKWEDHNIEEHCQSCRRNGR

SEQ ID NO: 12154 - protein, 81 aa, Peromyscus maniculatus
HDMNTVTYDDVRIDFTWEEWTLLDPSQKNLYKDVMLETYRNLTSIGYIWEDHNIEEYCQSSRGHESTPVIPAQLVQDDDAD

SEQ ID NO: 12155 - protein, 81 aa, Peromyscus maniculatus
KKNAVTYDDVHVDFTWEEWTLLGLSQKNLYKDVMLETYMNLTTIGYSWEDPNIKEHCQSSRGHQRHNGSQSREKPVYTQCV

SEQ ID NO: 12156 - protein, 81 aa, Mesocricetus auratus
TNLKGTSKDVTVDFTQEEWQQLDPAQKALYRDVMLENYCHFISVGFHITKPDMIRKLEQGEELWTERIFPSQSYLEDEDVL

SEQ ID NO: 12157 - protein, 81 aa, Mesocricetus auratus
NAVTYEDLHIDFTWEEWTLMDPSQKNLYKDVMLETYRNLTAIGYSWKDHHIEDYQSSRRYERNERSQTGEKPSIYTQGVKT

SEQ ID NO: 12158 - protein, 81 aa, Mesocricetus auratus
SQVLLTFRDVTVDFSQEEWQCLDSAQRTLYIDVMLENYNNLLYVENYCVCDPVHHHVNNEKESRWCHDLGKVLHDPSTCAL

SEQ ID NO: 12159 - protein, 81 aa, Ictidomys tridecemlineatus
MASPSSPLEPKEEWDYLDPAQRSLYKDVMMENYGNLVSLDVLNRDKDEEPTVKQEIEEIEEEVEPQSVIVTRIKSEIDQDP

SEQ ID NO: 12160 - protein, 81 aa, Ictidomys tridecemlineatus
FQDLVTFRDVAVDFSQEEWNCLDSSQRHLYSNVMLENYNILVSLGLCFSKPSVIILLEQGKEPWMVKREFTNGLCSGWESM

SEQ ID NO: 12161 - protein, 81 aa, Ictidomys tridecemlineatus
WSQMPVTFEDVALYLSREEWGRLDHTQQNFYRDVLQKRNGLALGFPFSRPLWAAQVQGKGEAASSSRQTGAEKEEKRGPGS

SEQ ID NO: 12162 - protein, 81 aa, Ictidomys tridecemlineatus
TEGQLAFRDVAIEFSQEEWKCLDPTQRALYRDVMLENYRNLVSLGMCPSDPSVLSWLEQGREPWTVNGPDEWACVEGVKAG

SEQ ID NO: 12163 - protein, 81 aa, Ictidomys tridecemlineatus
GAVSFADVAVYFSPEEWGCLRPAQRVLYRDVMRETYGHLGALGDISNKEKLEPKEGPAARREMTPGKEQHEELVKHNPDCT

SEQ ID NO: 12164 - protein, 81 aa, Marmota monax
QQRPVSFKDVVVGFTQEEWRRLNPAQRALYRDVMLETYSNLVSVGYEGTKPDVILRLEQEEAPWICEAVCPGCHCQEDFLS

SEQ ID NO: 12165 - protein, 81 aa, Marmota monax
MLETYGHLLSVGNQMAKPEVISLLEQGEEPWLVEQTCPESSCPEWMRDHESSALIPTQSTFNEEPSHGMKLKRYIWDDPWF

SEQ ID NO: 12166 - protein, 81 aa, Marmota monax
SQASVSFKDVTVELSQEEWQHMGPAQRTLYREVMLENYSHLVSVGFCFTKPELIFTLEQGEDPWSLEKEKGFLNWSSPEDS

SEQ ID NO: 12167 - protein, 81 aa, Heterocephalus glaber
RPRALKFADVAVYFSPEEWGCLRPAQRTLYRDVMRETYGLLGALGCAGPKPALISWLERSTDDWEPAALDPQEYPRGVTVQ

SEQ ID NO: 12168 - protein, 81 aa, Heterocephalus glaber
LFQESLTLEDVAVRFTREEWQLLGPAQKDLYRDVMLENYSSLVSVGYQASQPDSLSSLLCGEPWMVEDELHCGTHSDLTLV

SEQ ID NO: 12169 - protein, 81 aa, Mus caroli
GCVTFQDVAICFSHEEWRLLDETQRLLYLSVMLQNFALINSQGCGHRTEDEERRVSTRASKGLRSETTPKTNLCEKCVPIL

SEQ ID NO: 12170 - protein, 81 aa, Mus caroli
MATSEPAESDAVRAEWEQLEPVQRNVYKDTKLENCSNPDSMGNQDTKQDIVSKLEEEEPSSGKGKKTSPSSLDKIARPKKA

SEQ ID NO: 12171 - protein, 81 aa, Mus caroli
DSDVMTCHWATCCWSMSYNAVTYEDVHVNFTREEWALLDPSQKSLYKDVILETYRNLTALGYNWEDCNIEEHCQSSRRHGR

SEQ ID NO: 12172 - protein, 81 aa, Mus caroli
VDMGLVSFEDVAVDFTWQEWQELDAAQRTLYRDVMLENYRSLVWLGVRKWSAPVEKSQQSHEKYLRQVKIIKKNTSDEDKV

SEQ ID NO: 12173 - protein, 81 aa, Mus caroli
VQDLVTFKDVAVLFTQEEWGRLSSAQRALYRDVMLENYSNLVSLGLLGSRPDMFFPLEEVEECVSEEAPEGFVLDAADEPH

SEQ ID NO: 12174 - protein, 81 aa, Mus caroli
VSFEDVAVHFTQDEWALLDPSQKSLYRDVMLETCRSLAAIGYIWEEQNVEDDCKNFGRIQRHVISDSEHLLDEQEGYGNKP

SEQ ID NO: 12175 - protein, 81 aa, Neotoma lepida
LPLTFEDVAIYFSEQEWRRLEAWQRELYKHVMRTNYEILVSLDNGLPKPELISWIELGSELFSSWGEEQKLEEGIRSSADD

SEQ ID NO: 12176 - protein, 81 aa, Mus musculus
VCGSVTFRDVAVDFSQEEWAFLDATQKVLYRDMMLETYSNLVAVVGSCISKPDLIVLLEQEKEPWMAVKEETDWPSPDLEA

SEQ ID NO: 12177 - protein, 81 aa, Mus caroli
SQGLLTFRDVTVDFSQEEWECLDSAQRALYIDVMLENYSNLVYVENYCICDTVCQHVKTEKESCQCNELGEMLHEPSNCVL

SEQ ID NO: 12178 - protein, 81 aa, Mus caroli
VCGSVTFRDVAVDFSQEEWACLDATQKVLYRDMMLETYSNLVAVVGSCISKPDLIVLLEQEKEPWMTVKEETDRPSPDLEL

SEQ ID NO: 12179 - protein, 81 aa, Mus musculus
VEEPVTFKDVAVAFTQEEWGQLDLVQRTLYRDVMLETYGHLLSVGNQIAKPEVISLLEQGEEPWSVEQGYPKSSCPEWMRN

SEQ ID NO: 12180 - protein, 81 aa, Mus musculus
MEDPLSFTDVSIDFSADECECLDSAQWNLYKEVMLENYSNLVFLGLAFSKPYLVTFLEQSSDPWSMKRKESAAIHLGSKPH

SEQ ID NO: 12181 - protein, 81 aa, Mus musculus
VSFEDLVVHFTQDEWDLLAPSQKTLYGDVMLETFRNFTAVGYEWEDEAIEDHCEDPEVNLRNIVTHSEYTQYEHEEYEEKP

SEQ ID NO: 12182 - protein, 81 aa, Mus musculus
DSTGCCERRLVKLRTPNMDLVTYDDVHVNFTQEEWALLDASQKSLYKGVMVETYRNLTAIGYSWEEHTIEDHFQTSRSHGR

SEQ ID NO: 12183 - protein, 81 aa, Cricetulus griseus
TEPIEFEDVSLTFTEEEWALLGHEQKCLYKEIMLENYNNVISVGQKRVPHIIMDICEPQFAGSELGSGHREEQPVVLATDT

SEQ ID NO: 12184 - protein, 81 aa, Cricetulus griseus
GNQFCFQSLLTFKDVAINFSKEEWECLHTSQKDLYRDVMLENYSNLVSVGLFESKPELVTCLEENKEPWMVNIDEAEGLGQ

SEQ ID NO: 12185 - protein, 81 aa, Cricetulus griseus
AVTFKDVAVVFSEEELGLLSAAQRKLYRDVMLETFRNLLSVGGQGPNKMETLHEAGLSCLLLGRLPCWQMMSQGVNELART

SEQ ID NO: 12186 - protein, 81 aa, Cricetulus griseus
QEFILPYRDVSVDFTKEEWQCLDSDQRALYIDVMLENYNNLIFVENYYSSDPAHQRVRIQKKPCQCSELGKVLHDPSMCAF

SEQ ID NO: 12187 - protein, 81 aa, Cricetulus griseus
CALQIYFGLFANTALDLLTGNMSSRKDAVTYDEVHTNFTQEEWAFLDPSQKRLYEDVMLDTYRLLLNGNAMLFRLLAFRSA

SEQ ID NO: 12188 - protein, 81 aa, Cricetulus griseus
MSRSKDVAVAFTQEEWRQLGSEEKTTYRDVMLENYSNLISVGYDVTKPNVIIKLEQGEEPWMMEGDCHAQSHLEISKVGDT

SEQ ID NO: 12189 - protein, 81 aa, Cricetulus griseus
LLIRWQVLQLNNLAYGANKVSNNHHNVSKDHKTVNQFLFQSLLTFKDVALNFLREEWECLNTSQRNLYRDVMLENYGNLVS

SEQ ID NO: 12190 - protein, 81 aa, Cricetulus griseus
EKQFSFQSLLTFEDVAIKFSKEEWECLNTSQRHLYRFVMLENYSNLVSVGLSVSKPELVIFLEQNKEPWMVNIEESEVLEP

SEQ ID NO: 12191 - protein, 81 aa, Cricetulus griseus
GCVTFEDVAVYFCREEWELLDESQRLLYLDVMLENFALIASLDCWHEAETGETACAQSVSPTEEPQVRAPKEGLPTKKTHP

SEQ ID NO: 12192 - protein, 81 aa, Cricetulus griseus
EVCLVGRGGMGVRSRFRWLALLAGPRRAQTGCLNQNKWIPPSKSHAGFLVFKPELISRLEQGQEPWVLDLQGAEGTEAPWI

SEQ ID NO: 12193 - protein, 81 aa, Cricetulus griseus
IQGVLTFRDVTVDFPQEEWECLDSAQRALYIDVMLENYSNLVSVENYYVCDPVHYHVKTEKESCQCNEVGKVLHDPSTCAL

SEQ ID NO: 12194 - protein, 81 aa, Cricetulus griseus
MFRDVTVDFSQEEWECLNSSERDLYKDVMLENYSHLVSLAGHSISKPDVITLLEQGKEPWMIVRDEKRRWSQELESRYSSK

SEQ ID NO: 12195 - protein, 81 aa, Cricetulus griseus
NAVTYDDVHVNFTSDEWALMDTSQKNLYKEVMRDTYRNLTDIGYNWEDNNIEEPDQISTQHGRHEKIQSEEESSQYIRCGK

SEQ ID NO: 12196 - protein, 81 aa, Cricetulus griseus
KHSPTSTLHLQEAVTWVLGIDLWALCKSHEHIWILIRFRTRMEFKKMKMSGEPAPDLVTFSDVAIDFSQEEWACLDSVQRD

SEQ ID NO: 12197 - protein, 81 aa, Cricetulus griseus
KKLLPGVLDVALDFSQEEWECLDSAQRALYSDVMLENYSNLVPVGLTLSKPELLNSLEDSEEPWNVNMGETEDKEQGNAFA

SEQ ID NO: 12198 - protein, 81 aa, Cricetulus griseus
MACSKVSNHHQKGNQFCFQSLLTFKDVAINFSKEEWECLHTSQKDLYRDVMLENYGNLVSVGENQSFSDCSLGLGMSINFY

SEQ ID NO: 12199 - protein, 80 aa, Castor canadensis
MNISQASVSLKDVTVELTQEEWQHMDPFQRTLYRDVMLENYSHLVSVGYCIFKPEVIFRLEQGEEPWLLEEEFPSQSFAG

SEQ ID NO: 12200 - protein, 81 aa, Peromyscus maniculatus
MLENYRNLASMGFPLLKPALISQLEEGKDLENLSQLATGTDSQGLWTEYTAIQTGNNLTKEVCEEKRSILFELQKDFFQET

SEQ ID NO: 12201 - protein, 81 aa, Peromyscus maniculatus
MEEMLSFWDVAIEFSAEERECLEPAQWNLYRDVMLENYSNLDFLGLAESKPHLVTLLEQRQESSDVTRQAAANVQPGTTTD

SEQ ID NO: 12202 - protein, 81 aa, Peromyscus maniculatus
SQVSVTFEDVAVLFTRDEWRKLDHSQRSLYREVMLENYSNLASLGCPFTKPKVISLLQQGEDPWKVEKEGPGDSSRGLTRS

SEQ ID NO: 12203 - protein, 81 aa, Peromyscus maniculatus
MDAVTYEDVHVNFTHEEWALLDPCQKSLYKDVMLETYWNLSAVGYKWGDENIEHCQSSRRHGRYVICHSGYKPCECKGYGK

SEQ ID NO: 12204 - protein, 81 aa, Peromyscus maniculatus
MNTVTYDDVHIGFTWEEWTLLDPSQKNLYKDVMLETYRNLAIIGYSWEDHNIEEHYQNSRRHERHERSQTGMKTSVHTQCS

SEQ ID NO: 12205 - protein, 81 aa, Peromyscus maniculatus
MESVTFDDVAVNFTLGEWALLDSSQKKLYRDVMTETFMNLISIGKTNEKENIEDNYQNLRKNVRTQVLERNCDYGDGGQCG

SEQ ID NO: 12206 - protein, 81 aa, Peromyscus maniculatus
AVNAVTYNDVHVDITQEEWALMDPSQRNLYKDVMVETYMNLTAIGYNWEDLEVEEHCQWSQKHGRHERPHTTEKSCEYMGC

SEQ ID NO: 12207 - protein, 81 aa, Peromyscus maniculatus
ADAVTYEDVHVNFTHEEWALLDPSQKSLYKDVMLETYWNLISTGYKWEDHNIEEHCQSSRRNKRDVICHSGYKACDHKGYG

SEQ ID NO: 12208 - protein, 81 aa, Peromyscus maniculatus
AGSKLSFRDVAIDFSPEEYECLGPAQWDLYSDVMLENYSNLVSLGLAFSKPYLITFLEQRKQPWNVKQQATVAVYPGIKPY

SEQ ID NO: 12209 - protein, 81 aa, Peromyscus maniculatus
QAQESLTLDDVAVVFSWEEWQLLSHAQKDLYWDVMLETCKSLVSMGYLTRKSDVCSQLDPGVPWTIEDEIHNLICPEIREV

SEQ ID NO: 12210 - protein, 81 aa, Peromyscus maniculatus
EPQQCGWTRFSIYLAAPLLHGWNLGAGLTPGHVSILSFSASHTAGFLVFKPELISRLEQGQEPWVLDLQGAEGTEAPWICQ

SEQ ID NO: 12211 - protein, 81 aa, Peromyscus maniculatus
DPVTYEDVHVNFTHEEWALLDPSQKSLYKDVMLETYWNLTCIGYKWEDHNIEEHCQSCRRNGRCVICHSGYNPCEHKGCGK

SEQ ID NO: 12212 - protein, 81 aa, Ictidomys tridecemlineatus
SQVSVTFEDVAVLFTRDEWRKLDPSQRSLYREVMLENYSNLASLGPPFTKPKVISLLQQGEDPWKVEKESPGDSSIGYKSS

SEQ ID NO: 12213 - protein, 81 aa, Marmota monax
DHELVTFRDVVINFSQEEWEYLDSAQRDLYWDVMMENYSNLVSLDLESRCETEILSVRKDVFENSGSQLEVMENSNLIDFK

SEQ ID NO: 12214 - protein, 81 aa, Marmota monax
WSQMPVTFEDVALYLSREEWGRLDHTQQNFYRDVLQKRNGLALGFPFSRPLWAPQVQGKGEAASSSRQTGAEKEEKRGPGS

SEQ ID NO: 12215 - protein, 81 aa, Marmota monax
MTRGFSYKKSVHQIPAHRHLYRDIRKESVGTMVSLGSTVSTSNKISRLEQRKEPWTIGLHSSNKRNILRSNCIKEKSVHAI

SEQ ID NO: 12216 - protein, 81 aa, Marmota monax
TDELVTFRDVAIDFSQEEWECLDPAQRDLYMDVMLENYSNWVSLDLDSTYETKNIFSEKDIFEIKFSRWDTKEESKTLGLE

SEQ ID NO: 12217 - protein, 81 aa, Marmota monax
FKGPVTFKDVTVEFTKEEWKLLTPAQRTLYKDVMLENYNHLVSVGYRVSKPNLVFKLKQGKEPWVLEVEFPRRRCPEELWN

SEQ ID NO: 12218 - protein, 81 aa, Marmota monax
PQLPESIEDVAMYISQEEWGHQDPNKRVLSRDTVQESYENVDSLESHIPSQEALKTQVEQGGKPWDPSVQSCKEGVSPRSA

SEQ ID NO: 12219 - protein, 81 aa, Heterocephalus glaber
SQGLVTIKDVSLCFSQEEWRSLDPSQTDFYGEYVMQENCGIVVSLRFPIPKLDMLSQLGGGEEQWVPGPQDLEERDILRVT

SEQ ID NO: 12220 - protein, 81 aa, Heterocephalus glaber
EAVTFEDVAVNFTKEEWAFLDPSQKKLYRDVMWETLRNLAAIGRSSGDQQIEDEYKTWSKSLSHSEMNTYACIPCGKSFNS

SEQ ID NO: 12221 - protein, 81 aa, Heterocephalus glaber
MLKEAVTFKDVAVAFTEEELGLLDSAQRKLYQDVMVENFRNLVSVEHQLFKQDRSHVERDEKLWMMKAETQRERSLGKDQA

SEQ ID NO: 12222 - protein, 81 aa, Heterocephalus glaber
AVTFEDVAVNFTMEEWALLDPSQKKLYRDVMWENFRNVASIGRNWDNQQIEDEYKNYWENLRNAEVVNLWYQHGKMVFVTP

SEQ ID NO: 12223 - protein, 81 aa, Heterocephalus glaber
VTFEDVAVNFTAEEWALLDPSQKKLYRDVMWETFRNVTAIERNCNDQQVEDEYKSCRRNRRSEEVDKWYQHELWYQHEDMM

SEQ ID NO: 12224 - protein, 81 aa, Mus caroli
MEAVTFGDVAVHFSREEWQCLDSGQRALYREVMLENHSSVAGLGFLVFKPELISRLEQGQEPWVLDLQGAEGAEAPRICQT

SEQ ID NO: 12225 - protein, 81 aa, Mus musculus
NLITYDDVHVNFTQEEWALLDPSHKNLYKDVMVETYRNLTAIGYIWEEHTSEDHFQNSRSHGRHERSCSAEQLSEFIHCGK

SEQ ID NO: 12226 - protein, 81 aa, Mus musculus
MMGSQEEWEQLDPSQRILYMDVMLENYSNLLSVEVWKADGQVERDPRDLQRQVGSLTTIKNQPPTEERGSRFGKTLTLNTD

SEQ ID NO: 12227 - protein, 81 aa, Mus musculus
KPWAVNFADVAVYFSPEEWRYLRPAQRALYREVMRETYGLLAYLDVGCAKPALICWVEEESEVWGPCAQDPEVAMCRTEVH

SEQ ID NO: 12228 - protein, 81 aa, Cavia porcellus
RTIEKAGPPSGPERPEVCGAGRASKARFRRRRAVRTSGGPQAGHGEAGFLVFKPELISRLEQGQEPWVLDLQGAEGTEASR

SEQ ID NO: 12229 - protein, 81 aa, Cricetulus griseus
EQEMLSFWDVAIEFSPEERKCLDPAQWNLYRNVMLENYSNLEFLGLAVPKPHLVTFLEQKQEPSGVKRQAAATVYPGTTTN

SEQ ID NO: 12230 - protein, 81 aa, Cricetulus griseus
MDFSLEEVEYLDPAQRALYKTLMIENYSSLISVGAEEVLSLFLTQKAERREQQGEMDGPVVNTSQGLLTFRDVAVDFSQEE

SEQ ID NO: 12231 - protein, 81 aa, Cricetulus griseus
SSGLVTFGDVAVFFTQEEWERLSPGQRRPYWKVMLENYRSLASLGLCASKPDMITLLEEGKDPWVMERELARGLCPDLKAV

SEQ ID NO: 12232 - protein, 81 aa, Cricetulus griseus
ALGLVSFEDVAVDFTWQEWQELDAAQRTLYRDVMLENYSSLVSLGHCVTKPELIFRLEHGFGPWSIGETSLWNLPEFVNLT

SEQ ID NO: 12233 - protein, 81 aa, Cricetulus griseus
AEVAFTFEDVAVIFTQEEWGQLAPAQRTLYQEVMLENRGLLVSLGYPVPKPELMCQLERGQELWSVMRNLSPRIGAVHMCA

SEQ ID NO: 12234 - protein, 81 aa, Cricetulus griseus
MLENYSNLVSVGLSVSKPELVTCLEQNKEPWMVNIEEADVLEPDSGEEKPSMLEACDNTCTQSSKLQVHQIHNGEKHYKCK

SEQ ID NO: 12235 - protein, 81 aa, Peromyscus maniculatus
DVERLTFEDVSIDFSPGERECLDPARWNLYRDVMLENYRNLVFLGLAVCKPDLVTFLEQRKEPWNVERQESVTICPENLYK

SEQ ID NO: 12236 - protein, 81 aa, Peromyscus maniculatus
MESVNFEDVAVRFTKEEWALLDPSQKKLYKDVMQETLRNLAAIGNKLENQKVVNEYENLCRKLSSQLVEIFCEYKESLQCT

SEQ ID NO: 12237 - protein, 81 aa, Peromyscus maniculatus
MGELENHDMEEWALLDLSQKNIYKDVMLETYINLTAIGYRWEDLNIEEHCQSPRRHGRYERSHTGEKPYECNQCDKGFSPH

SEQ ID NO: 12238 - protein, 81 aa, Peromyscus maniculatus
MEEMLSFRDVAIDFSAEEWECLDLAQWNLYRDVMLENYSNLVFLGLASCKPYLVTFLEQRQGPSDVKRQAAAPVHPGGTPY

SEQ ID NO: 12239 - protein, 81 aa, Peromyscus maniculatus
VSFEDVAVHFTQEEWALLDPSQKSLYRDVMQETCRNLAAIGYIWEEQNIEDDCKNFGRYQRHIISHSEYTPYEHEEYGNKP

SEQ ID NO: 12240 - protein, 81 aa, Peromyscus maniculatus
MVTFRDVAVDFSQEEWDCLNSSQRHLYSHVMLENYRILVSLGLCFSKPSVIILLEQGKEPWPAKTELTDSLSTDWESMYVT

SEQ ID NO: 12241 - protein, 81 aa, Peromyscus maniculatus
PKVPMTFDDVAVYFSELEWAKLEDWQKELYKHVMRNNYESLVSLDSAISKPDILIRIERGEEPCPADPWGQTGSEEEAACP

SEQ ID NO: 12242 - protein, 81 aa, Peromyscus maniculatus
DMNAVTYDDVHVNFTWEEWALLDPSQKNLYKDVMLETYRNLTSIGYSWEDHNIEEHCQSSRRRKRHERSQIGKKTSVNTQW

SEQ ID NO: 12243 - protein, 81 aa, Peromyscus maniculatus
NAVTYNDVHVDFTQEEWALMDPSQRNLYKDVMVETYMNLTAIGYNWEDLEVEEHCQNSLKHGRHKRPHTTEKSCEYMGCGK

SEQ ID NO: 12244 - protein, 81 aa, Peromyscus maniculatus
LKDAVTYNDVHVNFTQEEWALLDPSQKNLYRDVMLETYMNLTDIGYNWEDHKVEEHCQSYQRYGRHERSHTGEQTSEYTEC

SEQ ID NO: 12245 - protein, 81 aa, Peromyscus maniculatus
IQNTVTYDDVHIDFTWEEWTLLDPSQRNLYKDVMVETYTNLTAVGYSWEDHNMEEHCQSSQRQRRYKRSNTGEKPCEYTQC

SEQ ID NO: 12246 - protein, 81 aa, Peromyscus maniculatus
TENAVTYDDVHVGFTWEEWALLDPSQKNLYKDVMLDTYRNLTTIGYSWEGHNIEEHFQSSRRHERHKRSDTGENSSVYTQC

SEQ ID NO: 12247 - protein, 81 aa, Mesocricetus auratus
FQSEVVFRDVTVDFSQEEWECLNSSERDLYKDVMLENYSHLVALAGCSISKPDVITLLEQGKEPWMIVRDEKRRWSQELEP

SEQ ID NO: 12248 - protein, 81 aa, Mesocricetus auratus
MEKLLSFGDVAIDFSAEERECLDLAQWNLYREVMLENYSHLVFLGLAVSKPHLITLLEQRQEPWSVKRRVGAHPGSKSLLV

SEQ ID NO: 12249 - protein, 81 aa, Mesocricetus auratus
MEEMLSFRDVAIDFSAEEWECLGPAQWNLYRDVMLENYSNLVFLGLAFSKPYLVTFLEQRQEPTDVKRQDAATMHPDIKPY

SEQ ID NO: 12250 - protein, 81 aa, Mesocricetus auratus
METVTFEDVAVDFTLEEWALLDSSQKKLYRDVMKETFFNLISIEKTLEERIEEDYKNLNRNTGSPVLEEDCGYECDTECDK

SEQ ID NO: 12251 - protein, 81 aa, Mesocricetus auratus
VSFEDLAVNFTQEEWDLLDSSQRSLYGDVMLETCRNLTAIGYEWDDQAVGEHYEEPEINLRHIVSHSECTQYENEEYEQKP

SEQ ID NO: 12252 - protein, 81 aa, Mesocricetus auratus
MEPVTFDDVAVDFTVGEWALLDPTQKKLYSTVMEETFLNLISIEEALGENIEEDYKELSRNMGAQVIEKACEYKCASRCDT

SEQ ID NO: 12253 - protein, 81 aa, Mesocricetus auratus
HKKSMVFSDVSLDFSQEEWECLGPAQRDLYRDVMLENYSNLLSVGLHIPKPQVISLLEQGKEPWMIGKELTRGLCSALESM

SEQ ID NO: 12254 - protein, 81 aa, Ictidomys tridecemlineatus
MSKISFSKPDVISLLEQGKEPWIVKKEGTRVTCPDWEYVFKNSDFSSKQDVYQESAKAVTLGRSHLSHSLVCPSWKPCVSE

SEQ ID NO: 12255 - protein, 81 aa, Ictidomys tridecemlineatus
FQESVTFKDVVVDFTQEEWKQLDPIQRDLFRDVTLENYTHLVSIGLQVSKPDVISQLEQGTEPWTVEPLWETRPEDSVPRP

SEQ ID NO: 12256 - protein, 81 aa, Ictidomys tridecemlineatus
MDFTREEWQQLDPAQRHLYKDVMLEIYSHLFSVEEFGLDILQQEVSEKASFQNDMVSETTRGGSWCSILEELWRDADLTKR

SEQ ID NO: 12257 - protein, 81 aa, Ictidomys tridecemlineatus
MDLAVRFSEEEWRLLEEQQREFYRDVMRENYETLVSVGTDELLPLSAFLSPTEPGAAMGGGSRGDKGQEPPVKGSPQGRQP

SEQ ID NO: 12258 - protein, 81 aa, Marmota monax
SKDLVTFGDVSVSFTQEEWEWLNPTQRTLYRKVMLENYRSLVSLGISFSKPDVISLLEQGKEPWIVKKEGTRGTCPDWEYL

SEQ ID NO: 12259 - protein, 81 aa, Heterocephalus glaber
MLETFQNLVSLGYQVSIPHLISQWEQEEDLLKVKGGLIQGICMKEHQEGFETQLNTNELVAFQDIDGEKTSREQKIRVKRT

SEQ ID NO: 12260 - protein, 81 aa, Mus musculus
MGLISFEDVAVDFTWEEWQDLDAAQRTLYRDVMLETYISLVSLGHCMNKPELIFKLEQGLGPWSVAEASDRNLSDFHILTA

SEQ ID NO: 12261 - protein, 81 aa, Rattus norvegicus
EMVTFRDVAVVFSEEELGLLDAAQRKLYGEVMLENFRMLLSVEYQLFKQEKPQLEREEKPREQGSGMNNQSERGAVQGGRS

SEQ ID NO: 12262 - protein, 81 aa, Rattus norvegicus
FLESVTFKDVVVNFTQEEWKHLDPTQRDLFRDVTLENYTHLVSIGLQVSKPDMISHLEQGTEPWIEESCIPVGSLEGFRLI

SEQ ID NO: 12263 - protein, 81 aa, Mus musculus
PQDLLTFNDVALNFSLEEWECLNFAQRTLYMEVMLENYNNVLFVENQCICGKNESFLDQDIQHIVNEHGHIRKKSSKCNEL

SEQ ID NO: 12264 - protein, 81 aa, Mus musculus
EQLTFRDVAVDFSPDEWECLDPPQQRLYRDVMVENYRNLVSVALSHHCTQNFSPEQILKYSFTEVTNGSYSLQHLYLREDC

SEQ ID NO: 12265 - protein, 81 aa, Mus musculus
NMDLLTYDDVHVNFTQEEWALLDASQKSLYKGVMVETYRNLTAIGYSWEEHTIEDHFQTSRSLGRHERRSSAEQHSEFIPC

SEQ ID NO: 12266 - protein, 81 aa, Cavia porcellus
GWVPALFDEVAIYFSDEEWEVLTEQQKALYREVMRMNYETVLSLEFPFPKPDMISRLEQEEESPNSDKWQLQRGTSAAPRT

SEQ ID NO: 12267 - protein, 81 aa, Cricetulus griseus
MVVNFTSGEWALLDSSQKKLYRDVMKETFLNLISIEEAIEENIGENCKDLSRNTRSQAIDKYYICTCDHECNKNGKSITEN

SEQ ID NO: 12268 - protein, 81 aa, Cricetulus griseus
ASIQGTSDVAMDFSLEEVEYLDPAQRALYKTLMIENYSSLISVENYCMCAIVHQHVESEEKYSKCNELGKMLHESTRCTVY

SEQ ID NO: 12269 - protein, 81 aa, Ictidomys tridecemlineatus
RVVFEDVAIYFSQEEWGHLDEAQRFLYCEVMLENLTLLSSLGCWNGAEAEKAAPEQGVSVGAPQVRTPKPGSSTQNAQPSE

SEQ ID NO: 12270 - protein, 81 aa, Ictidomys tridecemlineatus
EPGAVSFADVAVYFSPEEWGCLRPAQRVLYRDVMRETYGHLGALGFPGPKPALISWMEQESEAWSSAAQDPEEGESLGGAL

SEQ ID NO: 12271 - protein, 81 aa, Ictidomys tridecemlineatus
MLENYSSLLFLGYQIIKPDAVFKLDQEESWTVYEETLHQNVSEIWLDSDSKICHQDNQDKLKSMEKGHGCDVLGKIFNSSM

SEQ ID NO: 12272 - protein, 81 aa, Marmota monax
MLENYSNLVSVGYPVSKPDALSKLEQGEEPWTEDEMHTWICPENDKVDHLQGHSENQRMLKIIKKYELQNKSHFPFKENHN

SEQ ID NO: 12273 - protein, 81 aa, Marmota monax
LQGMVSFEDVSVDFTWEEWQDLDDAQRTLYRDVMLETYSSLVFLGLFITRPEVIFKLEQGTEPWLVKEALDRCLPDVQIVD

SEQ ID NO: 12274 - protein, 81 aa, Marmota monax
MLENYNNLITVGYPFTKPEVIFKLEQEEEPWVVEEEVFRRHCSGEIWGTDEHQKTQDRLLRQVFKNTLTEEKVKEYPKKFA

SEQ ID NO: 12275 - protein, 81 aa, Marmota monax
AHKLVKFSDVSVVFSQREWKCLNPTQRELYRDVMLENYSNLVSLGYSASKPEVITLLEQGKEPFIVIGDVQGRRCAGLFSR

SEQ ID NO: 12276 - protein, 81 aa, Marmota monax
MLENYSNLVSVGYHIIKPDVIIKLEQGEEPWIVEGEFPPQSYPDEVWQVEDPMEKLQEDEDMFFINKTLGEERGNVSGKAF

SEQ ID NO: 12277 - protein, 81 aa, Heterocephalus glaber
MLTFRDVAIDFSVEEWEFLEPAQQNLYRDVMIENYRNLLSLGLAVTKPYLITFLEQSKELWDVKSQGTAAIHPAMSSHHTE

SEQ ID NO: 12278 - protein, 81 aa, Heterocephalus glaber
SQGSVSFTDVTVGFTQEEWQHLDTSQKSLYRDVMLENYNHLVSVGYCVTKPELIFRLEQGEEPWILEEEFSRQSFSEFWKT

SEQ ID NO: 12279 - protein, 81 aa, Heterocephalus glaber
WQGCVTFDDVAIYFTWEEWRLLDEAQRLLYFNVMLQNFALTSSLGCGHGTQDEEAPSEQIGSVGVSQAQTCKTGPSIKKTY

SEQ ID NO: 12280 - protein, 81 aa, Mus caroli
MEEILSFRDVAIDFSAEEWECLEPAQWNLYRDVMLENYSHLVFLGLAFSKPYLVTFLEQRQDPLDEKKQVATTMHPDIKPY

SEQ ID NO: 12281 - protein, 81 aa, Neotoma lepida
PLTFKDVAISFSKEEWKCLDTSQRDLYREVMLENYSNLVSVAMFCYPIHEFFPKKHTQSICQTEIPGQCGCNSFGELHIRK

SEQ ID NO: 12282 - protein, 81 aa, Mus musculus
QEAVTFRDVAVVFSEEEMGLLDAAQRKLYHDVMLENFLNLLAVGSQSPNKVDTLDLTGLRHLSLGWLPCWHMTGHDVKKLA

SEQ ID NO: 12283 - protein, 81 aa, Mus musculus
VMESVSFEDIAVFFTWEEWQDLDIAQKLLYRDVMLENYSSLVSLGCCVIKPELILMLEREFGPWRVADTSVWNLPGYCMTR

SEQ ID NO: 12284 - protein, 81 aa, Mus musculus
SQGLLAFNDVAVEFSQEEWGCLDSAQRSLYINVMLENYNNLVSVENYCIRDTVDQHVNTEKESCQYNELGKILHEHFKCAL

SEQ ID NO: 12285 - protein, 81 aa, Mus musculus
MLSFRDVAIDFSAEEWECLEPAQWHLYRDVMLENYSHLVFLELADSKPQLVTFLEQRQQSTGVKRQEVLQTPGNCGEGIRS

SEQ ID NO: 12286 - protein, 81 aa, Mus musculus
VTFEDVAVNFTLGEWALLDSYQKELYRDVMKETFSNLISIGKSEEDNIEDYQNIRRNLSTLMVEGFYEFERGIQYREMHQQ

SEQ ID NO: 12287 - protein, 81 aa, Mus musculus
MGVVTYDDVHVNFTQEEWALLDSSQKNLYRDVMLETYRNLAAIGYSWEDHNPEEHFQSSRRHGRHEKSHIEKKPSEFTQCG

SEQ ID NO: 12288 - protein, 81 aa, Mus musculus
PCERLVSFEDVTVNFSQEEWQHLDSAQRRLYQDVLLEIYSHLLVVGYSRPEVILKMKKVKDSPMGKVDFPHQRCGQGEAEH

SEQ ID NO: 12289 - protein, 81 aa, Dipodomys ordii
PQAKVTFEDVAVLLSQEEWNQLGPAQRGLYRNVMMETYGNVVSLGLPGSKPSVISQLERGEDPWVLDGPGAEESQGLGQSL

SEQ ID NO: 12290 - protein, 81 aa, Fukomys damarensis
MEEWALLNPSQKKLYRDVMGETFRNMATIERTWDNQEAEEDYRNYWRNLRNEEVEKCYQYKAWNQYKETFLCTPVANVHGK

SEQ ID NO: 12291 - protein, 81 aa, Rattus norvegicus
EWEQLEPGQRNVYKDTKLENCSNPASMGNQDPKQDLVSKLDGEEERWSSVRANKNSSSSLHRLKKTGTSAKVQQDGAQTEG

SEQ ID NO: 12292 - protein, 81 aa, Mus musculus
VRSQEAMTFKDVAMDFTPEEWGKLDPAHRAVMLENYRNLVSLWLPISKPDNYNSEDGKELSKLEKSPKCSDSDMETRPESK

SEQ ID NO: 12293 - protein, 81 aa, Mus musculus
MGRVTYDDVHVNFTWEEWALLDPSQKNLYRDVMLETYRNLAAIGYVWEDHNMEEHLHISRRYGRHERSHTEQLLSEFIQCD

SEQ ID NO: 12294 - protein, 81 aa, Mus musculus
MLSFRDVAVDFSAEEWECLEPAQWHLYRDVMLENYSHLVFLGLADSKPQLVTFLEQRQGSTGEERQAVKAVFPGITPNDPN

SEQ ID NO: 12295 - protein, 81 aa, Cricetulus griseus
ITGAVTFGDVAVDFSEEEWACLDAAQRAFYRDLMLETYSNLVTVVGSSISKPHLITLLEQEREPWMVVKEETDRPSPDLES

SEQ ID NO: 12296 - protein, 81 aa, Cricetulus griseus
EGQLTFRDVAIEFSQEEWECLDPAQRALHRDVMLENYSNLVSLGKDDFLRELRYLWCNFAVFLPGFVEPCGLSSFLPSSVP

SEQ ID NO: 12297 - protein, 81 aa, Cricetulus griseus
FQESVTFKDVSVNFTWEEWMQLDSVQRNLCGRVMLETYRNLVSLGHQLSKSNVISELEQGLSLREKELPGCISLVDLYYPL

SEQ ID NO: 12298 - protein, 81 aa, Cricetulus griseus
SLQTFEDVAINFSKEEWKCLNTSQRDLYRGFLWGNYSNLVSIGHSEYKPELVTCLEQNKEPWKVNIEEAERLEPDKVKGNN

SEQ ID NO: 12299 - protein, 81 aa, Marmota monax
EPLTFGDVAIDFSEEEWECLDPAQQNLYREVILETYSNLVFVAMTSHHPQEILPEQGIKEREGRYGKSDLDYLQLRKQWEN

SEQ ID NO: 12300 - protein, 81 aa, Marmota monax
GSVSFTDVTVDFTQEEWEQLDPSQRILYMDVMLENYSNLLSVEVWKADDQMERDHRNPDEQVKQFIILKNQTPVEERDNLF

SEQ ID NO: 12301 - protein, 81 aa, Marmota monax
MDFTPEEWGKLDPKQRDMMLENYRNLVSLWLPVSKPENYNLDSGEEPLKLERKTPKCSYSDVETLPESKDSSSVQDFSKDE

SEQ ID NO: 12302 - protein, 81 aa, Marmota monax
SQESLTFRDVFVDFTLEEWQQLDPAQKNLYRDVMLENYSHLVSLGYLLAQPDVLFRLGQGEEAWRADGRTPIQSCPEVWQV

SEQ ID NO: 12303 - protein, 81 aa, Marmota monax
FQESVTFRDVAIAFSQQEWQSLDSSQRDLYRDVMLENYRNLVSLGHSLSKPHVITLLEQWKDPWETGRKDKRRRCADLQLE

SEQ ID NO: 12304 - protein, 81 aa, Marmota monax
SQEQVSFKDVCVDFTKEEWSLLDPAQKILYRDVILENYSNLVSVGYCVTKPEVIFKIEQGEEPWILEKEFPSQCHSERKWK

SEQ ID NO: 12305 - protein, 81 aa, Heterocephalus glaber
MYRDVMLETYRNLVSLGFAGSTPNLITFLEQSKEPCNVKRQETLAVYPAVSSHFAQGISSKQGRKCSFQNMTEERHSICGH

SEQ ID NO: 12306 - protein, 81 aa, Heterocephalus glaber
QESVTFEDVAVIFTDEEWRHLVPVQRALYQAVMLENYESIVSLGLPVPPPDVIFWLKRGDEPWREGPQGSEERECPQSISL

SEQ ID NO: 12307 - protein, 81 aa, Mus musculus
PQGLLTFKDVALDFSLEEWECLSFAQRTLYMDVMLENYNNLLFVENYCIRGKNGKVLDQDSQYIVHEHMNIQEKSSKWDKL

SEQ ID NO: 12308 - protein, 81 aa, Mus musculus
MNLVTYDDVHMNFTQEEGALLETSQKNLYKDVMLETYRNLSAIGYIWEEHTIENHFQTSRSHGRHERSCIAVQPSEFIQCG

SEQ ID NO: 12309 - protein, 81 aa, Mus musculus
SEGLVSFEDVSVDFTWDEWQDLDDSQRKLYRDVMLETYSSLLSLNQCDAKPELILKLEKEAEPWKEDDAPDQSLPDMQNVD

SEQ ID NO: 12310 - protein, 81 aa, Mus musculus
MDAVTFMDVHVNFSQEEWALLDPSQKSLYKDVMLETYWNLTCIGYDWEDNNSEECCQSSRRHGRYFNSSQYSTYKAKGYGK

SEQ ID NO: 12311 - protein, 81 aa, Fukomys damarensis
MAFRDVAVDFSQEEWSLLSPAQRSLYREVMLETYSHLESLGIPFSKPKLITQLEQGKEMWREERKCPLVTCPEPKLELQPG

SEQ ID NO: 12312 - protein, 81 aa, Rattus norvegicus
HKKQVAFSDVSLDFSQEEWACLGPAQRALYKDVMLENYSHLLSVGLHIPKPQVISLLEQGKEPWMVGKELTRGLCSALESM

SEQ ID NO: 12313 - protein, 81 aa, Rattus norvegicus
FQEMLSFRDVAIDFSAEEWECLDLAQWKLYRDVMLENYNNLVFLGLASCKPYLVTFLEQIQEPSDVKGRATTTMHPGGKCC

SEQ ID NO: 12314 - protein, 81 aa, Rattus norvegicus
ACGSVTFRDVAVDFSQEEWACLDATQKVLYRDAMLETYSHLVTVVGSCLSKPHLITLLEQEKEPWMAVKEETDRPSPELET

SEQ ID NO: 12315 - protein, 81 aa, Ictidomys tridecemlineatus
HFRIPEIVPSFLPSVQSIQFLPDFHLIGYPVSKPDVISKLEQGEDPWIIKREIPNWIYPDGNHAHERQERKSNLHNSQSYI

SEQ ID NO: 12316 - protein, 81 aa, Ictidomys tridecemlineatus
FEGSVSFEDVAVDFTRQEWHRLDPAQRTMHKDVMLETYSNLASVGLCVAKPEMIFKLERGEELWILEEESSDHGYSGSLSL

SEQ ID NO: 12317 - protein, 81 aa, Marmota monax
MEEVVLVTITFLLFFLNFNYFLLGGLPFIKPKVISLLQEGEDPWKVEKENPGGTSLAWKSHHKTTKSTQTQDSSFQRLIMN

SEQ ID NO: 12318 - protein, 81 aa, Marmota monax
GAVSFADVAVYFSPEEWGCLRPAQRVLYRDVMRETYGHLGALGDIPNKEKLEPKEGPTARRRGMTPGKEQHEEFVKHNPDS

SEQ ID NO: 12319 - protein, 81 aa, Marmota monax
EPQEAMTFKDVEVTFSLDEWGWLDSAQRNLYRDVMLENYGNMASLVGPFSKPALISWLEAREPWGLNIQAAKPKRDPGASP

SEQ ID NO: 12320 - protein, 81 aa, Marmota monax
EPLTLRDVVIDFSEEEWKCLDPSQQTLYGDVMLEIYRNLLFIGLTSNQNQEFSEEQEIKYFLQNLIKSRKHPCDHLKVLYN

SEQ ID NO: 12321 - protein, 81 aa, Marmota monax
MFEDVAVHFSWEEWGLLNATQRGLYRDVMLENFALVSSLGCLCRMKDEDAPPKQVKSCRVDLSEKPFVYERFVKDGPVTTG

SEQ ID NO: 12322 - protein, 81 aa, Heterocephalus glaber
QELVTVKDVSVDFTWKEWMQLDPAQRNLCGKVMLENYRNLISLGHQLSKPNVMSQLEQELGLRNKDLQGYVFPDWETRLED

SEQ ID NO: 12323 - protein, 81 aa, Heterocephalus glaber
VTFEDVTVTFTMEEWALLNPSQKKLYRDVMQETFRNMATVGGNWEKQKNEEEQIHCQTHEEGHQGEKPYVFKKCGKALSTN

SEQ ID NO: 12324 - protein, 81 aa, Mus caroli
FQEMLSFRDVAIDFSAEEWECLEPAQWDLYRDVMLENYSNLVFLGLASSKPYLVTCLEQIQEPSDVKRGAATSMLPAGEKC

SEQ ID NO: 12325 - protein, 81 aa, Mus caroli
MLSFRDVVIYFSEEEWECLEPAQWNLYRDVMLENYSNLVFLGLASSKPYLVTCLEQIQEISGGKCYKCKECGKVFVWTKVF

SEQ ID NO: 12326 - protein, 81 aa, Mus caroli
SKHLLTFRDVAVDFSQKEWERLDSSQRTLYIDVMVENYTNLVFVEKYSVRDTVHQHVRTEKESRQCNELGEMLHEPSNCAL

SEQ ID NO: 12327 - protein, 81 aa, Mus caroli
SKNLLTFEDVSVNFTQEEWQWLSDTQRNLYRKVTLENYRSLVSLGIPVYKPAVISLLEQGKDPWMVQKKGARDTCPDWEYV

SEQ ID NO: 12328 - protein, 81 aa, Mus caroli
SQELVTFEDVAVYFIWKEWKRLEPAQRDLYRDVMLENYGNVFSLDGDSKTGNDRVISEGMGSCEMILGRFQKDVSQGLKFE

SEQ ID NO: 12329 - protein, 81 aa, Mus caroli
AQGGMAFSDVAIYFLREEWRLLDDSQRHLYHQVMMEVFVLMSSSGLIPSGTDITQLGSSGDRFIPALRFLTPRVELAKISC

SEQ ID NO: 12330 - protein, 81 aa, Mus caroli
AKGLLTFKDVAIEFSQEEWECLDSAQRMLYRDVMLEIYSILVSVGLSVSKLELLTCFEQNEEPSITGIKELKGIEPVLSCF

SEQ ID NO: 12331 - protein, 81 aa, Neotoma lepida
YQVSKPDAIFKLEQGEEPWISETEIQRPFCPDWKTRPDTKSSSLQQGKSEVSHSTNNLSHATLGDIWNVSIQRHQESWRTH

SEQ ID NO: 12332 - protein, 81 aa, Mus musculus
LQESVSFEDVSVDFTQEEWNQLDPIQRSLYRDVMLENYSHLVSLGYPITKPEVIASLEKGVLGIIKREIPSSSCTEDGQAE

SEQ ID NO: 12333 - protein, 81 aa, Mus musculus
FVSVGHCVTKPDVIFKIEQGEDPWIPENGFQCHPERKWKVDDLLESNQENQDGHFWPLMFTNKITNLEGGGNTRETPSPDI

SEQ ID NO: 12334 - protein, 81 aa, Mus musculus
YRDVMFENYQNLATVGYQLIKPSLISWLEQEEFSKGQKIVFPEWKLQLETKCSAFQQEFLRGNISSRMQMQTGINRGRELC

SEQ ID NO: 12335 - protein, 81 aa, Mus musculus
YRDVMFENYNNLITVGPPLTKPEVISKLEQEEEPCVVEREVLWRPCPGEILGIDEHQKIQDGQVFEGIVVTSEASECPEEF

SEQ ID NO: 12336 - protein, 81 aa, Dipodomys ordii
ACVTFEDVVIYFSQEEWEFLNTTQRLLYLNVMLETFALVTSLGCEYGIEDEDTSVQSVSLKGMSHLRIPKAGTPSQDTHPC

SEQ ID NO: 12337 - protein, 81 aa, Dipodomys ordii
SLGLVSFEDVSVHFSWEEWKDLDDIQKTLYRDVMLETYSNVVSLGYCIPKPEVIVNLEQGAEPWPREALDKNITDVQQVDG

SEQ ID NO: 12338 - protein, 81 aa, Dipodomys ordii
KPGAVSFADVAVYFSPEEWGCLRPAQRALYRDVMRETYGHLGALGLPGPKPALISWMEGESEAWNPAAQDPEEGENLGGAL

SEQ ID NO: 12339 - protein, 81 aa, Octodon degus
SHAMEEMTFEDVAVNFTMEEWALLDPSQKKLYRDVMRETFRNMAAVGRAQDNQEVEEDKNDWRNRRKEELEKGYPLNMPTI

SEQ ID NO: 12340 - protein, 81 aa, Octodon degus
SRALENDGVCFSEQEWENLADWQKELYRNVMQSNYEALVSLKVLGQPEGEVELGAEMLGDLEEDEEGLAGAHPVDGPVLRA

SEQ ID NO: 12341 - protein, 81 aa, Octodon degus
WMEAVTLKDVTMAFTQKEWKKMDPAQRDLYKDVMLENYSNLAIVAGYQSSKPDMICKLEKGEEPWSRKGKRSNQSHLRKLA

SEQ ID NO: 12342 - protein, 81 aa, Octodon degus
AVTFEDVAVNFTLEEWALLNPSQKKLYRHVMRETFRNMAAIGRVLDNQKVEEEYKNCWRNLRNKVEKCYQDKGWNQYAEIF

SEQ ID NO: 12343 - protein, 81 aa, Octodon degus
EAVTMEDVLVNFTMEEWAVLNPSQKKLYREVMWETFMNVTAVGRSFRKQQIEEYKNCSRNLRREELVKFSQNKAWDQHGKI

SEQ ID NO: 12344 - protein, 81 aa, Octodon degus
VTEPVTFRDVAVLFSQDEWLQLGPDQRRLYREVMLENYSNLVSLGIPVSTPSVICQLQRGEDPCTAEREGPADTCTDFNTW

SEQ ID NO: 12345 - protein, 81 aa, Octodon degus
CHQDLVTFEDVTVDFTQEEWALLDRGHRDLYREVMLENYENLASVGCELVKPSLIWLEHEEDWRTQQRGDRQEWEMQLSTR

SEQ ID NO: 12346 - protein, 81 aa, Octodon degus
DSFLPQEIIIKVEGEDGGLLATPSKEGINFKIVTVDFTHEDHGTWNPALRTPDRGVTLENHTDLISCSKCIIPHSEESTQS

SEQ ID NO: 12347 - protein, 81 aa, Octodon degus
FQELVTFKDVSVDFTWEEWMQLDPAQRNLYGKVMLENYRILVSLGHQLSKPNVIAQLEQELSLRNKELPGCTSSGLETRFE

SEQ ID NO: 12348 - protein, 81 aa, Fukomys damarensis
RPRALKFADVAVYFSPEEWGCLRPAQRTLYRDVMRETYGLLGALGCAGPKPALISWLERNTDDWEPAALDPQEYPRRVTVQ

SEQ ID NO: 12349 - protein, 81 aa, Fukomys damarensis
EPWAITFADVAVYFSPEEWGCLQPTQRALYRDVMRDTYVLLSALGGGGGAKPALISWVERESELWDSDAQDPEVPKWPTEA

SEQ ID NO: 12350 - protein, 81 aa, Fukomys damarensis
ARGLMAFEDVAVYFSREEWVLLDTGQRALYRHVMLENFALVASLGFFSSPPRVIIQLQRGEEPWVPSGKDSILGRNAYRTL

SEQ ID NO: 12351 - protein, 81 aa, Fukomys damarensis
LTCDSPEQCGRAVTHSNGLVQLDITFEDVAIYFSREEWELLDEAQRLLYCDVMLNNFALVLSLGSFPYSYLSEESESQALS

SEQ ID NO: 12352 - protein, 81 aa, Rattus norvegicus
PVTLEDVAVDFTLEEWTMLNLWQKQLYKEVMQDTLRNLCYIGNKQEHQNIENEYENLWKKLSSQLLEKLCEYTEGHQCAEI

SEQ ID NO: 12353 - protein, 81 aa, Ictidomys tridecemlineatus
VMFSDVSIDFSQEEWECLTDDQRHLYRDVMLENYSNLVSMVLESTCEIKKLFLKKEIYEIESAQWEIMGRLTRHDLQCSSL

SEQ ID NO: 12354 - protein, 81 aa, Marmota monax
PQELLTFKDIFVDFTQEEWGHLAPTHRNLYRDVMLENYRNLVSVGYQFSKPSVISQLEKGEEPWIIQKEGPRNDVSDSKSK

SEQ ID NO: 12355 - protein, 81 aa, Marmota monax
QLDSVTFEDVAVDFTQEEWTSLDPTQRNLYKDVMLENFQNLSTVGRQLLKPSLISWLEEEVQLTIVERGILQEWEMHLQTK

SEQ ID NO: 12356 - protein, 81 aa, Marmota monax
TMELMSIEDVSISFTQEVWAMLDQSQKMLHQSVMLEIINHLVSVGYLLCKSDVTLYLEEGKILWMGEGTGFLPSQSPGMEN

SEQ ID NO: 12357 - protein, 81 aa, Marmota monax
AQGLVTFRDVIIEFSQEEWKCLEPAQRDLYRDVTLENFSHFVSLGLSISKPDVISLLEQGKEPWILANDMTGPWYPDLKSR

SEQ ID NO: 12358 - protein, 81 aa, Marmota monax
GSVTFKDVTMAFTQKEWKQLEPAQKNLYKDVMLENYSNLASMAGYQAPKPDMISKLEKGEEPWLGKGKKPSQNRLNKKARS

SEQ ID NO: 12359 - protein, 81 aa, Marmota monax
QSQESLTLEDVTVKFTWEEWQLLAPAQKDLYWDVMLENCRNLVSVGCQASKPDALSKLLGGEPRTVEDAIHEANSPEIWEI

SEQ ID NO: 12360 - protein, 81 aa, Marmota monax
AQESVMFSDVSIDFSQEEWECLTDDQRHLYRDVMLENYSNLVSMGHSISKPNVISYLEQGKEPWLVDRGRTRGQWPVLEST

SEQ ID NO: 12361 - protein, 81 aa, Heterocephalus glaber
LQDLVTFEDVAVDFTQEEWALLDTSQRSLYREVMLENCRNLASLGCHVGKPSLISQLEQEDKVIIEERRNLPRTCPDLETV

SEQ ID NO: 12362 - protein, 81 aa, Heterocephalus glaber
FESEPCDNFRCLSPLQNHEKILFGEKQHEYKQCGTLFRSHSYVGLAVSKPHLITCLEQSEEPWNVETQGTAATHPGVKSHS

SEQ ID NO: 12363 - protein, 81 aa, Mus musculus
VSFEDVAVNFTAEEWALLNSSQKRLHRDVMQETFRNLAAIAKKQEDWILEDGSKNLRKIPPISVQTDYKLCESQECTEKPG

SEQ ID NO: 12364 - protein, 81 aa, Mus musculus
MEAVTFGDVAVHFSREEWQCLDSGQRALYKEVMLENHSSVAGLAGFLVFKPELISRLEQGQEPWVLDLQGADGTEAPRICQ

SEQ ID NO: 12365 - protein, 81 aa, Mus musculus
PQAKVTFEDVAVLLSQEEWARLGPAQRGLYRHVMMETYGNVVSLGLPGSKPVVISQLERGEDPWVLDGQGNELSQSLGSDH

SEQ ID NO: 12366 - protein, 81 aa, Mus musculus
PQGQLTFKDVAVDFSQEEWECLDCAQRALYMDVMLENYNNLFFVENHCVCPKYENVLDQDTQHIFHKHVNIQKKSCKCNDR

SEQ ID NO: 12367 - protein, 81 aa, Mus musculus
GSLENDGVCFSEQEWENLEDWQKELYRNVMESNYETLVSLKVLGQPEEEVELGAEMVGDLVEEGTHLDRAMVKQEMLYKQE

SEQ ID NO: 12368 - protein, 81 aa, Mus musculus
MDALTYDDVYVNFTREEWALLNPSQKSLYKDVMLENYTNLIAVGNNWEDSNIEEHCESSRRHGRHERSLTGEKPSENTQCG

SEQ ID NO: 12369 - protein, 81 aa, Octodon degus
SRGMMAFEDVAVYFSQEEWALLDQGQRALYRQVMLENFALVASLGFFSSPPRVVIQLERGEEPWVPSGKDSILGRNAHRRL

SEQ ID NO: 12370 - protein, 81 aa, Octodon degus
PSGCLTFRDVAVEFSQEEWECLDPAQRTLYREVMLENYRTLVSLGIFLPNLSVISILEQGREPWTVENERRTARNSNRREC

SEQ ID NO: 12371 - protein, 81 aa, Octodon degus
TRLHLTFEDVAIYFSEQEWQDLEIWQKELYKGVMRTNYETLVSLDGALPKPELISWIEQGREPFRSWGPSQCPGNTVLSSA

SEQ ID NO: 12372 - protein, 81 aa, Octodon degus
PQESVTFKDVAVDFTREEWHHVDSAQRSLYRDVMLENYSHLVSLGYQVSKPEVIFKLEQGEEPWISEGEIPRPFCPDQKTR

SEQ ID NO: 12373 - protein, 81 aa, Octodon degus
VAFEDVAVIFTREEWVLLDPSQKKLYRDVMWETFRNVSAVERNCDEQKIEDECRCCRINLRGKKIEKWHVCELRYQYEEMV

SEQ ID NO: 12374 - protein, 81 aa, Fukomys damarensis
QDSVTFGDVAVDFSWEEWKLLDEMQRLLYRDVMLENFALVASLGLVSSQIHVLVQLKLEEDTKGADGAHLTVATGEPWRQA

SEQ ID NO: 12375 - protein, 81 aa, Fukomys damarensis
AVTFEDVAVNFTMEEWALLDPSQKKLHRDVMWENFTNVTAIGESLACEKPLIGHSLPTMPIIYNTGLKSYELHGFEQKVYN

SEQ ID NO: 12376 - protein, 81 aa, Rattus norvegicus
MATPEPAESDAEWEQLEPGQRNVYKDTKLETCSNPASMGNQDPKQGLVSKLDGEEERWSSVRANKNSSSSLHRLKKTGTSA

SEQ ID NO: 12377 - protein, 81 aa, Rattus norvegicus
AVTFRDVAVVFSKEEMGLLDAAQRKLYHDVMLENLRNLLAVGGQSPNKMKTVDATGVRCLLLGQLLYWEITGHDANKLARA

SEQ ID NO: 12378 - protein, 81 aa, Rattus norvegicus
SQGLLTFRDVAVNFSQEEWEYLNSAQRALYIDVMLENYSNLVSVENYCICETVLPTVKTEKDSCQGNELGEMLRGPSNCVL

SEQ ID NO: 12379 - protein, 81 aa, Marmota monax
MLENYRNLVSVEHQLSKPDVVSQLEVAEDFWPEERGILQDTFPECPKVPLGPQMKSLPAENPLMKIRVVEVLTLNQEMAGP

SEQ ID NO: 12380 - protein, 81 aa, Marmota monax
CSEPVAFEDLTLTFTPEEWGLLDLRQKSLYREVMLENYRNLVSVEHQLSKPDVVSQLEVAEDFWPEERGILQDTFPECPKV

SEQ ID NO: 12381 - protein, 81 aa, Marmota monax
MLENYSHLVSVGYCVTKPEVIFRLEQGEEPWISEAEFPSQSFPELWKADYLKEQSQEDLWKVVFISNKMLMKEQGNIIGRP

SEQ ID NO: 12382 - protein, 81 aa, Marmota monax
FQELVTFGDVAIDFSQQEWEYLDPLQRDLYRDVMLENYRNLVFLGHSTSKPDVVDLLEQGKEPWMFLKEETQRQYTDWGLQ

SEQ ID NO: 12383 - protein, 81 aa, Marmota monax
MIESQISFEDVAVDFTWEEWQLLNPTQRSLYRDVMLENYSSLLFLGYQIIKPDAVFKLDQEESWTVYEETLHRNVSEIWLD

SEQ ID NO: 12384 - protein, 81 aa, Marmota monax
MACGSPGHPFPGPLSDSTCETVIGLCFSKPNVILLLEQGKEPWMVKREFTNGLCSGWESMYETKELMPKQELYEEQSSQNI

SEQ ID NO: 12385 - protein, 81 aa, Marmota monax
MVENFKNLVAVGYLPFKVDMVSQLEAEEKLWMMETETQRSSYFGNTSQNEMETLQKFALKYLSHAELSCWQIWKQVASELT

SEQ ID NO: 12386 - protein, 81 aa, Marmota monax
SLEPVTFKDVAVDLTQEEWQQMKPAERNLYRDVMLENYSNLVIVGFQVTKPDVIFKLEQEEEPWVIEEEMFWRHSPEVWEV

SEQ ID NO: 12387 - protein, 81 aa, Heterocephalus glaber
ETVTFKDVAVDLTQEEWQQMKPVQRNLYRDVMLENYSNLVTVGCQVTKPDVIFKLEQEEEPWVMEEEMFWRHSPEPRRRRE

SEQ ID NO: 12388 - protein, 81 aa, Heterocephalus glaber
GTVIFEDVAVYFSWEEWDLLDETQRDLYHSVMLENLALVTSLGCLCEAEGEKTNSLLTVSAQRRPISPEKAYACEICGPVL

SEQ ID NO: 12389 - protein, 81 aa, Heterocephalus glaber
MLENYCNLIAAAGSTISKPEVIALLEQEKEPWIGVRKETSRQYPDLDSDYGAEKISPENYIYEINLSKQDIKQINTLGLKS

SEQ ID NO: 12390 - protein, 81 aa, Heterocephalus glaber
MLETYKNLVSLGAGSAGPKPGVILQLERGNEPWVLNTKEAEGRRHLRVSSSAHGTRTEHTELASEETFVGRELHQPRRTVH

SEQ ID NO: 12391 - protein, 81 aa, Heterocephalus glaber
SGTFEDVAVDGPQVEKPLMNPTRRSIHSDGMVKNYQNVATVGCQTPIKLSPMACLKEELLTGQKELLQDLEMQLQTKDSAI

SEQ ID NO: 12392 - protein, 81 aa, Mus caroli
MDAVTYDDVHVNFTWEEWALLAPSQKSLYKDVMLETYSNLTAIGCNWEEHNIEEYCQSSRRHGRAYSCASAIHSGEKLYEG

SEQ ID NO: 12393 - protein, 81 aa, Mus caroli
TESRISFEDVAVVFSWDQWQLLSPTQMSLYRDVILENCSSLVFFGNQTTKPDVTFKLDQQESQIMGEECLSQNFLEIWLDS

SEQ ID NO: 12394 - protein, 81 aa, Mus caroli
DELTYDDVHVNFTQEEWALLNPSQKSLYRDVMLETYRNLNAVGYNWEDRNIEDHYKSSRRHGSLQMHKIIHTGEKQYKYNQ

SEQ ID NO: 12395 - protein, 81 aa, Neotoma lepida
MTGPDLPKPAVISQLEQGAELWVAERGGTRACHPGWILGPENHTSLKEQDLTEKESFPITERDEFKRAISCHSMTEVDQKN

SEQ ID NO: 12396 - protein, 81 aa, Mus musculus
MEKLLSFRDVAIDFSAEERECLDSAQWNLYKEVMLENYSHLVFLGLAFSKPHLITFLERRPEPWNVKTQASVGTYPGSKPY

SEQ ID NO: 12397 - protein, 81 aa, Mus musculus
KPELVSFADVAVYFSPQEWGCLRPAQRTLYREVMRETYGLLGALGFPGPKPALISWMEQGSEAWSPAAQDPEEGESLGGAP

SEQ ID NO: 12398 - protein, 81 aa, Mus musculus
MDALTFDDVHIHFTREEWSLLDPSQKRLYQDVMLENYRNLTTIGYNWKDHNIEEHSQNDRRYGRHERSPSAEKPYEYTQWN

SEQ ID NO: 12399 - protein, 81 aa, Mus musculus
PQGLLTFKDVALDFSLEEWECLSFAQRTLYMDVMLENYNNLLFVENYCIRGKNGKVLDQDNQYIVHEHMNIREKSSKWDKL

SEQ ID NO: 12400 - protein, 81 aa, Dipodomys ordii
CQATVTFRDVAIDFTQEEWKQLDPAQRDLYRNVMLENYNNLITVGYPVAKPDVIFKLEQEEEPWVVEDEVLRRHCPGVIWN

SEQ ID NO: 12401 - protein, 81 aa, Dipodomys ordii
QVPISFKDLAVRFSEEEWRLLQEGEREFYRDVMRENYETLVSVGTAELLPLSAFLSPTEPGRAPGTENCAGQGQGPPARAG

SEQ ID NO: 12402 - protein, 81 aa, Dipodomys ordii
AVTQLTLEDVAVDFTRGEWRCLTPAQRALYRDVMLDTYRNLVSVGVSPPSVSVILPLELEEEPWVAQSHVTTPGELNGWKG

SEQ ID NO: 12403 - protein, 81 aa, Dipodomys ordii
LASISFEDLAVTFTEEEWEHLDLGQRNLYQEVMLETYQLLVSLGDQVRLAPPTPGTPLPALPAQPRLLGLPSQPLDRRGTP

SEQ ID NO: 12404 - protein, 81 aa, Fukomys damarensis
EMELLTFKDVAIDLSLEEWECLDPAQQNLYRDVTLENYRNLIFLGLAVSKPHLITLLEQRKEPWIVKTMSYHIQGFSSEQG

SEQ ID NO: 12405 - protein, 81 aa, Fukomys damarensis
QDLPVGTGNQYLCGLEQSSRGPRLVLTCRKVLCPLAQTLLCIYPRAGYQVSKPEVIFKLEQGEEPWISEGEIQRPFCPDWK

SEQ ID NO: 12406 - protein, 81 aa, Peromyscus maniculatus
RSKGLVSFKDVAVAFTQDEWQQLGSEEKTTYRDVMLENYSNLVSVEISKVQDTIEKIQENEDKHMRQADDLNSQRSEKGDA

SEQ ID NO: 12407 - protein, 81 aa, Peromyscus maniculatus
GLLTFGDVAVDFPQEEWECLDSAQRALYIDVMLENYNNLVSVENYCKCDPVHQHVKTEKESCQCNELVKVLHDPSTSAPHK

SEQ ID NO: 12408 - protein, 81 aa, Peromyscus maniculatus
HQDLLTFRDLDVDFSQEEWECLDSAWRTLYIDVMLENYRNLIFVEKHRMCGIYENIMDQGSNSTVYQHVNIQKKSYKNNDP

SEQ ID NO: 12409 - protein, 81 aa, Peromyscus maniculatus
MEKLLSFRDVAIEFSAEEREYLELAQWNLYRDVMLENYSNLVFLGLAFSKPYLVTFLEQRKEPWSVKRHAKVGAHAGSKSY

SEQ ID NO: 12410 - protein, 81 aa, Peromyscus maniculatus
LTLDDVAVVFSWEEWQLLSHAQKDLYWDVMLETCKSLVSMEIREVGDPLQHHLKDRTIHKSIEQCYKHRNFRNILNQSKDH

SEQ ID NO: 12411 - protein, 81 aa, Peromyscus maniculatus
DAVTYEDVHVNFTPEEWALLDPSQKSLYKDVMLETYWNLTIVGYKWEDHNIEEHCQSCRRNGRYIICHSRYKPCEHKGYGK

SEQ ID NO: 12412 - protein, 81 aa, Mesocricetus auratus
SQGLLTFRDVAVDFSQEEWECLDSAQRALCIDVMLENYNNLVFVENYCIYDPVHHHVKTEKESCQCDELDKVLHDPSTCVL

SEQ ID NO: 12413 - protein, 81 aa, Mesocricetus auratus
EEGCVSFEDVAVYFSWEEWKLLDDSQRLLYQTVMTDILAIMSSLGLVPSGIHGITQLGPWGEPSVPALRFLTPGCWIKVES

SEQ ID NO: 12414 - protein, 81 aa, Mesocricetus auratus
GEMPLTFQDVAVYFSRAEGQQLGPQERALYRDVMLENYGNVASLGFPVPKPELISQLEQEEELWVLDLLGAEEPDVLRSCQ

SEQ ID NO: 12415 - protein, 81 aa, Ictidomys tridecemlineatus
LTYIMEVVTFKDVAVVFTEEELRLLDSAQRKLYQDVMLENFRNVVSVGHQSITPERKREELWMKKVSTQSGNSPRNKNLSE

SEQ ID NO: 12416 - protein, 81 aa, Ictidomys tridecemlineatus
MKRHQGSIPRSLIFLSVTKPSFPGPAWILGLFFVPGICAQISVICLTGYPFTKPEVIFKLEQEEEPWVVEEEVFSRHCSGE

SEQ ID NO: 12417 - protein, 81 aa, Ictidomys tridecemlineatus
VPEPVTFEDVAVDFTQEEWGQLDLVQRTLYRDVMLETYGHLLSVGNQIAKPEVISLLEQGEEPWLVEQTCPESSCPEWMRD

SEQ ID NO: 12418 - protein, 81 aa, Ictidomys tridecemlineatus
FQETVTFGDVAVHFSREEWQCLDSGQKALYREVMLENHSSVAGLGFLVFKPELISRLEQGQEPWVIDLQGVEGTEAPWTSQ

SEQ ID NO: 12419 - protein, 81 aa, Heterocephalus glaber
IEDVADMAVSFILEEWEHLDQSQKSLYRDGRKENYGSITSLDYESKDNNMELTAKQISNEASSPNSHWVAVGSTERNISQS

SEQ ID NO: 12420 - protein, 81 aa, Heterocephalus glaber
EAVTLEAVAVNFTMEEWAVLNLSQKKLYRNVMWETLMNTTAIGRTWGKPQIEGECKNCSRSLRIYERFHMEEKTYVCKQCG

SEQ ID NO: 12421 - protein, 81 aa, Mus caroli
ARSQEAVTFKDVAMDFTPEEWGKLDPAHRAVMLENYRNLVSLWLPISKPDNYNSEDGKELSELEKSPKCSDSDMETRPESK

SEQ ID NO: 12422 - protein, 81 aa, Mus caroli
MTFEDVAVKFSMEEWALLNPSQKKLDKDGMQETLRNLTAIGFKMDTNHMNIRNLQSDCMNIRERTHASENLGVCKQHRKEF

SEQ ID NO: 12423 - protein, 81 aa, Neotoma lepida
MLLLSVSLSHVIIGLSVSRPRVIIQLQRGEEPWVPNRTNTGPGRSTHRRPRLGSNYNARDRHVSGDAALPGATCDGPDGTP

SEQ ID NO: 12424 - protein, 81 aa, Mus caroli
IQGPVLFEDVSVAFTQKEWQLLDDAQRHLYREVMLETYRHLGAVGHNVTKPELICKLEQGEGPWEPSSHSLSEVQRADTTT

SEQ ID NO: 12425 - protein, 81 aa, Neotoma lepida
LGAVSFADVAVYFSPEEWGCLRPAQRALYREVMRETYGLLGALDCRQEKMKRPRKETEATQKTLSTQAGPNEPHLSLAGPP

SEQ ID NO: 12426 - protein, 81 aa, Mus musculus
NAVTYEDVHVNFTREEWALLDPSQKSLYKDVMLETYRTLRAIGCYWEDHSNEENSQTSRRHGRHLQMEDRTHTGDKSYEGV

SEQ ID NO: 12427 - protein, 81 aa, Mus musculus
MGLVSFEDVAVDFTWQEWQELDAAQRTLNRDVMLENYSSLVSLGHCVTKPELILRLEHGFQPWSIGDTSVWRLPGVLEVYT

SEQ ID NO: 12428 - protein, 81 aa, Fukomys damarensis
VSFEDVFVSFTWEEWQVLDDAQRTLYREVMLETYSSLAVLGHCITKPEVIFKLEQGAEPWMGEEPPNLSPPDGQKMDDIIE

SEQ ID NO: 12429 - protein, 81 aa, Rattus norvegicus
SQVSVTFEDVAVLFTRDEWKKLDLSQRSLYREVMLENYSNLASMGFLFTKPKVISLLQQGEDPWQVEKEGPRYFSLGLKCS

SEQ ID NO: 12430 - protein, 81 aa, Rattus norvegicus
LQDAVTFKDVAIDFSQEEWEWLNPAQRSLYRNVVLENYRNLVSVGGESVQKTQELSLRQLAFDAVSVENIASLGCESPTSG

SEQ ID NO: 12431 - protein, 81 aa, Rattus norvegicus
FKGPVTLRDVTVEFTKAEWKLLTPAQKSLYKNVMLETYSHLVSVGYRVVKPSMISKLKKGKEPWPLGAEFLRRSCGDKRRT

SEQ ID NO: 12432 - protein, 81 aa, Peromyscus maniculatus
NAVTYDDVHVDFTWEEWALLDPSQKRLYKDVMLETYGNLTAIGYKWKDHHIEEHCESSRRHGRHERIHTREKPYGCNQCGK

SEQ ID NO: 12433 - protein, 81 aa, Peromyscus maniculatus
MLENFRTLLSVAHQPFKPDLIAQLEKEEKLCMEETQGGGYSGSEGGHAVHSAEDVEFNPLCPTELSSCQTCVLPGVQDSLR

SEQ ID NO: 12434 - protein, 81 aa, Peromyscus maniculatus
QDSVTFDDVAVEFTPDEWTLLDLTQRNLYREVMLENYENLTSVGCQFFIPSPTPWLKQEELETVESAVPQQLELQPRIDDT

SEQ ID NO: 12435 - protein, 81 aa, Peromyscus maniculatus
MEEWIMLDLSQKDLYKDVMKEILRNMVSIGNIRKHQKIENEYQNSERKRSCQLVEKLHDCKEGHKCAEIFNFSMEGTVNHK

SEQ ID NO: 12436 - protein, 81 aa, Mesocricetus auratus
KETVTFKDVAVAFTEEELKLLDSAQRKLYQEVMVENFRNLLSVGINHQSELRASQDGRSRDALSCWQIWQRVMDDLSRCQD

SEQ ID NO: 12437 - protein, 81 aa, Mesocricetus auratus
SEETVTFKDVAIDFTPDEWKQLDPVQRNLYRNVMLENYNNLITVGSPLAKPDVIFKLEQEEEPSIVEKEVLKRHSPGEIWE

SEQ ID NO: 12438 - protein, 81 aa, Mesocricetus auratus
MLETYSSLVFLKLCTAKPKLIFNLERGYGPWSPAEASVWSLPNVHKVSALIDTSKENPEIHLGQLEITNQKIPDEVMIEAK

SEQ ID NO: 12439 - protein, 81 aa, Mesocricetus auratus
FQEAVTFKDVALVFTREELRLLDLTQRKLYQDVMLETFKNLVTVGCFSRKADLVSLLEAEERLWLKETKAQRSHRNPGAKA

SEQ ID NO: 12440 - protein, 81 aa, Mesocricetus auratus
MEELLSFPDVAIDFSAEECECLDLAQWNLYKEVMLENYSNLVFLGLSFSKPYLVTFLEQSSEPWSVKRKSAAASHPGSKPH

SEQ ID NO: 12441 - protein, 81 aa, Mesocricetus auratus
VCQEVTFRDVAVYFCREEWECLSPGQRTLYRDVMLEIFRNFLELGYCGPRPDLISHLEQWDEPWVEDQDRPEFLEAGKGVC

SEQ ID NO: 12442 - protein, 81 aa, Mesocricetus auratus
LENYSNLVSLGIPFSKPTLITQLEESKETWPEERKCPQVACQAQAKLELSPGPVCHPDPINQKLPGQHVLSDHVPWVFTCL

SEQ ID NO: 12443 - protein, 81 aa, Mesocricetus auratus
MLEIFRNFLELGYCGPRPDLISHLEQWDEPWVEDQDRPEFLEAGKGVCPGGRKSIDHKRPHDLASAQERALPRTGAKRGAT

SEQ ID NO: 12444 - protein, 81 aa, Mesocricetus auratus
DMGLVSFEDVAVDFTWQEWQELDAAQRTLYRDVMLENYSSLVSLGNCLDKPELISKLEQGLVPWSGAEATEQYQPDVHKWS

SEQ ID NO: 12445 - protein, 81 aa, Mesocricetus auratus
KPELVSFADVAVYFSPHEWGCLRPAQRALYRDVMRETYGLLGALGCAGPKPALISWLERNTDDWEPAALDPQEYRRWVTFQ

SEQ ID NO: 12446 - protein, 81 aa, Ictidomys tridecemlineatus
MVTFKDVAVVFSEEELGLLDCAQRKLYRDVMLENFRNLLSVGHQSFKPDVISQLEREEKLWMEEIHTHPGGRNQSRVESRH

SEQ ID NO: 12447 - protein, 81 aa, Ictidomys tridecemlineatus
MYFTKTEWKLLDLKQRILYKQVMLENYGHLVSLGFAFSKPPLVSQLERGEGPWVANSLRGQAEAESHAGERIKSKTAISKQ

SEQ ID NO: 12448 - protein, 81 aa, Marmota monax
MLENYNNLVSVGFQNIKPHALSNLEQGEELWMIEDEVQNGPCSEIGKVDGHLQEYSQTQRFLKSMHQCSDQNAFKNITHFS

SEQ ID NO: 12449 - protein, 81 aa, Heterocephalus glaber
MLENYNSLVSVGYQASQPDPLSKLLHGEQWTVEDAIHSQIYPEIQKVDIQVRSQTQRWLKRTERHKHNAFGNVVRQRKSNF

SEQ ID NO: 12450 - protein, 81 aa, Marmota monax
MTQVTFSDVAIDFSHEEWAWLDSAQKDLYKDVMVQNYENLVSLGLSITKPYVITLLEDGKEPWMVEKTLSKDWESRWENKE

SEQ ID NO: 12451 - protein, 81 aa, Heterocephalus glaber
LLTFRDVAIDFSPEEWECLEPAQWNLYRDVMLENYRNLVFLAVSTHYTQAFSGDQCIKHLFQNMKKRRNGNYGLDNLYLRK

SEQ ID NO: 12452 - protein, 81 aa, Mus musculus
MNAVTYEDVHVNFTQEEWALLDPSQKKLYKDVMLETYRNLNAIGFNWDSKIFKNIVQVLEDTEGMKEVRVQRKRLNILNVI

SEQ ID NO: 12453 - protein, 81 aa, Mus musculus
LLFEDLDVYFSQEECVSLHPAQKTLSREAPLKSFENLDSIGGEDQTESSQELSLEPVELEELSLEKDSIAAPVVHYSEQSE

SEQ ID NO: 12454 - protein, 81 aa, Mus musculus
MATSEPAESDAKEWEQLEPVQRDVYKDTKLENCSNPASMGNQDPKQDIVSVLEEEEPSSGKGKKASPSSLKKIARPKTAGT

SEQ ID NO: 12455 - protein, 81 aa, Dipodomys ordii
SQGLVTFEDVAVYFSLEEWERLNVEQRALYQEVMQGNYGILVSLGYPIPKPDLIFRLEQGEEPWVPDSPHPEEGDIVTGVY

SEQ ID NO: 12456 - protein, 81 aa, Octodon degus
VTFEDVAVNFSREEWALLDPPQRKLYRDVMWETLRHLAAVDDQQSEDEFRNFQKRVRSEEVEKASQYTLWYQHGEMDSRTP

SEQ ID NO: 12457 - protein, 81 aa, Octodon degus
MEDVAVNFTKEEWALLNPSQKKLYRDVMWETFRNINAIGRTWDNQQMEEHKSCSRNLRDEELPKCCQYAPCSQHENIFLQT

SEQ ID NO: 12458 - protein, 81 aa, Octodon degus
QGSVTFEDVAVHFSWDEWHLLDKAQRCLYRDVMAENLALITSLGLWPGVGDAEASSEQSASLKGMSQVRTFREGLSPQRAQ

SEQ ID NO: 12459 - protein, 81 aa, Octodon degus
LMEAVTFGDVAVHFSREEWQCLDSGQRALYREVMLENHSSVAGLGFLVFKPELISRLEQGQEPWVLDLQGAEGTEAPRTLQ

SEQ ID NO: 12460 - protein, 81 aa, Fukomys damarensis
KAVTFEDVAVNFTMEEWALLDLSQKKLYRDVMWENFRNVTAIGRNMDDQQIEDEYKHYRENLRDAKVDKYCQYKLWNQHGE

SEQ ID NO: 12461 - protein, 81 aa, Rattus norvegicus
SQHVACGLVTFRDVAVDFSQEEWACLDATQKVLYRDTMLETYSHLVTVVGSCLSKPHLITLLEQEKEPWMAVKEETDRPSP

SEQ ID NO: 12462 - protein, 81 aa, Rattus norvegicus
PQKSVTFEDVAVYFTQTEWDGLSPEQRALYRDVMLENYRNLASVGFPLLKPAVISQLEEGEDLESLSQLATGTDSQGLWTE

SEQ ID NO: 12463 - protein, 81 aa, Rattus norvegicus
MGLVSFEDVAVDFTLEEWQDLNAAQRTLYRDVMLENYRSLVFLGHCMNKPELIFKLEQGLGPWNVAEASGRSLPDVHVLTE

SEQ ID NO: 12464 - protein, 81 aa, Rattus norvegicus
SQELVTFEDVAVYFIWKEWKRLEPAQRDLYRDVMLENYGNVFSLDGDSKTGNDQVISEGMGSCEMILGRFQKDVSQGLKFE

SEQ ID NO: 12465 - protein, 81 aa, Mus caroli
MGLISFEDIAVDFTWEEWQDLSAAQRTLYRDVMLETYISLVSLGHCTNKPELIFKLEQGLGPWSVAEASDRNLSDFHILTA

SEQ ID NO: 12466 - protein, 81 aa, Mus caroli
MENMLSFWDVVIYFSAEEREYLGPPQWTLYRDVMLENYNNLVFLGLASSKPYLVRFLEQIQEPLDVKSQVAISMYSGGNSS

SEQ ID NO: 12467 - protein, 81 aa, Mus caroli
NQGESCVSLEDVCLRFTSEEWSLLDDAQKLLYHNMMLENFLLVLSLGLPISKSFPGTRVYPSWPYLLQKDKHMTMEPSINI

SEQ ID NO: 12468 - protein, 81 aa, Mus caroli
MDVAVVFSEEELRLLDAAQRKLYHDVMLENFRNLLAVGGQSPNKIESLHATGVRCLSLGRLPCWQMTSHDVNKLARTPEDG

SEQ ID NO: 12469 - protein, 81 aa, Mus caroli
MDLVTYEDVRVNFTREEWALLDPSQKSLYRDVMLEICWNLTAIGYKWEDFNIEEHCKCPERHERYIICHSGFKPCEDKKYK

SEQ ID NO: 12470 - protein, 81 aa, Mus caroli
VTFEDVAVDFTQEEWILLDTKQRNLYREVMLENYQNLATLECQLIKSRYSFCLEAEELRVVKRRVHQEWAIQLNTRETMFQ

SEQ ID NO: 12471 - protein, 81 aa, Mus caroli
MLENFSHLVFLGFSFSKPLLVRFLEKNQELRNVKRKAAAVPRGKKLYKCKECGKAFAKSSVLTQHLRIHTGEKPYTCDICG

SEQ ID NO: 12472 - protein, 81 aa, Mus caroli
MDAVTYEDVHVNFSQEEWALLDPSQKSLYKDVMLETYWNLTCIGYKWEDHNAEDQHQSSGRHGRCINCPSAYGKKQCTNLF

SEQ ID NO: 12473 - protein, 81 aa, Mus caroli
MGLVSFEDIAVYFNLEEWQDLDTAQRTLYRDVMLETYSSLVFLDPCIAKPKLIFNLERGFGPWSLAEASSRSLPGVHNVST

SEQ ID NO: 12474 - protein, 81 aa, Mus caroli
SKGSASFKDVTVDFAQEEWQALDPAQKALYRDVMLENYCHFISVGFHITKPDLIRKLEQGEELWTERIFPSQSYLEEEEIL

SEQ ID NO: 12475 - protein, 81 aa, Neotoma lepida
FRASKPDVILKLEQGKEPWIVEESPKDDDALEDKGTQGKHSKQFSVFSNKKMPAKATLFEKTVALDMNTVSSEKMLHKYDP

SEQ ID NO: 12476 - protein, 81 aa, Mus musculus
MASVSFEDVAVHFTQDEWALLDSSQKSLYRDVMLEICRSLATIGNRWEEENVEDHYKNPWRNMRNTSRGSQWKNTLSIQGV

SEQ ID NO: 12477 - protein, 81 aa, Mus musculus
GCCSLETHSIRDKNAVTYGDVHVNFTQEEWALLDPSQKKLYKDVMLETYRNLNAIGFNWDDKNTEEHCPSTRRWRRFYRMQ

SEQ ID NO: 12478 - protein, 81 aa, Mus musculus
AQGGMAFSDVAIYFLRGEWRLLDDSQRRLYHQVMMEVFVLMSSLGLIPSGTDITQLGSSGNRFIPALRFLTPRVELAKIPC

SEQ ID NO: 12479 - protein, 81 aa, Mus musculus
NKKPVVFSDVSLDFSQEEWECLGPAQRDLYKDVMLENYSNLLSVGLHIPKPQVISLLEQGKEPWMIGKELTRGLCSALESM

SEQ ID NO: 12480 - protein, 81 aa, Mus musculus
MAAVTYEDVHVNFTHEEWVLLDPSQKSLYKDVMLETYWNLTAIGYKLEDLNSEEHSQRSRRYGRHKICHSEYKPCELKGYG

SEQ ID NO: 12481 - protein, 81 aa, Mus musculus
VPLLGAGTSGKPRSSDMDIVTYDDVHVNFTWEEWALLDPSQKDLYRDVMLETYRNLAAIGYYWKGHNISEGHFQNSRRNGR

SEQ ID NO: 12482 - protein, 81 aa, Mus musculus
PNMDLLTYDDVHVNFTQEEWALLDASQKSLYKGVMVETYRNLTAIGYSWEEHTIEDHFQTSRSLGRVFTMKQSILPRNLGI

SEQ ID NO: 12483 - protein, 81 aa, Dipodomys ordii
SIKTVAFQHVAVDLSQEEWQQMKPAQRNLYRDVMLETYRNLVAVGCQVTKPDVIFKLEQEEEPWVMEEEMFWRLSPESRRE

SEQ ID NO: 12484 - protein, 81 aa, Octodon degus
ELVTAEDVILEFTPEEWALLDTSQKKLYRDVMLENINHLISLGLMSVCKKAEKRSTQCFYRNDTNTVSGARTHTGEKPHQC

SEQ ID NO: 12485 - protein, 81 aa, Octodon degus
FRGSVSFEDVAVDFTQEEWNQLDPTQRTLYRDVMLENYSHLVSLGYPITKPDVITSLEQGVLGIIKKEIPSSVCTEDEKAE

SEQ ID NO: 12486 - protein, 81 aa, Octodon degus
VTFGDVAVHFSREEWQCLDSGQRALYREVMLENHSSVAGLESTIKPDCKQPCLDISLLKPQSHGCENAWNSEVWSERCSSS

SEQ ID NO: 12487 - protein, 81 aa, Octodon degus
FQLPVTFEDVAVYFSKEEWECLSLRQKTLYRNVMLDNFRSLVALGFCGPRPNLVSHLEQWDELWVEDCESAELQESQSDSC

SEQ ID NO: 12488 - protein, 81 aa, Octodon degus
MEPVTLEDVAVNFTLEEWAFLNSSQKKLYRDVMWETFRNMTAIRRTLDKQKIEEQYKNTSRNQSNEKAAKWYPYKSWNQYG

SEQ ID NO: 12489 - protein, 81 aa, Octodon degus
VSFEDVAVNFTLEEWALLDPYQKELYRDVMCETFRNIAALERIWGDEEIKYKNWRRNIRSEVEKGCEYELWYQHGEMVFWT

SEQ ID NO: 12490 - protein, 81 aa, Octodon degus
SQGSVSFKDVTVGFTQEEWQHLDPSQKSLYRDVMLENYSHLVSVGYCVTKPELIFRLEQGEEPWVLEEEFPRPGFLEFWKT

SEQ ID NO: 12491 - protein, 81 aa, Octodon degus
MLRMTKCGPDQGGLLDGGEAVTFEDVAVNFYREEWALLDPSQKKLYRDVMWETFRNLAAVGRSSDDQHLDDKDRKCGKQLR

SEQ ID NO: 12492 - protein, 81 aa, Octodon degus
ADGSVTFRDVAIDFSQEEWEFLDSAQRDLYRDVMWENYSNFISLGASISKPDMITLLDEEGKEPGMIVKEGIRNLYPGIAF

SEQ ID NO: 12493 - protein, 81 aa, Fukomys damarensis
MLETYGNLVSLGLAGSKPYMITCLEQSREPWNVKRQETVVIHPAVSSYFTQDISSEQHKEHSFQNVTDGRYRICGHDNLHL

SEQ ID NO: 12494 - protein, 81 aa, Fukomys damarensis
HGPGALGDIPFYFSREEWSSLDPAQRDLFWDIKRENSQNTTQGLELQSQNKKALLEKRTHTGEKPHKCPECDKSFRSSSDL

SEQ ID NO: 12495 - protein, 81 aa, Fukomys damarensis
MPLTFQDVAVYFSRAERRQLGPGQRALYRDVMLENYGNVASLGFPIPKPELISQLEQEEELWVLDLLGAEEPEVLRTCWTD

SEQ ID NO: 12496 - protein, 81 aa, Fukomys damarensis
VTFSDVAINFSHEEWGWLDSAQRDLYKDVMVQNYKNLASLGLSVTKPYVISLLENGKEPWMVEKKLSKDWESKWKNKELFT

SEQ ID NO: 12497 - protein, 81 aa, Rattus norvegicus
WKVHMAFRDVAVDFSQEEWSLLSPAQRSLYREVMLENYSNLVSLGIPFSKPKLITQLEQGKETWREERKCPQVACPAQAKL

SEQ ID NO: 12498 - protein, 81 aa, Rattus norvegicus
CERLVSFEDVTVDFSQEEWRRLDPAQRRLYQEVMLEIYSHLLSVGYPIPSPGAIFRIKKRKKTQTGEAKFPHHQCWCQEVE

SEQ ID NO: 12499 - protein, 81 aa, Heterocephalus glaber
EAVIFEDVVVRFTMEEWDLLNPSQKKLYRDVMGETFRNMAAVGRAWDNQELEDEHKTYWRNLRNKAWNQYKEIFLWTPDAN

SEQ ID NO: 12500 - protein, 81 aa, Heterocephalus glaber
PKVPVAFDDVSIYFSTPEWEKLEEWQKELYTNIMKGNYESLISMDYAMSQPDVLSQIQPEGEHNTEDQAGPEESDIPAVPS

SEQ ID NO: 12501 - protein, 81 aa, Heterocephalus glaber
MASLCVAKPEMIFKLERGEELWILEEESSGHAYAESLSLLCGNTSVGGIALNLLANQKVPTLNENVDYNGCGKGFHEETAF

SEQ ID NO: 12502 - protein, 81 aa, Heterocephalus glaber
YQEFVTFEDVAVYLTREEWGRLDPVQRDLYREVMLENYGNVVSLGILLRLPTTRIHCVNSCPALSHTQASAFSGETLAVLS

SEQ ID NO: 12503 - protein, 81 aa, Mus caroli
ETGSVSFEDIAVDFSWDEWQHLDVAQRTLYRDVMLENYSSLLFLGHCMTKPEVIFQLEHGFEPWPMGDSSVLSLAGIHKKS

SEQ ID NO: 12504 - protein, 81 aa, Mus caroli
ELVTFEDVAVHFTMEEWALLDLSQKELYKDVMKEILRNVVSIGDIRKHQKIDNEYQNSGRKLRCQLVEKLHDCKEGHECAE

SEQ ID NO: 12505 - protein, 81 aa, Mus caroli
MNAVTYEDLHVNFTQEEWALLDTSQKMLFKDVMLETYRNLNAIGFSWEAQNIEEHCQSSGRHRRCERSQSAEKPSEYTQRG

SEQ ID NO: 12506 - protein, 81 aa, Mus caroli
SQMPVTFEDVALYLSQEEWGRLDHTQQNVYRDVLQGKNGLALGAVEVGKVVPALADATLEDTKSIRTRARWTPGEDPKFGQ

SEQ ID NO: 12507 - protein, 81 aa, Mus caroli
VMESVSFEDIAVFFTWEEWQDLDFAQKLLYRDVMLENYSSLVSLGCCVIKPELILMLEREFGPWRAADTSVWNLPGYCMTR

SEQ ID NO: 12508 - protein, 81 aa, Mus caroli
LKPGAVSFADVAVYFSPEEWRCLRLAQRALYRKVMRETYGLLASLVGGDKPALICWVEEESEVWGPCAQEPEVAMCKTEVH

SEQ ID NO: 12509 - protein, 81 aa, Mus caroli
SQGLVTIKDVSLCFSQEEWRSLDPSQTDFYGEYVMQENCGIVVSLRFPIPKLDMLSQQEGGEDQWAPGPQDVEGRDILKVT

SEQ ID NO: 12510 - protein, 81 aa, Mus caroli
MEAVTFKDVAVVFTKEEFRLLDSAQRTLYQDVMVENFRNLLSVEYQLFKRDKPYLEREEKPPTRRAALRERDSGINGQSAR

SEQ ID NO: 12511 - protein, 81 aa, Mus caroli
KPGAVSFADVAVYFSPEEWRCLRPAQRALYREVMRETYGLLSYIEVGGAKPALICWVEEESEVWGPCAQDPEVAMCKTEFH

SEQ ID NO: 12512 - protein, 81 aa, Neotoma lepida
MLENYSHLVSLGYPITKPEVITSLEQGVLGIMKREISSSSCTEDGQAEDYLEWHQENQNIHREQAISIIEKNVTEERSYEY

SEQ ID NO: 12513 - protein, 81 aa, Mus musculus
LQEMVTFRDVAVVFSEEELGLLDAAQWKLYREVMLENFRMLLSVAHQPFKPGLIAQLENGEQLWMVEAEAHAGRRNGHAVE

SEQ ID NO: 12514 - protein, 81 aa, Dipodomys ordii
SNEPVTFEDIALTFTLEEKGLLDIPQKSLYREVMLENYRNLVSVELHLSKPDVIIQLEKAEDCWTVEREILQDTFPECSGA

SEQ ID NO: 12515 - protein, 81 aa, Mus musculus
TENPVTYNDVLVSFTREEWALLDPSQKSLYKDVMLETYKNLTAIGYNWEDDNIEEDCENSGRPRRHLQRDGPSNTREKPFE

SEQ ID NO: 12516 - protein, 81 aa, Dipodomys ordii
LRESVTFKDVIVDFTQEEWKHLDPTQRDLFRDVALENYTHLVSVGLQVSKPDVISQLEQGTEPWIVEPSIPGGAFGEWNTN

SEQ ID NO: 12517 - protein, 81 aa, Rattus norvegicus
MVTFRDVAVVFSEEELGLLDAAQRKLYGEVMLENFRMLLSVGGKNLEDTESLEEVGLRHLPHEELFCSQIWQRVIRELAKA

SEQ ID NO: 12518 - protein, 81 aa, Rattus norvegicus
FQEMLSFRDVAIDFSAEEWECLDPAQWNLYRDVMLENYSNLVFLGLAFSKPYLVTFLEQRQEPSDEKKQHKLGHTGEKPYK

SEQ ID NO: 12519 - protein, 81 aa, Rattus norvegicus
FQGSVSFTDVTVDFSQEEWEQLDPSQRILYMDVMLENYSNLLSVEVWKADDQVEKDPREPDKQAPSLTTPKNQPPTEERGS

SEQ ID NO: 12520 - protein, 81 aa, Peromyscus maniculatus
MLENYSNLTSLGYQVGKPNLISHLEQEEELRMEERDIQWGTSPDWGTSAKIKWSIVMEDIFGEETSNGVTLEKSHLLEKSS

SEQ ID NO: 12521 - protein, 81 aa, Peromyscus maniculatus
SLLTFRDVAVDLSKEEWECLDCAQRALYMDVMLENYNNLVFVGQNQRVHTGKKEHKNTEFDKSFESQHKLTMKRTNSGKKP

SEQ ID NO: 12522 - protein, 81 aa, Peromyscus maniculatus
VQDLVTFKDVAVLFTQEEWRQLSSAQRALYRDVMSENYSNLVSLGLSGSKPDVFFHLEKADKCVSEDAPGGFVLGWSNLRE

SEQ ID NO: 12523 - protein, 81 aa, Peromyscus maniculatus
SQGLLTFRDVAVDFHQEEWECLDSAQRALYIDVMLENYNNLVFVENYCKCDPVHQHVKTEKESCQCTKLGKVLHDPSTCAL

SEQ ID NO: 12524 - protein, 81 aa, Peromyscus maniculatus
VCGSVTFRDVAVVFSRREWAYLDASQRVLYRDIMLETYSNLVTVVGSSISKPDLIALLEQKREPWMVVKKQTDRPSPDLES

SEQ ID NO: 12525 - protein, 81 aa, Peromyscus maniculatus
SVSFMDVTIDFSREEWQHLDPDQRSLYQDVMQETYSHLRSVEELQQIGDQKETYQQIANSKSASDVIFIKKTLDTKSHYGY

SEQ ID NO: 12526 - protein, 81 aa, Peromyscus maniculatus
MLDNYSNLASLGLCASKPDMIALLEQGEDPWVTKRKRTGGRCPDLKAVQKFPPKDLREGKFSQAVVKKQPLHCRPRCSMLG

SEQ ID NO: 12527 - protein, 81 aa, Mesocricetus auratus
SWGSVSFEDVSVDFTQEEWNQLDPIQRSLYRDVMLENYSHLVSLGYPITKPKVITSLEQGILDIIKREIPSSSCTDDGQAE

SEQ ID NO: 12528 - protein, 81 aa, Mesocricetus auratus
MLSFRDVAIDFTPEEREYLEPAQWNLYRDVMLENYSNLLFLGLASSKPYLVTFLEQSQGPYDMKGQAASAMQTGKKHSTDK

SEQ ID NO: 12529 - protein, 81 aa, Mesocricetus auratus
MVLVSFEDIAVDFTWEEWQNLDAAQRALYRDVMLETYSSLVSLGHCMTKPELIFNLEHGLGPWSTADASVWNLSGVNKMSS

SEQ ID NO: 12530 - protein, 81 aa, Mesocricetus auratus
VQEPVTFRDVAVSFSQDEWLHLDSAQRSLYREVMLENYSNLASLGILFSKPKVISQLEQAEDFQMVESGMLQGVYLGWKSL

SEQ ID NO: 12531 - protein, 81 aa, Mesocricetus auratus
LQDSVTFKDVAVDFSQEEWERLNPAQRSLYRTVVLENYWNLVSVGACVSKSHLISLLEHGKAPWDMRGEVTESTSQDGESV

SEQ ID NO: 12532 - protein, 81 aa, Mesocricetus auratus
KDLVTFQDEAVDFIQEEWTTKDPAHNSVPGDVTVEDYTSLASVEGEKQLHTKDLALEQEFLTRHSFMETQKVDAVTFEDVT

SEQ ID NO: 12533 - protein, 81 aa, Mesocricetus auratus
SQGLSTFRDVTVDFSQEEAQCINSVQGSLYIDVILENYNNLVSLENYYICDPVHHHVKTEKESCQCDELDKVLHDPSTCAL

SEQ ID NO: 12534 - protein, 81 aa, Ictidomys tridecemlineatus
FQDLVMFRDVTVDFSQEEWECLNSYQRNLYRDVILENYSNLLSLAGCSISKPDVITLLEQGKDPWMIVRDEKRRWSLDLES

SEQ ID NO: 12535 - protein, 81 aa, Heterocephalus glaber
QGLITFRDVAIEFSQEEWKYLEPSQRDLYKDVTLENFSHLVTLGLSISKPDVISLLEQGKEPWMVTNDMTGPWYQGLESRC

SEQ ID NO: 12536 - protein, 81 aa, Heterocephalus glaber
MLENYSHLVSMGYPVSKPDVISKLEQGKDPCIMKRDIPNWTYPDENHRGKRQRKKNNLHNSQSCILGTVSFYNKILKGVTK

SEQ ID NO: 12537 - protein, 81 aa, Neotoma lepida
TQGLVTFEDVAVYFSLEEWERLDVDQRDLYREVMQENYGILVSLGYPIPKPDLIFRLEQGEEPWVPDSPHPEEGDIVTGVY

SEQ ID NO: 12538 - protein, 81 aa, Neotoma lepida
PKVPVAFDDVSIYFSTPEWEKLEEWQKELYKNIMKGNYESLISMDYAMNQPDVLSQIQPGEHSADDQPRPEASEIPADASE

SEQ ID NO: 12539 - protein, 81 aa, Mus musculus
MEDPLSFTDVAIDFSADECECLDSAQWNLYKEVMLENYSNLVFLGLAFSKPYLVTFLEQSSDLWSVKRKASVAIHLGSKAH

SEQ ID NO: 12540 - protein, 81 aa, Mus musculus
PQKSVTFEDVAVYFTQTEWDGLSPGQRALYRDVMLENYRNLASVGFPLLKPAVISQLEERKDLENLFQLATGTDSQGLWTE

SEQ ID NO: 12541 - protein, 81 aa, Mus musculus
YRDVMLENYSNFVSLGLAISKPSIISLLEQGKEPWIVEQAGWCPDLLSVNEAKSLSLKNGIFGKESLKWKIIERVGSSCLE

SEQ ID NO: 12542 - protein, 81 aa, Mus musculus
QICSEGAWVPALFDEVAIYFSDEEWEVLTEQQKALYREVMRMNYETVLSLGNALFSFVSGTLQTQRHSSVSVFSAISNLLL

SEQ ID NO: 12543 - protein, 81 aa, Dipodomys ordii
SLGLVSFEDVSVHFSWEEWKDLDDIQKTLYRDVMLETYSNVVSLDVQQVDGSVEICQESPDKHLLQVVITSSNTVEERVRF

SEQ ID NO: 12544 - protein, 81 aa, Dipodomys ordii
MLENYSNLISVGIHTSKPDVIFKLEQGEEPWIGDEITRQNHTEDDGALEKDPEIQDKHLNQIVFNNETMITEKNYVFGNTF

SEQ ID NO: 12545 - protein, 81 aa, Octodon degus
VQEPVTFRDVAVDFTQEEWGQLDPMQRTLYRDVMLETFGHLLSVGHQIAKPEVISLLEQGEEPWSVEPVHPQSSCPEWMRN

SEQ ID NO: 12546 - protein, 81 aa, Octodon degus
KQVSVTFEDVAVRFTAEEWGLLDLSKRTLYWEVMLETCGLLLAVGCPLSKSELIYQLEHSQDPWTAPEALSQSSHPGSSTK

SEQ ID NO: 12547 - protein, 81 aa, Octodon degus
CEGSVSFRDVTIDFTREEWQHLDPGQRNLYRDVMQETYSHLLSVEKLQKIGDQIENYPQTGSKSFSDVAFIKKMMTVKDHH

SEQ ID NO: 12548 - protein, 81 aa, Octodon degus
TLTFEDIAVNFTTEEWALLNPSQKKLYRDVMWETFMNITTVGRTCDNQQVEEKYKNCSGKLSNKEVPIWYQYKTWTKHEKI

SEQ ID NO: 12549 - protein, 81 aa, Octodon degus
KVQELVTFEDVAVDFTPEEWQYVSPPQRTLYRNVMLETYSHFVSLGQQVAKPDLILKLEVEEPCLAEGEVPIWSFPEVCQI

SEQ ID NO: 12550 - protein, 81 aa, Octodon degus
MFSDVSVDFSQEEWECLDSVQRDLYRDVMLENYRNLISLGPSIPKPQVVSLLEQGKEPWMVGRELTRGLCLDLESMCESKL

SEQ ID NO: 12551 - protein, 81 aa, Neotoma lepida
QEMLSFWDVAIEFSPEERECLEPAQWNLYREVMLENYSNLVFLGEDLIHSLAVSKPHLVIFLEQGQEPSYVKRQAAANVHP

SEQ ID NO: 12552 - protein, 81 aa, Mus musculus
DAVTYEDVHVNFSHEEWALLDSSQKSLYRDVMLETYWNLTAIGYKLEDPNVEEYYQSYRRHRRYNICHCGYKPCEHKGYGK

SEQ ID NO: 12553 - protein, 81 aa, Mus musculus
AYRNLASLGLCASQPDMITSLEQGRDPWMMKRKMRKGQHLDLKAMQETKEFPPKDLSEETLFLAVLRKQLLPHRPKCSMVR

SEQ ID NO: 12554 - protein, 81 aa, Mus musculus
EQLTFRDVAIDFSGEEWECLDSEQQNLYTDVMLENYRNLVFLGLAVSKPYLVTCLEQRKEPWNVKTQKTMAVFPAMFSHHS

SEQ ID NO: 12555 - protein, 81 aa, Mus musculus
SQGPVLFEDVSVVFTQKEWQLLDAAQRHLYREVMLETYRHLRAVGHNVTKPELICKLEQGESPWEPSGHSLSEVQRADTMT

SEQ ID NO: 12556 - protein, 81 aa, Dipodomys ordii
ACRKPGAVSFADVAVYFSPEEWGCLRPAQRALYRDVMRETYGKGGTKPALISWVEEEAELWGLDAQDPEVARCQAGTAPDS

SEQ ID NO: 12557 - protein, 81 aa, Dipodomys ordii
AVTQLTFEDVAVDFTQEEWRCLTQAQRTLYRDVMLDTYGNLVSVGVSPPSMSVILPLEFQEDPWVAKSHVTTPGELNGWEG

SEQ ID NO: 12558 - protein, 81 aa, Dipodomys ordii
SLRLVSFEDVAVDFSWEEWQDLDNAQRTLYRDVMLETYSSLVSLDVQQVDDQIEMCQGSPDRHLWQVVITSSNTVEERVRL

SEQ ID NO: 12559 - protein, 81 aa, Octodon degus
ETVTFEDVAVNFTMEEWALLNPSQKRLYRDVMKETFGNITAIGRVLDNQEVEEYKNYCRSLRNEEVEKCYQNKGWNQYEEI

SEQ ID NO: 12560 - protein, 81 aa, Octodon degus
GLLTFEDVAVFFTQEEWDYLDPAQRSLYKDVMMENYGNLVSLDVLNKDKDEEPSVKQEIEELEEEVEPQGVIVTRIKSEID

SEQ ID NO: 12561 - protein, 81 aa, Octodon degus
LQEPVTFRDVAVDFTQEEWGQLDPIQRILYRDVMLETFRHLLSVGPELPKPDVISQLEQGAEFWVGQQGQPQSCHSEKKPA

SEQ ID NO: 12562 - protein, 81 aa, Octodon degus
NQESVTFQDVAVDFTEKEWPLLDPSQRKLYRDVMLENYNNLTSLGYQVGKPSLISHLEQEEEPRTEEMGTPQGACPDWETP

SEQ ID NO: 12563 - protein, 81 aa, Octodon degus
SKDLVTFGDVSINFTEEEWEWLNPVQRNLYRKVMLENYRSLVSLAGISVSKPDVISLLEQGKEPWVMETEGAGDIRPDRES

SEQ ID NO: 12564 - protein, 81 aa, Octodon degus
AQESLTLEDVAVRFTQEEWQLLGPAQKDLYRDVMLENYRSLVSVGFQASRPDVLPTLEQGEPLWMLEDEIHSQILLEIEKA

SEQ ID NO: 12565 - protein, 81 aa, Octodon degus
SLGPALFRDVAVVFSQEEWERLAPAQRELYRHVMLETYRNLVSLGLAASKPGVISCLEQGRAPWVEETVTAGGPCPVSDSE

SEQ ID NO: 12566 - protein, 81 aa, Octodon degus
VTIEDVAVHFSWNECHLLNKAQKCLYCDVLAENMALITSLDMLHMTYHQQETRSDQKLYRCGARGRQLCFTAETHQHEKLQ

SEQ ID NO: 12567 - protein, 81 aa, Octodon degus
GTIEDVAVDGTHLEEPLMNPTQRSIHSDVMVKNLQKLATVGCQTPIKHSPVSYSKGELVTGQKGVLQELEMQLQTRDLALQ

SEQ ID NO: 12568 - protein, 81 aa, Octodon degus
LTLEDVTVTFTQDEWQLLCPAQKNLYRNVMLENYSNLVSLENGQVVNHVQCHMKNQRMLKDMEQYHKHNPFIDTVLQSKNH

SEQ ID NO: 12569 - protein, 81 aa, Octodon degus
TMAQGLVTFGDVAVLFTQEEWGRLSPPQRALYRDVMLENYSNLVSLGLLGPKPDTFSHLGKEWMLEVSSGCFCLDWMTMTV

SEQ ID NO: 12570 - protein, 81 aa, Fukomys damarensis
QGSVSLKDVTVDFTEEEWQRLDTAQKALYMDVMLENYCHFISMVLFINHKKPVKERSNIYGKTLTLGKNRIISKTLYEHKS

SEQ ID NO: 12571 - protein, 81 aa, Fukomys damarensis
EAVSFEDVAVNFTKEEWSSLDPSQKKLYRDVTAETLRNLAAVAFNTCSACQRHERIHTGEKPYVCKHCGKAFRTQSDYKVH

SEQ ID NO: 12572 - protein, 81 aa, Fukomys damarensis
MECICTLHEGLPVLAAPVHHTWRPGPASSIFFFAAHTAGFLVFKPELISRLEQGQEPWVLDLQGAEGTEAPRTFQTGVSQS

SEQ ID NO: 12573 - protein, 81 aa, Fukomys damarensis
VKIEDMAVSLILEEWGCQNLARRNLNRDSRQENYGNVFSQGRENRSENKESTSKAEDTEDTGSHGETTGRFQKDLGEKREQ

SEQ ID NO: 12574 - protein, 81 aa, Fukomys damarensis
SSDSVTFEDVALDFTQEEWVLLDQSHRDLYREVMLENYENLASMGCELVKPSLISWLEHEEDWRTGQRGGPREWEMQLSTK

SEQ ID NO: 12575 - protein, 81 aa, Mus musculus
VTFDDVHMNFTKEEWNLLDPSQMNLYKDVMLETYWNLTSIGYKWEDHHIEEPCQSSRRHTRHVRSHSWKKLYECNQCGKAF

SEQ ID NO: 12576 - protein, 81 aa, Mus musculus
MEKRCHSEMWHDFSAEERECLDSAQWNLYKEVMLENYSHLVFLGLAFSKPHLITFLERRPEPWNVKTQASVGTYPGSKPYQ

SEQ ID NO: 12577 - protein, 81 aa, Mus musculus
YREVMLENHSSVAGLAGFLVFKPELIFRLEQGQEPWVLDLQGADGTEAPRICQTDSAIRTDRKQTCEYTSLLQRQIPGFGD

SEQ ID NO: 12578 - protein, 81 aa, Dipodomys ordii
SLRLVSFEDVAVDFSWEEWQDLDNAQRTLYRDVMLETYSSLVSLAGHCVPKPEAIIKLEQGAEPWVGEPSGQSFAGHCVHK

SEQ ID NO: 12579 - protein, 81 aa, Dipodomys ordii
SLELMSFDDVAVYFTWKEWQDLDPGQRTLHRDVMLETYSNLMSLGHCVPKPELIVKLEQGADPWIREASDKNFTDIQEMED

SEQ ID NO: 12580 - protein, 81 aa, Dipodomys ordii
PQKSVTFEDVAVYFTQVEWDGLSPAQRALYRDVMLENYGNVASLGLPLLKPAVISQLEEGDELVGPFPLATGTGMGSWDFW

SEQ ID NO: 12581 - protein, 81 aa, Dipodomys ordii
TKKLISFDDVAVNFTWKEWQDLDPGQRTLHRDVMLETYSNLMSLGHCVPKPKLIVMLEQGADPCIREGSEKNFTDAQEMED

SEQ ID NO: 12582 - protein, 81 aa, Octodon degus
AQVSVTFEDVAVRFTAEEWGLLDLSKRTLYWEVMLETCGLLLAVGCPMSKSELICQLEHRQALRKATDDLSQSICPGNSTK

SEQ ID NO: 12583 - protein, 81 aa, Octodon degus
YQDSVTFEDVTVDFTQEEWALLDRGHRDLYREVMLENYKNLASVGCEFIKPSLISWLEHEEDSKMQHRGDPQEWEMQLSTK

SEQ ID NO: 12584 - protein, 81 aa, Octodon degus
MAIDFSLEEWEDLDSAQQNLCRDVMLETYGNLVSLGLADSKPYMITCLEQSREPWNVKKQDSVVIHPAVHNGEKPFKCEEC

SEQ ID NO: 12585 - protein, 81 aa, Fukomys damarensis
QGSVTFRDVAIDFCQEEWECLDPAQRVLYRDVMLENYRNLIAAAGSTISKPDVIALLEQEQEPWIDVRKQTSRRDPDLDSD

SEQ ID NO: 12586 - protein, 81 aa, Rattus norvegicus
MGLVSFEDVAVDFTWQEWQELDAAQRTLYRDVMLENYSSLVSLGHCVTKPELILRLEHGFRPWSIGGDASVWSLPGVLEVY

SEQ ID NO: 12587 - protein, 81 aa, Rattus norvegicus
MMDMLSFWDVAIDFSPEEWEWLKPAQWSLYRDVMLENYSNLVFLGLAVSKPQLVTFLEQRPEPMDVKRQEAATVHSGIALN

SEQ ID NO: 12588 - protein, 81 aa, Mus musculus
YKEPVIFKDVAVYFSQKEWQLLEPAQKDLYKDVMLENYENLISVEYYIFKPKLITRLEQGVDLFAKENDVPGDPQQGEAGV

SEQ ID NO: 12589 - protein, 81 aa, Mus musculus
PAFATELKDLIMEDITIKAEPQEPVIFEDEAVYFTEQELASLTLDQKALHEEVVLENFAHVALLGCYDMFEEMGLGAGEIT

SEQ ID NO: 12590 - protein, 81 aa, Mus musculus
ERRLVKLRTPNMDLVTYDDVHVNFTQEEWALLDASQKSLYKGVMVETYRNLTAIGYSWEEHTIEDHFQTSRSHGSNLESVS

SEQ ID NO: 12591 - protein, 81 aa, Dipodomys ordii
TQVSVTFDDVAVTFTQEEWGQLDPAQKTLYQEVMMETFGLLASLGHPVSKPVLMDQLTHGQELWMVTQGLSKSTCPETKAA

SEQ ID NO: 12592 - protein, 81 aa, Dipodomys ordii
MYFSQEEWELLNPTQKSLYNDVMQENYNTVISLALFVLPKPKVIFCLEQGEEPWVQGSSDFKESRRGFCTGLKVKNDNENH

SEQ ID NO: 12593 - protein, 81 aa, Dipodomys ordii
YQEFVTFEDVAVHLTREEWGCLDPVQRDLYREVMLENYGNVVSLGILLRLPTTRIHCVNSCPALSHTQACAFSGETLAVLT

SEQ ID NO: 12594 - protein, 81 aa, Dipodomys ordii
VQEPVTFKDVAVDFTQEEWRQLNLVQRTLYRDVMLETYGHLLSVGNQITKPEVISLLEQGGEPWLVEQACSQSTHPELMRS

SEQ ID NO: 12595 - protein, 81 aa, Ictidomys tridecemlineatus
SLGSEFFRDVAIVFSQEEWEWLEPAQRDLYRDVMLETYRNLVSLGLAISKPDVISFLEQGKEPWMEERVVSGSLCTVLKSR

SEQ ID NO: 12596 - protein, 81 aa, Dipodomys ordii
FKGPVTLKDITVEFSKEEWKLLTPAQKTLYKDVTLDNYNLLVSVGYRVSKPAIVLKLKQGKDPWSLEVECPRRKHPEKVKN

SEQ ID NO: 12597 - protein, 81 aa, Dipodomys ordii
SQGHVSFKDVCVDFTKEEWYLLDPAQKIMYRDVILENYSNLVSVGHCVTKPEVIYKIEQGEEPWILEKGSSGQNHSEKKWK

SEQ ID NO: 12598 - protein, 81 aa, Dipodomys ordii
SQELVTFEDVAVYFIRKEWKRLEPAQRSLYRDVMLENYRNVFSLDGESRTENDEGISEASGSHGMLLGRFQKDIAQGLKYE

SEQ ID NO: 12599 - protein, 81 aa, Octodon degus
GWVPALFDEVAIYFSDEEWEVLTEQQKALYREVMRMNYETVLSLEFPFPKPDMISRLEQEEESHNSDKWQLQRGTFAENEE

SEQ ID NO: 12600 - protein, 81 aa, Peromyscus maniculatus
MAHVMTFSDVAVDFSPEEWECLNLEQRHLYRDVMLENYNHLVAVGLCIYQPRVLPVLEEEQDAYVDLGSETRGFCPDIDSV

SEQ ID NO: 12601 - protein, 81 aa, Peromyscus maniculatus
YQEFVTFEDVAVHLTREEWGCLDPVQRELYREVMLENYGNVVSLGFPISKPDGISQREQDLQVFDLETKNKEVIRDDCSDG

SEQ ID NO: 12602 - protein, 81 aa, Rattus norvegicus
QVDAVTFEDVAVDFTQEEWTSLDPIQRTLYREVMLENYQNLATVGGQLFKPSLISWLERKVELTVMEQGILQEWEMHLKTK

SEQ ID NO: 12603 - protein, 81 aa, Octodon degus
WSQEPLTFEDMAVDFTREEWEQLQPAQKTLYRDVMLENYRKVVALGHQANKPQRIAELEWEELWPVGALPDGDSGPKIKNS

SEQ ID NO: 12604 - protein, 81 aa, Octodon degus
WDLLTFDDLAVDFSPEEWTLLDLAQRKLYRDVMLETFQNLASLGFEILFKSSESVVLPDNDYEKVSNKEKVITLTRNSSWF

SEQ ID NO: 12605 - protein, 81 aa, Octodon degus
QAQVTFEDVAVLLSQDEWGCLGPAQRGLYRDVMLETYRNLVFLGVGSAGPKPAVILQLERGDEPWVLNTEEAEGRRPLRVS

SEQ ID NO: 12606 - protein, 81 aa, Octodon degus
PKDLEILDDVEMPFSENEWASLTSVGNALYAEVMAENCKTVASLAAASIDRPDANLALEEERDALIQRGWEVGLAEYITKL

SEQ ID NO: 12607 - protein, 81 aa, Octodon degus
LQDAVTFEDVTVDFTREEWALLDVSQRSLYREVMLENCRNLASLGCHVDKTSLISQLEQEDKTMTEERGNLTITCPDLETV

SEQ ID NO: 12608 - protein, 81 aa, Peromyscus maniculatus
DKTLMAFHDVAVAFNQVEWELLSPAQRILYREVMLENYSHLVSLGIAFSKPKLITQLEQGAEPWRDGSECLLDLCLAEPRT

SEQ ID NO: 12609 - protein, 81 aa, Peromyscus maniculatus
PQELVTFEDVAVYFTQSQWDGLQPAQRALYRDVMLENYAHVASLVECPPPKPILVSQLERGEAPWATDPWASECLRGCSPD

SEQ ID NO: 12610 - protein, 81 aa, Rattus norvegicus
YVELVSFEDVTVDFTWEEWQNLSDAQRILYRNVMLETYSSLLSLGQCIPKPELIFKLEQGEEPWAAEEPANKTLPVFCNVD

SEQ ID NO: 12611 - protein, 81 aa, Octodon degus
VHGSVTFRDVAIDFCQEEWECLGPIQRDLYRDVMLENYSNLIAVGSTISKPDVIALLEQGTEPWMGVRKDRSRWYPGLNSG

SEQ ID NO: 12612 - protein, 81 aa, Octodon degus
YKGFLTFEDVAVDFNPEEWALLDPIERNLYKEVMLENYQNLVSVGCQLIKPSLISCLEAEEELRIVERGALQEWALQLNTK

SEQ ID NO: 12613 - protein, 81 aa, Peromyscus maniculatus
MLENRGLLVSLGYPVPRPELMCRLEHGQELWPVMKDLFPSIHAGNNGKTKAAELTPCEPALSKGVSLQGKLTKEASEDWQS

SEQ ID NO: 12614 - protein, 81 aa, Peromyscus maniculatus
MEALLSFRDVAIDFSAEECECLDLAQWNLYRDVMLENYSNLVFLGLAFSKPYLVTFLEQRKEPWNVKGPAPVAVHPEIKPY

SEQ ID NO: 12615 - protein, 81 aa, Cavia porcellus
PKVPVTFDDVAVHFSEQEWGNLSEWQKELYKNVMRGNYESLVSMDYAISKPDLMSQMERGERPPMQEQEDSEEGETPTDPS

SEQ ID NO: 12616 - protein, 81 aa, Ictidomys tridecemlineatus
GQVTFQDVAVYFSWEEWDLLDEAQRHLHLEVMLENLALISSLGCLHGVEHEETPSEPSISEGLSHVMTHREGSSSQHAYTC

SEQ ID NO: 12617 - protein, 81 aa, Dipodomys ordii
LKGAVSFNDVAVDFTQEEWQQLDADEKAMYRDVMLENYSHLVSLGYDFIKPNMIIKLEQGEEPWMIEDDFPSQNHPEDIWK

SEQ ID NO: 12618 - protein, 81 aa, Dipodomys ordii
AVTQLTFEDVAVYFTREEWRCLTPAQRTLYRDVMLDTYRNLVSVGVSPPSMSVILPLEFQEEPWVAQSHVTTLGGLNGWEG

SEQ ID NO: 12619 - protein, 81 aa, Peromyscus maniculatus
SLGPLSFKDVAVAFTQEEWQQLGPEEKTTYRDVMLENYSNLVSVGYHIIKPDVIIKLEQGDEPWVGEEAFSPQSCPDEIWQ

SEQ ID NO: 12620 - protein, 81 aa, Octodon degus
SPVLVSFDDVFVSFTREEWQVLDNAQRALYGDVMLETYRSLVLLGQCITKPEVIFKLEQGVEPWTGGEPHNQSPPDVQEVD

SEQ ID NO: 12621 - protein, 81 aa, Octodon degus
CQESVTFEDVAVIFTDEEWRHLAPVQRALYKAVMLENYESMVSLGLLVPPPDVIFWLKRGDEPCREGLQGSEERECPQIIS

SEQ ID NO: 12622 - protein, 81 aa, Mus musculus
VCGSVTFRDVAVDFSQEEWACLDATQKVLYRNIMLETYSNLVAVVGSCISKPDLIVLLEQEKEPWMAVNEETGRPSPDLEA

SEQ ID NO: 12623 - protein, 81 aa, Cavia porcellus
LQVPVTFEDVAVTFTQEEWGQLDPGQRTLYQEVMLENCGLLVSLGCPVPTPELIQQLEHGQPPWTVRLGCGQSTQLGDSGK

SEQ ID NO: 12624 - protein, 81 aa, Cricetulus griseus
MAHVMTFRDVAIDFSPEEWECLTLEQRHLYRDVMLENYSHLVSVGLCIYQPHEFPVLAKEQDAFMDLGSEGRRCCPDIDPV

SEQ ID NO: 12625 - protein, 81 aa, Cricetulus griseus
FQRLVSFKDLTVDFTREEWQYLGPAQRLLYRDVTLENYRNLISLGFRVSKPEVILKLEQGKEPWIVEELSSQNHAGKCEDR

SEQ ID NO: 12626 - protein, 81 aa, Cricetulus griseus
RQESVTFKDVVVNFTQEEWKHLDPTQRDLFRDVTLENYTHLVSIGLQVSKPDMISQLEQGTEPWIEESCIPVGSMGDWKIR

SEQ ID NO: 12627 - protein, 81 aa, Cricetulus griseus
KPGAVSFADVAVYFSPEEWGCLRPAQRALYREVMRETYGLLGALGVGGAKPALISWVEEEAELWGPGAQDPEVAMCQTQAD

SEQ ID NO: 12628 - protein, 81 aa, Heterocephalus glaber
GEVPVTFDDVAVYFSEQEWGKLEDWQKELYKHVMRGNYETLVSLDYAISKPEVLSQIDQGKDPCTWRRTGPKIPDVPVDPS

SEQ ID NO: 12629 - protein, 81 aa, Heterocephalus glaber
LTMEDVTIKFTPEEWALLDTPQRKLYRNVMVENINHLLSLEYQLCESDLNFLSVDKEMLWTVEGRVIPQLQHPERKIAPNI

SEQ ID NO: 12630 - protein, 81 aa, Mus caroli
PKVTVSFEDVSVYFTKTEWKLLDLKQRNLYKQVMLENYSHLVSVGFAFSKPNLVSQLERGEKPWIRDDRMESAARSRAGNR

SEQ ID NO: 12631 - protein, 81 aa, Mus caroli
MEDMLSFWDVAIYFSAEEWECLGPAQWDLYRDVMLENYSNLVFLGLASSKPYLVRFLEQIQEPSDVKRQAAITVHPGGKCY

SEQ ID NO: 12632 - protein, 81 aa, Mus caroli
GSLENDGVCFSEQEWENLEDWQKELYRNVMESNYETLVSLKVLGQPEEEVELGAEMVGDLVEEGTHLADRAMVKQEMLYKQ

SEQ ID NO: 12633 - protein, 81 aa, Mus caroli
RGTEPVTFRDVAVSFSQDEWLHLDPAQRTLYREVMLENYSNLASLGFQASIPPVIGKLQKGQDPCMEREVPEDTCLDFEIW

SEQ ID NO: 12634 - protein, 81 aa, Mus caroli
MESVSFEDVAVKFTQEEWIVLDPSQKKLYKDVMQETLKNLASIGNKSGKQKVINEYGKLWRKLSSHLAEKFSDYNENHQCA

SEQ ID NO: 12635 - protein, 81 aa, Mus caroli
WPQSVTFEDVAVYFTQAEWGGLSPEQRALYRDVMLENYRNLASVGFPLLKPAVISQLEERKDLENLFQLATGTDSQGLWTE

SEQ ID NO: 12636 - protein, 81 aa, Mus caroli
LQEPVTFRDVAVDFTQEEWGQLDPTQRTLYRDVMLETFGHLLSVGPDLPKPAVISQLEQGAELWVADRGGTRACHPGWILE

SEQ ID NO: 12637 - protein, 81 aa, Mus caroli
MEDLLSFTDVAIDFSADECECLDSAQWNLYKEVMLENYSNLVFLGLAFSKPHLVTFLEQSSDPWSVKRKASAAISLGSKPH

SEQ ID NO: 12638 - protein, 81 aa, Mus caroli
MPPVQKELYKTVTLQNYWNMVSLGLTVYRPTVIPVLEEPWMVIKEIVEGPNPEWEPIAQAQSPAKHLPELKQDGTQTVKLE

SEQ ID NO: 12639 - protein, 81 aa, Mus caroli
LQEAVTFNDVAIDFSQEEWEWLNSAQRSLYRTVVLENYRNLVSVGACISKPSLISLLEHGKEPWEVKGQVTGSRVQGGESV

SEQ ID NO: 12640 - protein, 81 aa, Mus caroli
PQGLLTFKDVAVEFSQEEWECLDCAQRTLYMDVMLENYKNLFFVENLCTFPKYENGLDQDTQHIVHKHVTIQKKSYKYYEH

SEQ ID NO: 12641 - protein, 81 aa, Mus caroli
SQESVTFQDIAVDFTEKEWPLLDSSQRKLYKDVMLENYSNLSSLGYQVGKPRLISHLEQEEDLRMEERGIQQGPSPDWGTT

SEQ ID NO: 12642 - protein, 81 aa, Mus caroli
NTVTYEDVHVNFSQEEWALLDPSQKKLYKDVMLETYRNLNAIGFNWEDQNTEEHCESSRRHMRHERSQSAEKTFEYTQCDK

SEQ ID NO: 12643 - protein, 81 aa, Mus musculus
MNAVTYEDVHVNFTQEEWALLDPSQKKLYKDVMLEIYRNLSALGFNWEAQNIEEYCQSSRRHRRCERSQSAEKPSEYTQRD

SEQ ID NO: 12644 - protein, 81 aa, Mus musculus
MVTFRDVAVVFSEEELGLLDAAQRKLYHDVMLENFRNLLAVGCQSPNKMAPLDTKGIRCLPLGKLPYWQMTSHDVNKLARA

SEQ ID NO: 12645 - protein, 81 aa, Mus musculus
ASSHGPSEDSGCLQERKIAAEMMLVDCLTDDQELVSFEDVIVDFTQEEWSSLNPDQRNLYRDVMLENYQNLATGISSSNPV

SEQ ID NO: 12646 - protein, 81 aa, Mus musculus
MASSSSQDMVCGSVTFKDVAVDFSQEEWACLDATQKVLYRDMMLETYSNLVSVDIELSAPSEPCLPGSCHASCHDDNGLNL

SEQ ID NO: 12647 - protein, 81 aa, Mus musculus
YREVMFENYSNLVSLGLAFSKPYLVTFLEKRQQSWDVKQQATVATYPGTKPYKYKECNKTFVRKSLLIQHQRVHTGEKPYK

SEQ ID NO: 12648 - protein, 81 aa, Mus musculus
PQGLLSFKDVALDFSLEEWECLSFAQRSLYMDVMLENYNNLLFVENHCIHGKYEKVMDQDSQYIVLEHMNIQEKSSKWNKL

SEQ ID NO: 12649 - protein, 81 aa, Dipodomys ordii
CQESVTFEDVCVIFTDEEWEYLVPVQKALYKVVMLENYQNIVSLGLPVLQPDVIFQLKKGDMSWKEGLHGSEEKECPESLA

SEQ ID NO: 12650 - protein, 81 aa, Dipodomys ordii
HGSVTFRDVAIDFSQEEWEFLNSAQKDLYRDVMWENYSNFISLAGPSICKPDMNVLLDEEGKEPSTVVKEGTRRYSPDWES

SEQ ID NO: 12651 - protein, 81 aa, Dipodomys ordii
GWGLLSFTDISMELSLEEWQLLDSAQRHLYREVTLENYSNLLSVGYHGTKPDLVFKLEHGEEPWVINTKMSTQNCPEGWED

SEQ ID NO: 12652 - protein, 81 aa, Dipodomys ordii
GGGPVLFRDVCVDFTWKEWQLLDVTQRLLYKDVMLDNYRHLHALGLCVTKPQLICKLEREEEPWIMEREPPSHSHSGTPNM

SEQ ID NO: 12653 - protein, 81 aa, Dipodomys ordii
MTKLVSFDDVAVDFSWEEWQDLDFSQRTLYRDVMLETYSNLVSLGPCVPKPNLIVKLEEGAEPWIGEASDKNYTNVQEMED

SEQ ID NO: 12654 - protein, 81 aa, Dipodomys ordii
SVKLLSFKDVSINFSPEEREYLSPAQCTLYRDVMLENYRNLVSLGLAISQPYLITFLEEWEEPWNLKRQEAGAVYPAVSSQ

SEQ ID NO: 12655 - protein, 81 aa, Dipodomys ordii
SKVPVSFEDVSVYFTKTEWKLLDLKQRILYKQVMLENYSHFVSLGLAFPKPCLVAYLEQGEGAWVPALHREGAAESQAGDG

SEQ ID NO: 12656 - protein, 81 aa, Octodon degus
ELEGPVSLKDVTVDFTEEEWQQLDPAQKALYREVMLENYCHFISVGFHMTVPHVICKLEEKLWTERIFPSQSYLINLTKQM

SEQ ID NO: 12657 - protein, 81 aa, Octodon degus
PQDLEILDDMKTPFSDNEWASLTSVGHALYTEVMAENYKTVASLAAASIDRPDANLALKEERDTLIPRGWEVGLAEYIIKL

SEQ ID NO: 12658 - protein, 81 aa, Octodon degus
IARSQETMTFKDVAMDFTPEEWGKLDPVQRDVMLENYRNLVSLWLPVSKPENYNLDNGKEPLKCERKAPKLRYSDIEIIPE

SEQ ID NO: 12659 - protein, 81 aa, Octodon degus
SLVLVSFDDVFVSFTREEWQVLDNAQRALYRDVMLETYRSLVLLGECITKPEVIFKLEQGAEPWTGGEPPNQSPPDVQEVD

SEQ ID NO: 12660 - protein, 81 aa, Mus musculus
MDALTFDDVHVHFTREEWSLLDPSQKRLYKDVMLENYRNLTAIGYHWKDHNIEEHCQNDRRYGRHERSPAGEKPYEYTQWN

SEQ ID NO: 12661 - protein, 81 aa, Mus musculus
MKDLLSFTDVAIDFSADECECLDSAQWNLYKEVMLENYSNLVFLGLAFSKPYLVTFLEQSSDPWSMKRKESAAIHLGSKPH

SEQ ID NO: 12662 - protein, 81 aa, Cavia porcellus
MLENYGNVASLGFPLLKPAMISQLERGGELKGPSPLATGTGTGSQGLWPVDTDIQTNSNLTKKIHEEKDGTSFELPRDICL

SEQ ID NO: 12663 - protein, 81 aa, Cavia porcellus
RDVAVVFSEEELGLLDSAQRELYREVMLENFRNLLAVEHRFITADISPQLERQGKLWMREMTVQSDDASGENKKLNEMETL

SEQ ID NO: 12664 - protein, 81 aa, Cavia porcellus
ELMTFRDVAIDFSPEEWECLDSAQWNLYRDVMLENYRNLVSLGLAVSKPYLVTFLEQRKELWNVEREEILAIFPAESSPYT

SEQ ID NO: 12665 - protein, 81 aa, Cricetulus griseus
VMTFRDVAIDFSPEEWECLTLEQRHLYRDVMLENYSHLVSVDIDPVWRKNKVLPKDSTRAGQLSQWEVLETDTNHSLEGLC

SEQ ID NO: 12666 - protein, 81 aa, Cricetulus griseus
YFCGMLTASGVTVNLSQEEWQCLDPPLRALYRDWMLQNCSRMVSVGLTDHPDLLTCAAEQRGWKMETDETVVKDPEKQALF

SEQ ID NO: 12667 - protein, 81 aa, Cricetulus griseus
EEALMAFHDVAVAFSQMEWELLSPPQRALYREVMLENYSHLLSLGIAFSKPKLITQLEQGAEPWRDGSECLRDLCLAESRT

SEQ ID NO: 12668 - protein, 81 aa, Cricetulus griseus
PQGPISFRDVAVDLSQEEWECLDCAQRALYLDVMLENYSNLVFVENHCIYGKYEKILDQGTKHMTHKHVNIQEKHFEFDEL

SEQ ID NO: 12669 - protein, 80 aa, Cricetulus griseus
MLENYSSLMFLGYCMTKPELIFKLERGFGPWSVVEASLQSLPGVHKMTTPIENHQEYHNGFLWPVEITNSQTSNEEIVEN

SEQ ID NO: 12670 - protein, 81 aa, Ictidomys tridecemlineatus
QDSVTFKDVAVLFTQEEWGQLSPAQRALYRDVMLENYSNLVSLAQAPLIDEPHHSPVFISLSLSFLIADISKDELDSHWKY

SEQ ID NO: 12671 - protein, 81 aa, Marmota monax
GSVTFEDVAVTFTQEEWGQLDPAQRTLYQEVMLENCGLLVSLGYPVPKPELIFQLEHGQQLWTVMIDLFQSTCPGDSGKPQ

SEQ ID NO: 12672 - protein, 81 aa, Marmota monax
MQEEWALLDASQKNLYRDVMLEVLRNLASIGNKCDEKNFEDQIKHSGSNVRQITSHYGHERYKHEECEEKPCELKQYRKSL

SEQ ID NO: 12673 - protein, 81 aa, Marmota monax
MQRKAILRQSRSFRSPQPAAPPPQARKAAVTWAGHCIPKPDAIIKLEQGAEPWVAEEPPDQSHPGHCIPKPEAIIKLEQGA

SEQ ID NO: 12674 - protein, 81 aa, Marmota monax
CVTFEDVAVYFSQEEWGLLDEAQRLLYLHVMLENFALVTSLVYWHEAEDERIPPGPRVSAEEASHIRTPKQSPSFQKTHPC

SEQ ID NO: 12675 - protein, 81 aa, Marmota monax
PLTFRDVAIDFSEEEWKYLNPSQQNLYRDVMLEIYRSLVFLGMSPHQMLEISAEQGINYLWQTMKNGSPRKHQCDHFKKKV

SEQ ID NO: 12676 - protein, 81 aa, Marmota monax
MWQFGKILHYFSLTGHCIIKPEVIFKLEQGAEPWMVEEHPNQTLSDVQKVDDQIDRSQESQDRRLWQVVITNSNSSTKERV

SEQ ID NO: 12677 - protein, 81 aa, Heterocephalus glaber
RWQDSVTFGDVAVDFSWEEWKLLNEMQRLLYRDVMLENFGLVASLGLVSSQIHVLVQLELEEDWVADRADLTVAAREPWRR

SEQ ID NO: 12678 - protein, 81 aa, Mus musculus
MEAVTFKDVAVVFTKEEFRLLDSAQRTLYQDVMVENFRNLLSVEYQLFKRDKPYLEREEKPQTRRAAPRERDSGINGQSAR

SEQ ID NO: 12679 - protein, 81 aa, Mus musculus
FKELVVFRDVAVEFCKEEWECLGPEQRSLYRDVMLENYSNFVSLGLAISKPSIISLLEQGKEPWIVEQAGWCPDLLSVNEA

SEQ ID NO: 12680 - protein, 81 aa, Mus musculus
YQDVMLENYRNLVSVGYQLSKPTVISQLEKGEGPCMAESQGPEDPILDVKNKLETKESTAEDDISVKLDHGITRGRLIEDD

SEQ ID NO: 12681 - protein, 81 aa, Dipodomys ordii
KVPVTFVDIAVYFSEDEWKNLDEWQKELYNNLVKENYKTLMSLDAEGPVSKPDAPAQVEPREEPCVWEQRHPEEREVPVDA

SEQ ID NO: 12682 - protein, 81 aa, Dipodomys ordii
AYGPVTFRDIAIDFSQQEWECLNSSQKNLYRNVMMENYGNLVSLGHPISKPDIITLLEQGKDPWMIVRKETRKGFREFKPA

SEQ ID NO: 12683 - protein, 81 aa, Octodon degus
IQSLVTFNDVAVEFTPWEWGQLGPAQTHPYKEVMLENTGDLASGGRMGKSPVSETELEMGTHPNWKRRLKAKESASSQRIS

SEQ ID NO: 12684 - protein, 81 aa, Dipodomys ordii
MEEWALLDASQRKLYGNVTSEMYRNLASIEIKEEENTEGGYRNRKRIVRTAKVEKLCEETGDIPCGESFQQVPDCSVNRSL

SEQ ID NO: 12685 - protein, 81 aa, Ictidomys tridecemlineatus
LLTFRDIAIDFSEEEWECLEPAQQNLYRDVMLETYRNLVFLAMISHHTQEISPEPGLEHLLKQVIKRRYGYCNLDYLQQQK

SEQ ID NO: 12686 - protein, 81 aa, Marmota monax
AHVSLAFKDVAIDLSQEEWECLDTAQRDLYRDVMLENYSNLISLGCIIPKPDVIVLLEQEKDPWLETREETRRQSSDFTKK

SEQ ID NO: 12687 - protein, 81 aa, Marmota monax
VMFEDVAVHFSWEEWGLLNATQRGLYRDVMLENFALVSSLGCLCRMKDEDAPPKQVKSCRVDLSEKPFVYERFVKDGPVTT

SEQ ID NO: 12688 - protein, 81 aa, Marmota monax
SQTLVTFKDVLVDFTREEWQLLDPAQQVMYKDVMLENYENLVSLGHQLPKPEVILQLEKGEEPWLVERAVQELCPDLDTNV

SEQ ID NO: 12689 - protein, 81 aa, Marmota monax
MITNYETLLSLDDRLSKPELISWIEQEEEPFKSWGESQKPRNMIHSADMYFDPHIEGELFGGSQETVKSGETKCHFQFSPL

SEQ ID NO: 12690 - protein, 81 aa, Marmota monax
AHGSVTFRDVAMDFSQQEWECLNPFQKTLYRDVMMENYGNLVSLGHSISKPDVITLLEQGKEPWMIVKKETRKWRKDLESR

SEQ ID NO: 12691 - protein, 81 aa, Marmota monax
MLLDTAQRALYRHVMLGNFALVASLGLSASRPRVVIQLEHGEEPWVPSGTDTALGRNAHRKSSLGSCCLAEDRDVSGEPTL

SEQ ID NO: 12692 - protein, 81 aa, Heterocephalus glaber
FQLPVTFKDVAVYFSKEEWECLSPKQRALYRNVMLDNFRSLVALGFCGPRPDLVSRLEQWDELWVEDCEKTELQEAQSAPC

SEQ ID NO: 12693 - protein, 81 aa, Heterocephalus glaber
AVTFEDVAVNFSVEEWALLDPSQKKLYRDVMWENFRNVTALDVRAFSTPIYVQLQERNHSRVNTYICIQSGKVLNSHHDIQ

SEQ ID NO: 12694 - protein, 81 aa, Heterocephalus glaber
SVTFKDVVVDFTQEEWKQLDPGQRDLFRDVTLENYTHLVSIGLQVSKPDVISQLEQGTEPWTVEPGPGVAVGACGGRQQMP

SEQ ID NO: 12695 - protein, 81 aa, Mus caroli
KPGAVSFADVAVYFSPEEWRCLRPAQRALYREVMRETYGLLSYIEVGCAKPALICWVEEESEVWGPCAQDPEVAMCKTEFH

SEQ ID NO: 12696 - protein, 81 aa, Mus caroli
EEEQASSCDSGIMAHEEWECLSSYERDLYRDVMLENYSHLVSLAGCSISKPDVITLLEQGKEPWMIVRAEKRRWSRDLESR

SEQ ID NO: 12697 - protein, 81 aa, Mus caroli
EMVTFRDVAVVFSEEELGLLDAAQRKLYHDVMLENFRMLLSVGDKNPEEIESLEEVGLRHLPHEALFCSQIWQQVSRDLTK

SEQ ID NO: 12698 - protein, 81 aa, Mus caroli
ENAEDSMASTLPTTWPHESVKFEDVSLRFTEEEWALLDRQQKCLYREIMMENYSNMISVGKPGSTLINTCLGGWSMLLIPS

SEQ ID NO: 12699 - protein, 81 aa, Mus caroli
SKAPVTFGDLAIYFSQEEWEWLSPIQKDLYEDVMLENYHNLVSVGLACRRPNIIALLEKGKAPWVIEPSRRRWGPESGSKY

SEQ ID NO: 12700 - protein, 81 aa, Mus caroli
MEEMLSFRDVAIDFSPEERECLEPAQWDLYRDVMLENYSHLDFLGLAVAKPYLVTFLEQNQRSSGVKSQTSATIPPGTTGN

SEQ ID NO: 12701 - protein, 81 aa, Mus caroli
FKELVVFRDVAVEFCKEEWECLGPEQRSLYRDVMLENYSNFVSLGLAISKPTIISLLEQGKEPWIVEQAGWYPDLLSENEA

SEQ ID NO: 12702 - protein, 80 aa, Mus musculus
AGEIWPGFRKPELVSFADVAVYFSPQEWGCLRPAQRTLYREVMRETYGLLGALGEAPSQSPAPILLGVHRGVAVDRSSGL

SEQ ID NO: 12703 - protein, 81 aa, Mus musculus
FQVPVTFRDVAVYFCREEWECLSPSQRTLYRNVMLENFRNLNELGCCSRRPGLITRLEQWDEPWVDDWDRSEFPDGQKSFC

SEQ ID NO: 12704 - protein, 81 aa, Mus musculus
DAVTYDDVHMNFTEEEWDLLDSSQKRLYEEVMLETYQNLTDIGYNWQDHHIEEHCQSSRRHERHERSHIGEKPYERNQCGK

SEQ ID NO: 12705 - protein, 81 aa, Mus musculus
TQRSISFKDLAVDFTREEWQRLGPAQRLLYRDVMLETYSNLIAVGLHVSKPDVILKLEQGKEPWVVENSSRQNHAEDDEPL

SEQ ID NO: 12706 - protein, 81 aa, Mus musculus
YRDVMLENYSNLLFLGHCKTKPELIFNLEQRLGSWIVEASHQCVPDFQNMSTLNKSSPDTKARHVWQVALNSETSKELAGI

SEQ ID NO: 12707 - protein, 81 aa, Mus musculus
YREVMLENYSNLSFLGYQVGEPRLISHLEQEEDLRMEERGIQQGPSPVFSFRLGTTSKVKWSILLEDIFGKEASDDVRLET

SEQ ID NO: 12708 - protein, 81 aa, Mus musculus
DAVTYDDVHINFTQEEWVLLDLSQKRLYKDVILETYRNLTAIGYKWEEYNIEEYCQNSRIHGRQERSHPEDKLYEYRQCGK

SEQ ID NO: 12709 - protein, 81 aa, Dipodomys ordii
VSFEDVTMSFSWEEWNLLDEAQRHLYFSVMLENLARMSSLGRSLEVKHDGTPSEPSISVALSQVRDLLSRFSSPECIFHSA

SEQ ID NO: 12710 - protein, 81 aa, Dipodomys ordii
SQAPVTFEDMAMYLTREEWRPLDPTQRDLYRDVMQENYGNVVSLDFEIRSENEVNPKQEISEEVEFGTTSDGRPVGSREEN

SEQ ID NO: 12711 - protein, 81 aa, Dipodomys ordii
SQTLVTFRDVLVDFTEEEWKLLDAAQQFIYKDVMLENYKNLVFLRFHLPKPDVIHCLEKGEEPWLVERRIYRETQPVKDLR

SEQ ID NO: 12712 - protein, 81 aa, Dipodomys ordii
LQGSVSFEDVAVDFTQEEWNQLDTSQKTLYRDVMLENYSHLVSVGYLITKPEVIAFLEQEAVLGIIKREIPSSSCTEDGQV

SEQ ID NO: 12713 - protein, 81 aa, Dipodomys ordii
YEVPVSFEDVTVDFSREEWQKLDSTQRCLYQDVMLENYSHLLSVGFEVPKPEVIFKLEQGEEPWMLEDEVPHQSCFDGKFG

SEQ ID NO: 12714 - protein, 81 aa, Octodon degus
IVTFEDVAVTFTMEEWTLLNPSQKNLYREVMWVTFLNMASIGTTWDKNIDMAYKNWWQNIRNEEVEKCYEYKAWNQHEDIL

SEQ ID NO: 12715 - protein, 81 aa, Octodon degus
VRFADVAVYFSPEEWGCLRPAQRTLYRDVMRETYGHLGALADSPSKKEEPKEEPGDKGPALTPGKEPPEELVKHSPDSSVS

SEQ ID NO: 12716 - protein, 81 aa, Octodon degus
MEDVAVNFTKEEWALLNPSQKKLYRDVMWETFRNIKAIGRTWDNQMEEKYKNCSRNLRNDEGAKCYQYKACNQPENRSNHT

SEQ ID NO: 12717 - protein, 81 aa, Octodon degus
AQVAVTFEDVAVLFTQDEWRKLDALQKSLYRDVMLENYRNLASLGFLFTKPRVISLLQQEEDPWKVEKEIPGDPAIGCKSS

SEQ ID NO: 12718 - protein, 81 aa, Octodon degus
YKVSVTFDDVALEFTQEEWTLLDITQRNLYREVMLENYENLSSVGYQFFIPSLISWLKQEELNTAETGVLHPLELELQQIT

SEQ ID NO: 12719 - protein, 81 aa, Octodon degus
KVPVTFVDIAVYFSEDEWKNLDEWQKELYNNLVKENYKTLMSLDAEGPVAKPDAPAPVEPREEPCVWEQRHPEERQVPVNT

SEQ ID NO: 12720 - protein, 81 aa, Octodon degus
EESITIEDVTITFTPEEWALLDTAQRTLYRAVMLETIRNLQSLEKNNSPDAEGQIATGPVKRKKPDSVKPRENAQCEEIHF

SEQ ID NO: 12721 - protein, 81 aa, Octodon degus
AQGLVTFRDVAIEFSQEEWKCLEPSQRDLYRDVTLENFSHLATLGLSISKPDVISLLEQGKEPWMVTDDMTGPWYQGLESR

SEQ ID NO: 12722 - protein, 81 aa, Octodon degus
AVTFEDVAVSFTLEEWALLDPSQKKLYRDVMWETFRNLADIGKNWDDHQVEDEYKNYRKIARNAEDYKCCQYKLWCQHAKI

SEQ ID NO: 12723 - protein, 81 aa, Octodon degus
FKGLVMFEDVAIEFSEEEWEGLDPSQRNLYRDVMLENYNTFISLGLAISKPSVIFLLEQGKEPWMAGKTGSYPDLLSWYET

SEQ ID NO: 12724 - protein, 81 aa, Peromyscus maniculatus
AQGRVTFEDVYVNFSREEWELLDEPQRLLYLNVMLENFSLVATLGCWCESDGKEAPCEHNISGEAVPQTRTAESSLPMQTS

SEQ ID NO: 12725 - protein, 81 aa, Peromyscus maniculatus
IILSHNALLAQEKMKKEEMNNGLQIRGRNLYRALMLENYRNLVALGHQLYKPEVITQLEQEVRRTLERGSQLDAFPDGVDR

SEQ ID NO: 12726 - protein, 81 aa, Peromyscus maniculatus
SPSLMAFEDVAVYFSQEEWTFLDAAQRALYRHVMLENFALVDSIGLSVSRPRVIIQLQRGEEPWVPNRTNTGPGRRPHRRS

SEQ ID NO: 12727 - protein, 81 aa, Peromyscus maniculatus
PQGLLSFRDVAVDISQEEWECLDCAQKALYMDVMLENYNNLLFVENHCICGKYEKVLHQDTKHFIHDHENVKEKSYKCNEL

SEQ ID NO: 12728 - protein, 81 aa, Peromyscus maniculatus
VPQVLTFRDVAVSFSQEEWECLESASKALYFDVMLENYSNLVFVEKYRICGKYMNVLDQGSKHIVYHPVNIQEKSYENSDI

SEQ ID NO: 12729 - protein, 81 aa, Mesocricetus auratus
GKDTITYDDVHIGFTQEKWALMNPSQICLYKDVMLEMYRNLSAIGYKWEENNIEKHCDSSRRNRTNERTHSAEKPYACNHC

SEQ ID NO: 12730 - protein, 81 aa, Mesocricetus auratus
PQDPLTFRDVTVVLSQEEWECLDAAQRTLYMDVMLENYSNLVFVENHRPCGNHEKFQDQGLKHIVHHRHVNIQEISCKCNE

SEQ ID NO: 12731 - protein, 81 aa, Mesocricetus auratus
ESVTFEDVAVHFTMEEWAMLDPSQKELYKDVMKEILRNVISIGNIRKHQKIENEYQNSGRKLRCQLVEKLHDCKEDHECAE

SEQ ID NO: 12732 - protein, 81 aa, Mesocricetus auratus
MLENYRHLLAVGYRVVKRSVISKLKQGKEPWVSERELPNQRRDDKQQNVSDPKTKHRERQAGNARKGELGKRRKTPTQYES

SEQ ID NO: 12733 - protein, 81 aa, Mesocricetus auratus
DLVSFKDVTVDFTQEEWTSLNPAQRCLYRDVMLENYKNLATVEWKMQLETKCSTFQQKFLKGNIFNGMQMTGSQNVRELFN

SEQ ID NO: 12734 - protein, 81 aa, Ictidomys tridecemlineatus
FQELVSFNDVTVGFTQEEWQHLDPSQRSLYREVMLENYSHLVSVGYCVTKPEVIFRLEQGEEPWILEAEFPSQSFPELWKA

SEQ ID NO: 12735 - protein, 81 aa, Ictidomys tridecemlineatus
LMTVKDEEMDFTHEELEELNSAHRYMGMDMKVDNYGSLVFWDSESMPETKEFFSKQEVYEEESPERELVIERLEKDDSWGS

SEQ ID NO: 12736 - protein, 81 aa, Ictidomys tridecemlineatus
EPGAVSFADVAVYFSLEEWGCLRPSQRALYRDVMRETYLHLSALGGGGTKPALISWVEEEAELWHPDAQDPEVAKCPTEAD

SEQ ID NO: 12737 - protein, 81 aa, Ictidomys tridecemlineatus
MLENYHVLVSLGYEVMKPDVIFKLEQGEEPWVGDGDTPRSDSAEVCQVDGHMKWHQDNQDKLKNVKKGHEWDAFGKNFNPS

SEQ ID NO: 12738 - protein, 81 aa, Heterocephalus glaber
QGSVMFSDVSIIFSQEEWEYLDREQRNLYRNVMMENYSNLVSLAGCFISKPDVITLLEQGKDPWKVVRKGRKRYSDLETSH

SEQ ID NO: 12739 - protein, 81 aa, Heterocephalus glaber
QESLTFQDVAVDFTKEEEEQLYPAQKNLYRDVMLENYRNLVALGHQVYKPAVITQLEQEELWTRGGGHPVGAPLDGDNGPK

SEQ ID NO: 12740 - protein, 81 aa, Mus caroli
KVPVTFVDIAVYFSEDEWKNLDEWQKELYSNLVKENYKTLMSLDTDGPVSKPDPPVQAESREEPCVWEQHHPEEREIPVTA

SEQ ID NO: 12741 - protein, 81 aa, Mus caroli
MDAVTFMDVHVNFSQEEWALLNPSQKSLYKDVMLETYWNLTCIGYEWEDHNSEECCQSSRRHGRYFNSSQYSTCKAKGYGK

SEQ ID NO: 12742 - protein, 81 aa, Mus caroli
MLSFRDVAIDFSPEEWEYLEPAQWNLYRDVMLENYSHLVFLGLADSKSQLLTFLEQRQGSAAVKRQAVKAVFPGITPNDSN

SEQ ID NO: 12743 - protein, 81 aa, Mus caroli
MEEMLSFRDVAIDFSAEEWECLEPAQWNLYRDVMLENYSNLVFLGLASCKPYLVTFLEQRQEPSVVKRPAAATVHPGGKPY

SEQ ID NO: 12744 - protein, 81 aa, Mus caroli
VPLLGAGTSGKPRSSDMDVVTYDDVHVNFTWEEWALLDPSQKTLYKEVMLETYRNLAAIGYYWKDHNISEGHFQNSRRNGR

SEQ ID NO: 12745 - protein, 81 aa, Mus caroli
EQDGLTHDDVHVNFTREEWALLNPSQKSLYKDVMLETYRNLNAIGYKWEDNNIEEHCQSSRRHGRHERRLIGEKHSENIQC

SEQ ID NO: 12746 - protein, 81 aa, Mus caroli
MMGSQEEWEQLDPSQRILYMDVMLENYSNLLSVEVWKADDEVEKDPRDLQRQAGSLTAIKSQPPTEERGSLSGKTLTLNTD

SEQ ID NO: 12747 - protein, 81 aa, Mus caroli
FWILRLPPGSKGEVPKEWGKLEDWQKELYKHVMRGNYETLVSLGSGAPVPAPDLLMQIKQEGELQLQEQQALGVEAWAAGQ

SEQ ID NO: 12748 - protein, 81 aa, Neotoma lepida
PTLVLLQTCPSAAEDEYILGYHIIKPDVIIKLEQGDEPWIREGGFSPQSCPDEIWQENGLMEKVRGNEKKQSRSTVFNYKS

SEQ ID NO: 12749 - protein, 81 aa, Mus musculus
MGRVTYDDVHVNFTREEWALLDPSQKNLYRDVMLETYRNLAAIGYVWEDHNTEEHLHISRRYERHERSHTAQQLSEFIQCD

SEQ ID NO: 12750 - protein, 81 aa, Mus musculus
MDLVTYDDVQVNFTQEEWALLDPSQKSLYKDVMLETHRNLTAIGYIWEEHTIEDHFQTSRSHGRHERSCSAEQPSEFIQCG

SEQ ID NO: 12751 - protein, 81 aa, Mus musculus
PQGQLTFKDVAVDFSQEEWECLDCAQRALYMDVMLENYNNLFFVETHGMCPKYKNILDQDLQHIVHEHVNIQVKSYKCHEL

SEQ ID NO: 12752 - protein, 81 aa, Dipodomys ordii
SLKLISFDDVAVDFTWKEWQHLDPGQRTLHRDVMLETYSNLMSLGHCVPKPELIVRLEQGSEPWIREASDENFTNVPQMED

SEQ ID NO: 12753 - protein, 81 aa, Dipodomys ordii
LGDQDLGAVLLPGTPQDQWRHLDSTQKEQYWDLMLETYGKMVSGGVSTSKPNLPNSTELGKDLTGLPPHISEKIARLTCAG

SEQ ID NO: 12754 - protein, 81 aa, Octodon degus
TMAQGLVTFGDVAVLFTQEEWGRLSPPQRALYRDVMLENYSNLVSLGLLGPKPDTFSHLGKEWMLEVSSGCFCLAVVNSIL

SEQ ID NO: 12755 - protein, 81 aa, Octodon degus
AVTMEDVTVTFTKEEWAVLNPAQKKLYREVMWETLRNINAVGRTWSNQKMEEEYQNCSRNLRMEERAKCYQYKTCNQHENV

SEQ ID NO: 12756 - protein, 81 aa, Fukomys damarensis
MEEWALLDPSQKKLHRDVMWENFTNVTVIGRNGDDQQIEDEFKNYRNNLSNAEEKSTVYKQDVKNFSKPNYVKIHERNHRR

SEQ ID NO: 12757 - protein, 81 aa, Mus musculus
MDAVTYEDVHVNFSREEWVLLDPSQKSLYKDVMLETYWNLTCIGYKWKDHDNEEYCQNSGRHGRCINCPSAYGKKQCTNLF

SEQ ID NO: 12758 - protein, 81 aa, Cavia porcellus
PRVLETFSDVAVTFTQEEWRQLDLTQRTLYQEVMLEICTILVSLGYQVPKPELIYLPEHGQELWQMKGLMPVTCAGNRAQL

SEQ ID NO: 12759 - protein, 81 aa, Cavia porcellus
MLENYSSLVSVGYQASKPDALSRLLCGEPWMVEDELHCRTPSNIGKTDDDLPRYLQNESKVKRLEKWHEHNTYENVQQSKT

SEQ ID NO: 12760 - protein, 81 aa, Cricetulus griseus
EKQFSFQSLLTFEDVAINFSKKEWECLDTSQRDLYRFVMLENYSNLVSVGLSVSKPELVTCLEQNKEPWMVNIEESEVLEP

SEQ ID NO: 12761 - protein, 81 aa, Cricetulus griseus
GAVTFGDVAVDFSEEEWACLDSAQRAFYRDLMLETYSNLVTVVGSSISKPDLITSLEQEREPWMVVKEETDRPSPGDLSPF

SEQ ID NO: 12762 - protein, 81 aa, Cricetulus griseus
FQEPVTFKDVAVAFTQEEWGQLDIVQRTLYRDVMLETYGHLLSVGNHISKPEVISLLEQGEEPWSVKQAYPPSTCPGEVKP

SEQ ID NO: 12763 - protein, 81 aa, Cricetulus griseus
PQGLLSFRDVSVDFSQEEWECLDCAQRALYMDVMLENYSNLLFVENQRIYGKCEKLLHQGTRHFIHYHENIQEKSFTCNES

SEQ ID NO: 12764 - protein, 81 aa, Cricetulus griseus
SLLTFNDVAINFSKEEWECLDLSQRDLYRNVMLENYINLVSVGFSDSKPELVTCLEQNKEPWMVNMEEAEGLEPNIPKRMY

SEQ ID NO: 12765 - protein, 81 aa, Cricetulus griseus
EKQFSFQSLLTFEDVAINFSKEEWECLNTSQRDLYRFVMLENYSNLASVGLSVSKPELVTCLEQNKEPWMVNIKDSEVLEP

SEQ ID NO: 12766 - protein, 81 aa, Cricetulus griseus
SVPKQKPLDVLRDRNHHPRGRHNQRHKNMSSRKDAVTYDEVHTNFTQEEWAFLDPSQKRLYEDVMLDTYRWKDHNIELSNF

SEQ ID NO: 12767 - protein, 81 aa, Castor canadensis
SRSIENDGVCFSEQEWENLEDWQKELYRNVMQSNYETLVSLKVLGQPEGEAELSSEMLGDLEEEDPHGTHLADGAMVKQEV

SEQ ID NO: 12768 - protein, 81 aa, Peromyscus maniculatus
MDVVTYNDVHVNFTQEEWALLDPSQKSFYRDVILETYMNLTDIGYNWEDHNVEEHCQSSQRYGSYVVCHSGYKPYEHRDIE

SEQ ID NO: 12769 - protein, 81 aa, Mesocricetus auratus
MLSFWDVAIEFSPEEREYLEPAQWNLYRDVMLENYSHLDFLGLAVPKPHLVTFLEQRQEISDVKRQTAATMHPGTTTNDYN

SEQ ID NO: 12770 - protein, 81 aa, Mesocricetus auratus
GSAESRAESVGRLEDRGVDAVTCSDVRVDFTQEEWALLDPSQKILYQDGMLETYRNLTAIGYKWEDDNIKEHCQSSQRHGR

SEQ ID NO: 12771 - protein, 81 aa, Mesocricetus auratus
SKAPVTFGDLVIYFSQEEWEWLSPIQKDLYEEVMLENYHTLVSLGLVSRRPNIITLLEKGKAPWMVEPSRRRRGPESGSKR

SEQ ID NO: 12772 - protein, 81 aa, Mesocricetus auratus
MDAVTYDDVHINFTLEEWALLNPSQKSLYKDVMLDTYRNLTAIGYSWDDHNIEEICQSSRSHRRHLQRHAKINTGEKPYGS

SEQ ID NO: 12773 - protein, 81 aa, Mesocricetus auratus
MLETYSSLESLNQCDAKPELILKLEQGAEPWKEEDVPNQSLPAVENVKSLNNTSWDNQKRYLNHLVITGNSSTEERVKFGK

SEQ ID NO: 12774 - protein, 81 aa, Mesocricetus auratus
AQSQLTFEDVAISFSKEEWKSLHTSQREMYRDVMLENYSHLVSVGLSDSKPELITYLEQKKEPWMENIQEVKGLEPGFVPK

SEQ ID NO: 12775 - protein, 81 aa, Mesocricetus auratus
MLENYSNLVSVGITVSKPELINSLEQSKDPWDVNTGEIEDKDQGNIDIRRHGHRHLSGGMGMPGFCTEILYKDIMLEACRN

SEQ ID NO: 12776 - protein, 81 aa, Mesocricetus auratus
QETVTFEDVAVNFTLGEWALLDSSQKKLYRDVMTETFMNLLSLGKTKGKENIEDNYQNLRKNVRTQVVERSCVYGDGSQCG

SEQ ID NO: 12777 - protein, 81 aa, Mesocricetus auratus
CARLVSFEDVTMNFSQEEWQYLNPAQRRLYQDVMLEVYSHLLAVGEHSQGPYSNPCVPLKESITSLVTSVLHCVPFTVPSN

SEQ ID NO: 12778 - protein, 81 aa, Mesocricetus auratus
VQEPVTFRDVALFFSQDEWLHLDSAQRSLYREVMLENYSNLASLGIQVSIPRVIHKLQKGQDPCMERKDLEDTCLDFQIWP

SEQ ID NO: 12779 - protein, 81 aa, Mesocricetus auratus
IAKSQETMTFKDVAMDFTPEEWGKLDPAHRDVMLENYRNLVSLWLPISKPDSYNLDDGKELLKLERKPPKCSNSDMETRPE

SEQ ID NO: 12780 - protein, 81 aa, Heterocephalus glaber
VQGCVTFEDVTIYFSQEEWGLLSEAQRLLYCDVMLENFALIASLGLTSFRCHVIAQLEVGKEPWVPDRVAMTSAMTRGAFG

SEQ ID NO: 12781 - protein, 81 aa, Heterocephalus glaber
TARSQETVTFKDVAMDFTPEEWGKLDPAQRDVMLENYRNLVSLWLPVSKPENYNLDNGMEPLKFERKPPKRSYSDMESIPE

SEQ ID NO: 12782 - protein, 81 aa, Heterocephalus glaber
GKEAVTFKDVAVVFSEEELGLLDSAQRKLYRDVMLENFRNLLSVGHQSFKPDVISQLEREEKLWMTEIQTQRGNRNQNKME

SEQ ID NO: 12783 - protein, 81 aa, Mus caroli
NAMAHQGTMTFGVVAVELFEEWRCMEPAQRDLYRNVTLKNFSYLVSLGLVIFKPDVIFLLEQGKEPWTVTNYMTHPWHPGK

SEQ ID NO: 12784 - protein, 81 aa, Mus caroli
DAVTYDDVHINFTQEEWVLLDLSQKRLYKDVILETYRNLTAIGYKWEEHNIEEHCQNSRIHGRQERSHPGDKLYEYRQCGK

SEQ ID NO: 12785 - protein, 81 aa, Mus caroli
AVTFRDVAVVFSEEELGLLDAAQRKLYHDVMLENFRNLLAVGCQSLNTMAPLDTTGIRCLPLGKLPCWQMTSHDVNKLARA

SEQ ID NO: 12786 - protein, 81 aa, Mus caroli
PCERWMFFEDVTVDFSQEEWQHLDSAQRCLYQEVMLEIYSHLLAVGYPRPEVILKMKKVKGPLMGKVDFPHQRCGQGEAEH

SEQ ID NO: 12787 - protein, 81 aa, Mus musculus
KPEAVSFADVAVYFSPEEWRCLRPAQRALYREVMRETYGLLASLGLGGAKPALICWVEEESEVWGPCAQDPEVAMCRTEVH

SEQ ID NO: 12788 - protein, 81 aa, Mus musculus
MEPVTFEDVAVNFSLGEWALLDSSQKKLYRDVMTETFMNLISIGKTEEKENIEDNYQNLRKNVRTWVECSVGSFIFTNSHR

SEQ ID NO: 12789 - protein, 81 aa, Mus musculus
MDLLTYDDVHVNFTQEEWALLDASQKSLYKGVMVETYRNLTAIGYSWEEHTIEDHFQTSRSHGRHERSSSAEQHSEFIQCG

SEQ ID NO: 12790 - protein, 81 aa, Mus musculus
MNAVTYEDVHVNFTQEEWALLDPSQKTLYKDVMLETYRNLSALGFSWEAQNIEEHCQSSRRHRRCERSQSAEKPSEYTQHG

SEQ ID NO: 12791 - protein, 81 aa, Marmota monax
SQASVSFRDVTVELTQEEWQHMGPAQRTLYREVMLENYSHLVSLGYCIFKPEVVLKLEQGEVPWFSEEESSNQNDPENYKV

SEQ ID NO: 12792 - protein, 81 aa, Marmota monax
TEGPLTFRDVAIEFSQEEWKFLVPAQRALYRDVMLETYRNLVFLGTCPSDLSVLSWLEQGRELWTVNGPEEISRPANEWAC

SEQ ID NO: 12793 - protein, 81 aa, Heterocephalus glaber
VTFEDVAVNFTLEEWVLLNSSQKKLYRDVMSEIFKNLAAIEPNWNGQQIENQCKCWRRNLRSEEIEEWCQYKLWYQHEDMF

SEQ ID NO: 12794 - protein, 81 aa, Heterocephalus glaber
DSVVFEDVAVQFTQEEWALLDSAQRDLYRDVMLETFWNLASINDESQFKARDSVSQQDIYGEKIPKKPEIAKLTKNDSWAS

SEQ ID NO: 12795 - protein, 81 aa, Heterocephalus glaber
AVTFKDVAVVFTTEELGLLDCTQKKLYEDVMVENFKNLVAVGHLPFKPDMVSQLEAEEKLWMMETETQRSSMNQNEMETLR

SEQ ID NO: 12796 - protein, 81 aa, Heterocephalus glaber
LQTLVTFKDVLLDFTREEWKLLDAAQQIMYKDVMLENYKNLVSLGHQLPKPDMILRLEKGEEPWLMEKGIYHGTYPETIAE

SEQ ID NO: 12797 - protein, 81 aa, Heterocephalus glaber
MLENYRHLVSIGYQVSKSNVVLKLKQGKEPWILEVEFPHHSGPKDPWDIHDLGARYQESPAGNSRQVQELIFKIEALTGEL

SEQ ID NO: 12798 - protein, 81 aa, Mus caroli
SLGPLSFKDVAVAFSQEEWQQLDPEERTTYRDVMLETYSNLVSLDEIRHMSRLMEEDQGGEENQTSSAVFSYRSRADASSK

SEQ ID NO: 12799 - protein, 81 aa, Mus caroli
MDALTYDDVAVNFTQEEWALLNASQKSLYKDVMLETYRNLNAVGYNWEDHNIEEHCQSSRRHGRNDRSLTGENPYEGIQCG

SEQ ID NO: 12800 - protein, 81 aa, Mus caroli
VTFEDVAVNFTLGEWALLDSYQKELYRDVMKETFSNLISIGKSEEDNIEDYQNIRRNLSTLMVEGFYEFERGIQYRETHQQ

SEQ ID NO: 12801 - protein, 81 aa, Mus caroli
VEEPVTFKDVAVAFTQEEWGQLDLVQRTLYRDVMLETYGHLLSVGNEIAKPEVISLLEQGEEPWSVEQGYPKSSCPEWMRN

SEQ ID NO: 12802 - protein, 81 aa, Mus caroli
FQGLLTFRDVAVDFSQEEWECLDSAQRALYIGVMLENYSNLVSVGIIVCKADLVPHLEQIYIPWNVKREEMVAKPGRENYR

SEQ ID NO: 12803 - protein, 81 aa, Mus caroli
MGVVTYDDVYVNFTREEWALLDSSQKNLYRDVMLETYRNLAAIGYSWEDHNTEEHFRSSRRRGRHEKSHIEEKPSEFTQCG

SEQ ID NO: 12804 - protein, 81 aa, Mus caroli
SQCLLTFGDVAVEFPQEEWECLDSAQRALYIDVMLENYSNLVSVENYCICDTVHQHVKTEKESCQCNNLGEMLRNPSHDAL

SEQ ID NO: 12805 - protein, 81 aa, Mus caroli
TQRSISFKDLAVDFTREEWQRLGPAQRLLYRDVMLENYSNLIAVGLHVSKPDVILKLEQGKEPWVVENSSRQNHAEDDEPL

SEQ ID NO: 12806 - protein, 81 aa, Neotoma lepida
MGKEVPVTFDDITLCLLQEEWTMLSQPQKDFSASDKLTAPLGGPTAANPELFHEFGQGTEPWLGKFQGQRRLLNHHPGKTH

SEQ ID NO: 12807 - protein, 81 aa, Mus musculus
NLVTYDDVHVNFTQEEGALLETSQKNLYKDVMLETYRNLSAIGYIWEEHTIEDHFQTSRSHGRHERSCIAVQPSEFIQCGK

SEQ ID NO: 12808 - protein, 81 aa, Mus musculus
VCGSVTFRDVAVDFSQEEWACLDATQKVLYRNIMLETYSNLVAVVGRCISKPDLIVLLEQEKEPWMAVKGETDRPSPDVET

SEQ ID NO: 12809 - protein, 81 aa, Mus musculus
DSTGCCERRLVKLRTPNMDLLTYDDVHVNFTQEEWALLDASQKSLYKGVMVETYRNLTAIGYSWEEHTIEDHFQTSRSLGS

SEQ ID NO: 12810 - protein, 81 aa, Dipodomys ordii
PKVPVAFDDVSIYFSTPEWEKLEEWQKELYKNIMKGNYESLISMDYAMNQPDVLSQIQPEGEHNPENQAGPEESAIPTDPS

SEQ ID NO: 12811 - protein, 81 aa, Dipodomys ordii
MAATATSAAAATAAEVAGHCVPKPKLIAKLEQGAEPWIREASDKNLTDVQEMEYRTKTCQKSPYDCLSEVGVMNSNTGEEN

SEQ ID NO: 12812 - protein, 81 aa, Dipodomys ordii
SKDLVTFGDVSVSFTQAEWECLNPTQRSLYRKVMLDNYRSLVSLGISIHKPDVITLLEQGKEPWKSRKEAPRGASQDWEYV

SEQ ID NO: 12813 - protein, 81 aa, Octodon degus
QVNFEDVFVGFSQEEWELLDEAQRFLYRDVMLENFALAASVGHWRGVQDTEIPCEQSISIKGVSQTWTPRGSPTQKAHSCE

SEQ ID NO: 12814 - protein, 81 aa, Octodon degus
FADLVTFEDVAVTFTPEEMSYLTASQRKLYREVMLENYQNLASLGHHFPKPDMISYLEEEASRTMEEDSNTMICKGRDSPD

SEQ ID NO: 12815 - protein, 81 aa, Octodon degus
MQAERFELDPESNAQAYPVSKPDIISKLEQGEDPWIIKTDMASCNYPDANYTDRKNIHHNSQSCTLGTFSFHDKVIKAVTQ

SEQ ID NO: 12816 - protein, 81 aa, Octodon degus
VTFEDVAVNFSREEWALLDPPQRKLYGDVMWETLRHLAAVGRNSEDRQIEDECRNSRNCLRSEEVEKSYQYKLWCQHAELA

SEQ ID NO: 12817 - protein, 81 aa, Octodon degus
AGQRRKYPCVRHQNQELAESVTFEDVAVTFTLEEWALLDPSQKKLYRDVMREIQQNMAAIGRNWENQQNDEKYKNSWRHLR

SEQ ID NO: 12818 - protein, 81 aa, Octodon degus
VETVTFEDVAVNFTSAEWDLLNPAQKKLYRDVMWETLMNIKGLGRTLATKRMGEVDKNCSGNLRYDTENSFRFEEKLYKCK

SEQ ID NO: 12819 - protein, 81 aa, Octodon degus
QVSVTFEDVAVRFTAEEWGLLDLSKRTLYWEVMLETCGLLLAVGNSTKPSTTKPSAVYQAWPEESWLHDQETEGTCGGSLL

SEQ ID NO: 12820 - protein, 81 aa, Octodon degus
SQGSVSFKDVTVGFTQVEWQHLDPSQKSLYRDVMLENYSHLVSVGYCVTRPELIFRLEQGEEPWVLEEEFPRPGFLEFWKT

SEQ ID NO: 12821 - protein, 81 aa, Octodon degus
VQEPVTFRDVAVLFSQDEWLQLDPGQRRLYREVMLENYSNLVSLGILFSKPEVISQLEQTGGTQVVGTGAPRGVYLGWESF

SEQ ID NO: 12822 - protein, 81 aa, Fukomys damarensis
AEARGGSVMFSDVSIVFSQDEWEYLDLEQRDLYRNVMMENYSNLVSLVNDEVVNLKRSSSPVGIHLNIWQALNFSCELHLC

SEQ ID NO: 12823 - protein, 81 aa, Heterocephalus glaber
VTFEDVAVNFTQEEWALLKPSQKNLYRAVMQETFWNLASVGRPHECNKCDKAFKWPCDLRNHERTHTGEKPYTCVQCGKTF

SEQ ID NO: 12824 - protein, 81 aa, Heterocephalus glaber
RESGKAPVTFDDITVYLLQEEWLLLSQQQKDLCGSDKLVAPLGATVAGPNLFGEFGRGSKPWVGDIHSQRSLLGHHSGKNQ

SEQ ID NO: 12825 - protein, 81 aa, Mus caroli
NKKPVVFSDVSLDFSQEEWECLGPAQRDLYKDVMLENYSNLLAVGLHIPKPQVISLLEQGKEPWMIGKELTRGLCSALESM

SEQ ID NO: 12826 - protein, 81 aa, Mus caroli
MATSEPAESDAVRAKEWEQLEPVQRNVYKDTKLENCSNPDSMGNQDTKQDIVSKLEEEEPSSGKGKKTSPSSLDKIARPKK

SEQ ID NO: 12827 - protein, 81 aa, Mus caroli
PQSQLTFKDVVVDFSQEEWECLDCAQRALYMEVMLENYNNLFFVENHCMCPKFENMLDQDLQHIVHEHVNIQVKSYECHEL

SEQ ID NO: 12828 - protein, 81 aa, Mus caroli
MDALTYDDVHVNFTQEEWALLNPTQRNLYKDVMLEIYRNLKAVGYNWEDQNTEEYCQSSRRHGRHERSHTGEKPSENTQCG

SEQ ID NO: 12829 - protein, 81 aa, Mus caroli
MEDPLSFTDVAIDFSADECECLDSAQWNLYKEVMLENYSNLVFLGLAFSKPHLVTFLEQSSDPWSVKRKASATIPLGSKPH

SEQ ID NO: 12830 - protein, 81 aa, Mus caroli
MDAVTYDDVHVNLTQEEWALLDPSQKCLYKDVMLETYKNLTAIGYNWEYHNIEEHCQSSRRHGRYERSHTGEKHSEYTQCG

SEQ ID NO: 12831 - protein, 81 aa, Mus caroli
SKGLLTFMDVAIEFSKEEWGCLDSAQRTLYRDVMLENYNNLVSLGVAVSKPEVIVCLEQNNEPWIAGREDTERKKNSLYVD

SEQ ID NO: 12832 - protein, 81 aa, Mus caroli
PQGLLIFKDVALDFSLEEWECLNFAQRTLYMDVMLENYNNLLFVEKHCICGKYGKVLDEDIQYIVHKHMNIQEKSSKCNKL

SEQ ID NO: 12833 - protein, 81 aa, Mus caroli
TRDAVTYEDVYVKFTHEEWALLNPSQKSLYKDVMLETCRNLTAIGYKLEDNIEEHCHSSRGRGRYKSCEHKGHGKKQCTFA

SEQ ID NO: 12834 - protein, 81 aa, Mus caroli
MATSEPAESDAKEWEQLEPVQRNVYKDTKLENCSNPDSMGNQDTKQDIVSKLEEEEPSSGKGKKTSPSSLDKIARPKKAGT

SEQ ID NO: 12835 - protein, 81 aa, Mus caroli
MASPSPPLEPKEEWGYLDPAPKSLYKDVMMDSYGKLVSLDVLNRNKDEEPTVKEELEKDIEPQGVIVTRIKSEIDQDPMGS

SEQ ID NO: 12836 - protein, 81 aa, Mus caroli
MEFLAFEDVAVEFSQEEWVLLDPSQKKLYRDVMLETCSNLTSIGIKWEDKNIEEQYKHSWRFLRSCMIDAIYEHKEGGQFQ

SEQ ID NO: 12837 - protein, 81 aa, Mus musculus
DLVTYDDVHVNFTQEEWALLDPSQKSLYKGVMLETYRNLTAIGYIWEEHTIEDHFQTSRSHGRRRSPRDPQITGPAGRVKW

SEQ ID NO: 12838 - protein, 81 aa, Mus musculus
SKGPLTFMDVAIEFSKEEWECLDSTQRALYRDVMLENYNNLVSVGGAVSKPEVIFCLEQNKETWIIGSEDTEGKESALSCD

SEQ ID NO: 12839 - protein, 81 aa, Mus musculus
MLENFSHLVFLGFSFSKPLLVRFLEKNQELRNVKRKAATVPRGKKPYKCKECGKAFAKSSVLTQHLRIHTGEKPYTCDICD

SEQ ID NO: 12840 - protein, 81 aa, Mus musculus
PQGLLTFKDVALDFSLEEWERLSFAQRTLYMDVMLENYNNLLFVENHCIRGKYRKVLDQDSQYIVHEHMNIQEKSSKWDKL

SEQ ID NO: 12841 - protein, 81 aa, Mus musculus
YVELVSFEDVTVKFTWEEWQNLNDAQKMLYRSVVLETYNSLLSLGQCIPKPELIFKLEQGEEPWTAEEPANKTLPVFCSVD

SEQ ID NO: 12842 - protein, 81 aa, Mus musculus
MDLVTYEDVHVNFTQEEWALLDPSQKSLYKDVMLETYRNLTAIGYKWEDFNIEEHCKCPKRHERYIICHSGFKPCEDKQYK

SEQ ID NO: 12843 - protein, 81 aa, Mus musculus
MDVLTHDDVHVNFTREEWALLNPSQKSLYKDVMLETYRNLNAIGYNWEDNNIEEQCQSSRRNGRHERRLIGEKRSENIQCG

SEQ ID NO: 12844 - protein, 81 aa, Dipodomys ordii
VKKLVSFDDVAVDFSWEEWQYLDIAQRTLYRDVMLEIYRNIVSLGHCVPKPNLIVKLEQAVEPRIREASSKNFTNIQEMED

SEQ ID NO: 12845 - protein, 81 aa, Octodon degus
GGEAVTLKDVTMAFTQKEWKKMDPAQRDLYKDVMLENYSNLAIVGYQSSKPDMICKLEKGEEPWSRKGKRSNQSHLRKLAR

SEQ ID NO: 12846 - protein, 81 aa, Octodon degus
AEELLTFRDVAIDFSPEEWECLDPAQWNLYRDVMLENYRNLVFLGLAVSKPCLVTFLEQWKEFWNVEREEVVAVYPAVSYY

SEQ ID NO: 12847 - protein, 81 aa, Octodon degus
SLGSVTFTDVAIDFSQDEWEWLNLAQRSLYRNVMLENYRSLASVGLCISKPDMISFLEQEKDPWVVPGEMSGSPCTDLEYM

SEQ ID NO: 12848 - protein, 81 aa, Rattus norvegicus
MLSFRDVAVDFSPEEREYLGPSQWSLYRDVMLENYSNLVFLGLAVAKPYLVTFLEQTQGSSGVKRQEAATIPPGTTGNEFN

SEQ ID NO: 12849 - protein, 81 aa, Peromyscus maniculatus
MEEILSFWDVAIDFSAEERKCLEPAQWNLYRDVMLENYSNLVFLGLAESKPHLVTLLEQRQESSDVKRQAAANMQPGTTPN

SEQ ID NO: 12850 - protein, 81 aa, Peromyscus maniculatus
TAKSQETVTFKDVAMDLTPEEWGQLDPAHRDVMLENYRSLVSLWLPVSKPDDYNLDAGKELLELEEKPPKCSYSDVETRPE

SEQ ID NO: 12851 - protein, 81 aa, Peromyscus maniculatus
PQGLLTFRNLAVDFSPEEWECLDSSQRSLYMDVMWENYSNLVFVENHCICGKYEKVLDQDSKHIVHEDVNIQEKSYKCCEL

SEQ ID NO: 12852 - protein, 81 aa, Peromyscus maniculatus
AAHTGDLGVDLETMTFEGIAVIFTLEEWALLGPSQMKLYRDVMEETFRNLVSIEQAQECQNIEDNHKISWRLSSWEFNAFF

SEQ ID NO: 12853 - protein, 81 aa, Peromyscus maniculatus
QVDAVTFEDVAVDFTQEEWTSLDPIQRNLYRDVMLENYQNLATVGGQLFKPSLISWLERKVELTVMEQGILQEWELHLQTK

SEQ ID NO: 12854 - protein, 81 aa, Peromyscus maniculatus
AQELVTFRDVAIDFSEEEWECLNIEQKTLYTDVMMETYSHLISVGFCVHLPHLFSLLEKRKDPRMILMDETRGLYPDIDFS

SEQ ID NO: 12855 - protein, 81 aa, Peromyscus maniculatus
MEEMLSFWDVAIEFSAEERECLEPAQWNLYRDVMLENYSNLVFLGLAVSKPHLVTLLEQRQDSSDVKRRAAANVQPGTTFN

SEQ ID NO: 12856 - protein, 81 aa, Peromyscus maniculatus
HKEMLSFWDVAIDFSPEERECLEPAQWNLYRDVMLENYSNLDFLGLVLSKPHLVTFLEQKQGPMGMKKQVAATVHTGKTDN

SEQ ID NO: 12857 - protein, 81 aa, Peromyscus maniculatus
ETMTFEGIAVIFTLEEWALLGPSQMKLYRDVMEETFRNLVSIEQAQECQNIEDNHKISWRLRSEVVHSLGEHKGSECGEIF

SEQ ID NO: 12858 - protein, 81 aa, Peromyscus maniculatus
KGRVTFEDITVTFTPEEWQGLNPEHRHLYKDVMLENYSNLASVEKDQDIERQGGMNINLEKSLKRGVVSIHKKTFTKQNVP

SEQ ID NO: 12859 - protein, 81 aa, Mesocricetus auratus
PQSLLSFRDVAVHLSQEEWECLDCSQRDLYMDVMLENYNNLLFVENHCICGKYETVLDQGTKHIVHDHVNIQRKLSQYNEL

SEQ ID NO: 12860 - protein, 81 aa, Mesocricetus auratus
KPELVSFADVAVYFSPHEWGCLRPAQRALYRDVMRETYGLLGALGFPGPKPALISWMEQESEAWSPAAQDPAEGEILGGAL

SEQ ID NO: 12861 - protein, 81 aa, Ictidomys tridecemlineatus
SQELLTFKDVSVDFTQEEWGQLALDHQNLYREVMLENYGNLVSVGYQLCKPVVISQLEKGEEPWLTEKKISGGSCSDLANK

SEQ ID NO: 12862 - protein, 81 aa, Heterocephalus glaber
LVTFEDVAVSFTQEEWALLDPFQKNLYRDVMRETLSNLAFVGRPCQKIKTILKALIIFLFSYRRHVVERLWEGVKGAQRRE

SEQ ID NO: 12863 - protein, 81 aa, Heterocephalus glaber
VKESVTFKDVAIDFTLEEWRLMDPTQRKLHKDVMLENYRNLASLGLAVSKPDMISHLENGKGPWTVVRKISRTPYPDLETK

SEQ ID NO: 12864 - protein, 81 aa, Neotoma lepida
AQQQHCFGVHGRSQDEVCRHWTGRLSLRRSAISSVYTFPRAAENEQIKGYDVTKPNVIIKLAQGEEPWTVEGDCHVQSHLG

SEQ ID NO: 12865 - protein, 81 aa, Fukomys damarensis
LGLVTFTDVAIDFSQDEWEWLNLAQRSLYRKVMLENYSNLVSVDLKYMWLFKELSSNQDIYEENLSKEEPTSCFTLGENLK

SEQ ID NO: 12866 - protein, 81 aa, Rattus norvegicus
DAVTFNDVHVDFTSEEWTLLDPSQKGLYKDVMLETYWNLTAIGYSLEDHNIEEHFQSSRRHGRPERSHTEEKPYEDMKCGE

SEQ ID NO: 12867 - protein, 81 aa, Rattus norvegicus
AAVTYEDVHVNFTHEEWALLDPFQKSLYKDVMLETYWNLTAIGYKLEDLNSEEHSPRSRRYERHNICHSGYKPCERKGYGK

SEQ ID NO: 12868 - protein, 81 aa, Dipodomys ordii
LHGSVSFKDVTVDFTPEEWGHLDGAQRSLYRDVMLENYSHLVSVGYYVSQPEVIFKLEQGAEPWTLKEEFPSQNFPDLWNA

SEQ ID NO: 12869 - protein, 81 aa, Octodon degus
SQGLVTFKDVAVCFSQDQWSDLDPTQKEFYGEYVLKEDCGIVVSLSFPIPRLDDISQVREEEPQVPGIHEPQEPEEPEILS

SEQ ID NO: 12870 - protein, 81 aa, Octodon degus
FQELVTFQDVAVDFTPEEWQLLDCNQRMMYWDVMLDNYRNLISVGSLVTKPEVILKIEQGQEPWLEEEENLHWSYPKADCP

SEQ ID NO: 12871 - protein, 81 aa, Octodon degus
MLETYRNLVSLGLAASKPGVISCLEQGRAPWVEETVTAGGPCPVSDSECYTKVPSPKRDVRDAESPLWETLGCLTSYDVEC

SEQ ID NO: 12872 - protein, 81 aa, Octodon degus
MVENFKNLVAVGHLPFKPDMVSQLEAEEKLWVMETETHGNCINQNEMTTLQRFTVKYLSELSCWQIWKHVASELTRCLHRT

SEQ ID NO: 12873 - protein, 81 aa, Octodon degus
PKAPVSFEDVSVYFTKAEWKFLDFKQKALYKQVMLENYRNLASLGLASSKPYLVAQLERGAGPWVANLHSKAGGRIQCPRA

SEQ ID NO: 12874 - protein, 81 aa, Octodon degus
AVTMEDVTVTFTNEEWALLNPAQKRLYGDVMWETFRTISAIGRTWDSQQMEEEYKNYLRNLSNEEVAKCCRYTTFNQHENI

SEQ ID NO: 12875 - protein, 81 aa, Fukomys damarensis
MEQKLEQLLEHKRLHIIKVSGNQLLKPDMILRLEKGEEPWMMDKGFYHGTYPDSETAAEIKSSVSRKTISKEEQSCGIKVE

SEQ ID NO: 12876 - protein, 81 aa, Rattus norvegicus
FQDLLSFTDVAIDFSADECECLEPAQWNLYKEVMLENYSNLVFLGLAFSKPYLVTFLEQSSDPWSMKRKASAAIHLGLKPH

SEQ ID NO: 12877 - protein, 81 aa, Dipodomys ordii
VVTQLTFEDVAVDFTPGEWQCLTPAQRALYRDVMLDTYRNLVFVGVSPPNMSVLSLLELRKESWMAQSHMTTPRELSGWER

SEQ ID NO: 12878 - protein, 81 aa, Dipodomys ordii
QLGLVSFEDVILHFSPEEWELLDEAQKLLYCDVMLENFALLASLGLTAFRSHVVARLEMENKPWIPDRGAMTSAMARGVCG

SEQ ID NO: 12879 - protein, 81 aa, Octodon degus
GVTFEDVAVTFTKEEWALLDSSQKKFYGDVMWETFYNVSAIGRNWDNQQIEDEWQQYLRRNLRCEEAVECRQNKSGHEDGE

SEQ ID NO: 12880 - protein, 81 aa, Octodon degus
EAVTFEEVAVTFTTDEWFLLYPSQKELFRDVMWETFRNVSFVERNWDDQKTEDEYESCQRNLRSEEVEKWHQLELLYQYEE

SEQ ID NO: 12881 - protein, 81 aa, Octodon degus
MELLTFRDVAIDFSLEEWEDLDSAQQNLYRDVMLETYGNLVSLGLADSKPYMITCLEQSKEPWNVKKQESVVIHPAVSSHF

SEQ ID NO: 12882 - protein, 81 aa, Fukomys damarensis
SVSFEDVFVSFTWEEWQVLDNAQRTLYREVMLETYSSLAVLGHCITKPEVIFKLEQGAEPWMREEPPNLSPPDVQKVDHIL

SEQ ID NO: 12883 - protein, 81 aa, Fukomys damarensis
ACLVLGVFLRFRDTPVGWMCTLSLAIPVDVVPQFTTTRVWLEKESTGGHQIAKPDVISLLEQGEEPWFVEPVHPRSSCPGK

SEQ ID NO: 12884 - protein, 81 aa, Fukomys damarensis
EAVTFEDVAVDFTLEEWALLDPSQKKLYRDVMSETLKNMSAIEHTQTDQQMENGSEYWQRNLRSEDVEKCYQYKLWNPHRD

SEQ ID NO: 12885 - protein, 81 aa, Fukomys damarensis
EPILFDDLAIYFSQEECVSVDPAQKSLTREATQECSNNVTLMGGESNTEINEMLTLESLEIEEFSLENYSTAVPLVHSQRS

SEQ ID NO: 12886 - protein, 81 aa, Fukomys damarensis
MEEWALLNPSQKKLYRDVMWETVMNMTAIGRTWDNQQIEEEYKNCSKNLRNEEIAKCYQHKAWTQHENIFLWTPDASVVMQ

SEQ ID NO: 12887 - protein, 81 aa, Fukomys damarensis
MLETYSSLVSLGHRNPKPEVIVKLEQGRQPWMGEGPPSQTFSGHCTPSPEETIKLEQGAQPWMGEEPPSQTLSDVQKAEDP

SEQ ID NO: 12888 - protein, 81 aa, Fukomys damarensis
MVMLENYESIVSLGLPVPPPDVIFWLKRGNEPWIEGLPGSEERECPQSISLDWETKLKTQDASKEENPEETLRQSLSRQSL

SEQ ID NO: 12889 - protein, 81 aa, Fukomys damarensis
LQELFSFEDLSVDFTQKEWQLLGPHQKNLYRDVMLENYSSLVSLGYTVMKPDVIFKLEQGEEPWVGDGKVQHSDCPEVWQV

SEQ ID NO: 12890 - protein, 81 aa, Rattus norvegicus
VMGLVSFEDVSVDFTWDEWQDLDDAQRKLYREVMLETYSSLLSLNQCDAKPELILKLEQGAEPWKEDGAADPSLEALQPVK

SEQ ID NO: 12891 - protein, 81 aa, Rattus norvegicus
MAVSVMFSDVSVVFSKEEWDCLDLDQRTLYRDVMMENYHNVLSLGCFISKPDVISLLEQGKEPWKRRRCPDSGVKDETHQL

SEQ ID NO: 12892 - protein, 81 aa, Mus musculus
MEEMLSFRDVAIDFSEEEWECLEPAQWDLYRDVMLENYSHLVFLGLAFSKPYLVTFLEQRREPWNVKEAATVAAHPGIKPY

SEQ ID NO: 12893 - protein, 81 aa, Mus musculus
PQGLLSFKDVALDFSLEEWECLSFAQRSLYMDVMLEDYNNLLFVENHCIHGKYEKVMDQDSQYIVLEHMNIQEKSSKWNKL

SEQ ID NO: 12894 - protein, 81 aa, Mus musculus
SAIEEDVVTYDDVHVNFTGEEWNLLDPSQKSLYKDMMLETYWNLTVIGYTWENHHIKRHCQSSRRNESPSSLPGFQNAFLG

SEQ ID NO: 12895 - protein, 81 aa, Dipodomys ordii
KEDSVAFSDVVVAFTPEEWRLLSPAQRTLHKEVMLETYNHLISLEILLSKSKLISNMEQVEEPGRGDRKYSPESCPAGSMP

SEQ ID NO: 12896 - protein, 81 aa, Dipodomys ordii
AHDLVMFRDVTVDFSQEEWECLTSYQRNLYRDVILENYKNLVSLGCSISKPDVISLLEQGKEPWIVVREERRRWSLDLESR

SEQ ID NO: 12897 - protein, 81 aa, Dipodomys ordii
AELPVVFEDVAVYFTQEEWGLMDKRQKCLYRDVMRMNYELLASLGPAAAKPDLILKLERRATPWIKDPNQLKSGKGHPSVK

SEQ ID NO: 12898 - protein, 81 aa, Dipodomys ordii
SLELVSFEDVSVDFSWEEWQDLSSAQRTLYRDVMLETYSSLASLGHFMTKPAVIFKLEQGAEPWMVKGPPNQSCSEIQRFE

SEQ ID NO: 12899 - protein, 81 aa, Dipodomys ordii
MKGFVSFEDVSVDFTWEEWQDLDDAQRRLYRDVMLETYSSLASLGHCIVKPEVIFRLERGSGPWMVEAATSWSYTDVQKEN

SEQ ID NO: 12900 - protein, 81 aa, Octodon degus
VTMEDVAVNFTKEEWALLNPSQKKLYRDVMWETFRNIKAIGRTWDNQMEEKYKNCSRNLRNDEGAKCYQYKACNQPENRSN

SEQ ID NO: 12901 - protein, 81 aa, Octodon degus
PVSLEDVAVTFTLEEWALLNSSQKKLYRDVMWETFMNLTDIGRTWDNQQAEEYKTCLRNLSNEEVAKWYQYKSWNQYGNVF

SEQ ID NO: 12902 - protein, 81 aa, Octodon degus
KRGVVRFADVAVYFSPEEWGCLRPAQRTLYRDVMRETYGHLGALGFPGPKPALISWMEQESEAWSSAAQDPEERESPVGAL

SEQ ID NO: 12903 - protein, 81 aa, Octodon degus
FQESVTFKDVVVDFTQEEWKQLDPGQRDLFRDVTLENYTHLVSIGLQVSKPDVISQLEQGTEPWTVEPSVTVGTCGDWEPR

SEQ ID NO: 12904 - protein, 81 aa, Octodon degus
MASPSSPLEPKEWDYLDPAQRSLYKDVMMENYGNLVSLDVLNKDKDEEPSVKQEIEELEEEVEPQGVIVTRIKSEIDQDPM

SEQ ID NO: 12905 - protein, 81 aa, Octodon degus
VTFEDVTVDFTQEEWALLDRGHRDLYREVMLENYENLASVECAVRLSTSEYIHQPEFLMEQSSGGQHMERRKSVGELQQSC

SEQ ID NO: 12906 - protein, 81 aa, Fukomys damarensis
MDTTQRKLHKDVMLENYRNLVSLGLAVSKPDMISHLENGKGPWTLVREISRTPYPGLWKWSDRIFRWQNSQESHLNQRIVT

SEQ ID NO: 12907 - protein, 81 aa, Rattus norvegicus
DVVTYEDVHVNFTQEEWALLDPSQKRLYKVVMLETYKNLSAIGYIWEDHTIEQHFQSSRSHGRHKRHRTGEQPSELIQHGK

SEQ ID NO: 12908 - protein, 81 aa, Rattus norvegicus
MQGFLTFKDVAPEFTLEEWESLSFAQRALYMDVILETYYNLLSLENYVICEKHGKVLDRDTECVVDEHVNIQEKFCKWEEI

SEQ ID NO: 12909 - protein, 81 aa, Mus musculus
MLENYRNLVSVGYQLSKPTVISQLEKGEGPCMAESQGPEDPILDVKNKLETKESTAEDDISVKLDHGITRGRLIEDDIVCS

SEQ ID NO: 12910 - protein, 81 aa, Mus musculus
ELKREWGELGICAMDLVTYEDVHVNFTQEEWALLDPSQKSLYKDVMLETYRNLTAIGYKWEDFNIEEHCKCPKRHERSHHL

SEQ ID NO: 12911 - protein, 81 aa, Dipodomys ordii
TARSQERVTFKDVAMDFTPEEWGKLDPTQRDVMLENYRNLVSLWLPISKPENYNLDNSKEPLKLEKKVSKCSYSDLESRPE

SEQ ID NO: 12912 - protein, 81 aa, Dipodomys ordii
PKAPVTFGDLAIHFSQEEWEWLSPTQKDLYEDVMLENFQNLVSLGLCCRRPNVITLLEMGKAPWMVEPKSCRGPDSGSQCV

SEQ ID NO: 12913 - protein, 81 aa, Dipodomys ordii
SLKLVSFDDVAVDFSWEEWQDLDLAQRTLHRDVMLETYSNLLSVGYCVPKPKLIAKLEQGAEPWRREASDKNLTDVQEMEY

SEQ ID NO: 12914 - protein, 81 aa, Dipodomys ordii
SLKLVSFHDVAVRFSWEEWQHLDLAQRTLYRDVMLETYSNLVFLRHCAPKPKLIVKLEQGAEPWRREASDKNLTEHSVHCQ

SEQ ID NO: 12915 - protein, 81 aa, Dipodomys ordii
QLVCGTFQDVVIYFSPEEWKFLNVAQRHLYLSVMLETFALRTSVGCGHRVGGKEVCGHSGSVAGVAFSRTPATDASSLRAR

SEQ ID NO: 12916 - protein, 81 aa, Octodon degus
FQELVTFGDVAIDFSQQEWEYLDSRQRDLYRDVMLENYRNLVSLGQSISKPDVIDLLEQGKEPWMILREETRRPYTDLDLQ

SEQ ID NO: 12917 - protein, 81 aa, Rattus norvegicus
LTFKDVAVDFSQDEWEYLDCAQRALYVDVMLENYKNLFFVESHHLCHKYENILDEDTQCIVHKHVNIQSYKCHELGNPIPE

SEQ ID NO: 12918 - protein, 81 aa, Rattus norvegicus
QGMLAFRDVAVEFSQEEWGCLDSAQRALYIDVMLENYNNLVSVENYCIHDTVHQHVNTEKESCQYNELGKILHEHFKCALY

SEQ ID NO: 12919 - protein, 81 aa, Mus musculus
DVVTYDDVHVNFTWEEWSLLAPSQKSLYKDVMLETYSNLTAIGCNWEEHNIEEYCQSSRRHGRHERSLTGEKPSEYTQCVK

SEQ ID NO: 12920 - protein, 81 aa, Mus musculus
DAVTYDDVHVNFTGEEWKLLDPSQKSLYKDVMLETYWNLTVIGYTWENHQIERHCQSSRKNERFNLPMPVAMGKPKQPAVS

SEQ ID NO: 12921 - protein, 81 aa, Mus musculus
RRLVKLRTPNMDLVTYDDVHVNFTQEEWALLDASQKSLYKGVMVETYRNLTAIGYSWEEHTIEDHFQTSRSHGSYSPDILW

SEQ ID NO: 12922 - protein, 81 aa, Dipodomys ordii
NFWILRLPPGSKGEAPKEWGKLEDWQKELYKHVMRGNYETLVSLDYAISKPEVLSQIEQGKEPCSWRRAGPKVPEVPVDPS

SEQ ID NO: 12923 - protein, 81 aa, Dipodomys ordii
MPLTFQDVAVYFSQAEGQQLGPQQRALYRDVMLENYGNMASLGFSIPKPELISQLEQGEELWVLDLLGAEEPEVLRTCQTD

SEQ ID NO: 12924 - protein, 81 aa, Dipodomys ordii
CCENLSFDDVAVDFTWKEWQDLDPGQRTLHRDVMLETYSNLMSLGLCVPKPKLIVKLEQGAEPWIREGSEENFTDVQEMED

SEQ ID NO: 12925 - protein, 81 aa, Dipodomys ordii
EKKLVSFDDVAVDFSWEEWQDLDHAQRTLHRDVMLETYSNLLSLGHCVPKPKLIAKLEQGAEPWIREASDKNLTDVQEKEY

SEQ ID NO: 12926 - protein, 81 aa, Dipodomys ordii
ASQGAELFRDMAIISSQEEWECPELPQRALYKDVMLETYRNLISLGLTIFKPDVIFLEQGRMPWTEEWAATGGLGPVLELG

SEQ ID NO: 12927 - protein, 81 aa, Dipodomys ordii
SLKLVSFDEVAVDFSWEEWQDLDFSQRTLYRDVMLETYSNLVSLGHCVPKPKLIVKLEQGAEPWIGEASDKNFTDVQEMEE

SEQ ID NO: 12928 - protein, 81 aa, Octodon degus
PKVPVAFDDVSIYFSTPEWEKLEEWQKELYKNIMKGNYESLISMDYAMSQPDVLSQIQPEGEHNTKDQAGPGESEIPAVPR

SEQ ID NO: 12929 - protein, 81 aa, Octodon degus
LTETITIEDVTIRFTPEEWALLDTTQRKLHRAVMLETIRNLQSLGCQYGKSDFVFHKDETQILWKGEQRAFPRNHNACKNE

SEQ ID NO: 12930 - protein, 81 aa, Octodon degus
SQELVTFEDVAVYFIRKEWKRLEPAQRNLYRDVMLENYGNVFSLDSESRTESDREISEDSGSHGMLLGRFQKDISQGLKFE

SEQ ID NO: 12931 - protein, 81 aa, Octodon degus
GVFKVTFSDVAVDFSCEEWGWLDSAQRDLYKGVMVQNYKNLASLGLSVTKPHVIYLLENGKEPWVVEKALSKGMFLDWESK

SEQ ID NO: 12932 - protein, 81 aa, Octodon degus
LLPAAGCGKDSGTPATEAVTFEDVAVNFSREEWALLDPPQRKLYRDVMWETLRHLAAVGMNSDDRQIEDVYKICRKNLSGA

SEQ ID NO: 12933 - protein, 81 aa, Octodon degus
SWPQKLVTFEDVAVYFSQTEWDALSPAQRALYRDVMLENYGNVASLGFPFLKPAMISQLERGGELEHPLPLATGSGIGPQG

SEQ ID NO: 12934 - protein, 81 aa, Octodon degus
EAVTMEDVAVNFTKEEWALLNPSQKKLYRDVMWETFRNINAIGRTWDNQQMEEHKSCSRNLRDEELPKCCQYAPCSQHENI

SEQ ID NO: 12935 - protein, 81 aa, Octodon degus
QGSVTFEDVAVYFSWEEWDLLDEAQRHLYLDVMLENLALMSSLGYSCGVEDEVAPSRLGFSVESPQIGTPKEESSSQNDCA

SEQ ID NO: 12936 - protein, 81 aa, Octodon degus
VVTFEDVAVNFTLEEWALLDPSQKKLYRDVMRETFRNIAAIGKAWDNQEVEEQYKSFWRNLRNKEVKKCYQNKGWSQYEEI

SEQ ID NO: 12937 - protein, 81 aa, Octodon degus
QGSVTFEDVAVHFSWDEWHLLDKAQRCLYRDVMAENLALITSLDTHQHEKLQFVWQCFRSKGSRSLFVNRSKFRVAWEQFA

SEQ ID NO: 12938 - protein, 81 aa, Neotoma lepida
GPISFRNVDVDFSKEEWEYLDCAQRALYMDVMLENYNNLVFVEYHRICDKYGKVLDQGTKHIVHEHVNIQEKPYKCNDLGK

SEQ ID NO: 12939 - protein, 81 aa, Mus musculus
GFATKKTSRTEDRGAMAADPNFQQKSQPLGAEEQPESCERWMSFEDVTVNFSQEEWQHLDSAQRCLYQEVMLEIYSHLLAV

SEQ ID NO: 12940 - protein, 81 aa, Mus musculus
MLENYSNLVFLGLAFSKPYLVTFLEQSSDLWSVKRKASVAIHLGSKAHKCKECGKSFDRNSVLIQHQRIHTGERPYKCEEC

SEQ ID NO: 12941 - protein, 81 aa, Mus musculus
AEEFETLKDLAMDFTVEDWKDLESEWDQRDLFWDVTLNHYQDMFSFTDTSQPSLTSQPDVREELEATSTEVPETKSSPLQS

SEQ ID NO: 12942 - protein, 81 aa, Rattus norvegicus
DMGLVSFEDVAVDFTWQEWQELDAVQRTLYRDVMLENYRSLVWLGYCLVKPELISKLEKGFEPWDVAEAIEQCLPDVHKWS

SEQ ID NO: 12943 - protein, 81 aa, Rattus norvegicus
IKDLLSFTDVAIDFSPEECECLEPAQWNLYKEVMLENYSNLLFLGLAFSKPYLVTFLEQSSDPWRVRRKASAAIHLGSKAH

SEQ ID NO: 12944 - protein, 81 aa, Rattus norvegicus
MVQFPIPQWFSYTTVGPNLLFLLTGYDVTKPNVIIKLEQGEEPWTVEGDRHAKRHLEIKKVDDPREGIQENGEKHLQCGDD

SEQ ID NO: 12945 - protein, 81 aa, Mus caroli
EDAVTYDDVHVNFTGEEWNALDPSQKSLYKDVMLETYWNLTVIGYTWENHHIERHCQSSRRNERFSLHCQLPWTSRIASCV

SEQ ID NO: 12946 - protein, 81 aa, Mus caroli
VCGSVTFRDVAVDFSKEEWACLDATQKVLYRDIMLETYSNLVAVVGRCISKPDLIVLLEQEKEPWMAVNEETGRPSSGLEA

SEQ ID NO: 12947 - protein, 81 aa, Mus caroli
GCVTFEDVAVYFSQEEWELLDESQRLLYLDVMLENFTLITSLAHWSEAEAEDKTCVPHIRTAKEGLPTKKPHPSDICSAVL

SEQ ID NO: 12948 - protein, 81 aa, Mus caroli
RPRALKFADVAVYFSSEEWGCLQPAQRTLYRDVMRETYGLLGALGCAGPKPALISWLERNPDDWEPAALDPQEYRRWVTFQ

SEQ ID NO: 12949 - protein, 81 aa, Mus caroli
ARVSVVFSDVSIAFSQEEWESLDLEQRNLYKDVMMENYHNVASLGCFIAKPDVISLLEQGKEPWKVVRQRKPCPDSETKDE

SEQ ID NO: 12950 - protein, 81 aa, Mus caroli
SQGLLTFRDVAVDFSQEEWECLDSSQKALYIDVMVENYSNLVSVENYCICDTVHQPVRTEKESCQCNELNEMRHEPSNCAL

SEQ ID NO: 12951 - protein, 81 aa, Mus caroli
SQESLTFKDIAVDLSQEEWGQLAPAYRDLYREVMLENYRNLVSVGYQLSKPTVISQLEKGEGPCMAESQGPEDPILDVKNK

SEQ ID NO: 12952 - protein, 81 aa, Mus caroli
SVTLEDVAVNFTLEEWTMLNASQKELYKDVMQDTLRNLSYIGNKWEHQNIENECETLWRKLRTSCQEKSLWRYNSQLLETL

SEQ ID NO: 12953 - protein, 81 aa, Mus caroli
EKNAVTYEDVHVNFTQEEWALLDPSQKKLYKDVMLETYRNLSALGFSWEAQNIEEHCQSSRRHRRCERSQSAEKPSEYTQR

SEQ ID NO: 12954 - protein, 81 aa, Mus caroli
VTLEDVAVNFTLEEWTMLNASQKELYKDVMQDTLRNLSYIGEGNKWEHQNIENECETLWRKLSQLLETLCEYTEGRQRAET

SEQ ID NO: 12955 - protein, 81 aa, Mus caroli
PITFDDVAIIFSPEEWECLDSAQRDLYRDVMVENCRNLLSVEASRHGTKGFSSKKDMKRSFQEELSRRLSKCGADIFHPRK

SEQ ID NO: 12956 - protein, 81 aa, Neotoma lepida
MRGIWGREGSDDREEGVGALDLRACISKPHLISLLEHGKEPWEVKGEVTRSTLRDGEPVHKTQLSLKQFVSDNVSVEKITS

SEQ ID NO: 12957 - protein, 81 aa, Neotoma lepida
SQMPVTFEDVALYLSREEWGRLDHTQQSFYRDVLQEKNGLALGIVEMGKVVPALAMATLGDMKPLRTRARWAPGEEPQCGQ

SEQ ID NO: 12958 - protein, 81 aa, Mus musculus
MNAVTYRDVHVNFTQEEWALLDPSQKKLYKDVMLETYRNLNAIGFNWEAQNIEEHCQSSRRHRRCERSQSAEKPSEYTQRD

SEQ ID NO: 12959 - protein, 81 aa, Mus musculus
MLENYSHLVFLGLADSKPQLVTFLEQRQGSTGEERQAVKAVFPGITPNDPNHYSKPTNCESLLLKRRRINTGEKPYKCEEC

SEQ ID NO: 12960 - protein, 81 aa, Mus musculus
GRVTYDDVQVNFTREEWALLDPSQKNLYRDVMLETYRNLAAIGYVWEDHNIEDHFQSSRRRGSPGRIHNSSFRSATCFPFV

SEQ ID NO: 12961 - protein, 81 aa, Dipodomys ordii
CYQDLVTFEDVAVDFTQDEWMLLDSTQRSLYWEVMLENYGHLATVGYQLVKPSLISCLEAEELRTAERSVLQEWAMRLNTK

SEQ ID NO: 12962 - protein, 81 aa, Dipodomys ordii
FLKLMSFDDVAVYFTWKEWQDLDPGQRNLYREVMLETYSNLMSFGLCVPKPKLIVKLEQGTDSWIREDSEENFTDVPEMEE

SEQ ID NO: 12963 - protein, 81 aa, Dipodomys ordii
RMQVMTFRDVAIDFSQEEWEYLNPEQRNLYTDVMSENYSNLVSVGLYIYQPHVFSLLENGQDPWLDLSDETRRLYPGQTKK

SEQ ID NO: 12964 - protein, 81 aa, Octodon degus
RPRALKFADVAVYFSPEEWGCLRPAQRTLYRDVMRETYGHLGALGCAGPKPALISWLERNTDDWEPAALDPQEYPRGVTVQ

SEQ ID NO: 12965 - protein, 81 aa, Octodon degus
EAVNLEDVLVNFTMEEWAVLNPSQKKLYRDVMWETFMNMTALGSTWDIQQIEEYNNCSRNLRNEKITKFDENKVWNQDEKM

SEQ ID NO: 12966 - protein, 81 aa, Fukomys damarensis
MEEWALLDPSQKKLYRDVMWENFRNLAAIDSNVDVKQAVLTPAESLACRKALTGPLSLTVPVIARTALKPYKHLGSEEKVY

SEQ ID NO: 12967 - protein, 81 aa, Fukomys damarensis
MLENYRNLVSLGISPFDLSVVSLLEQGQPWSVDGQVKVSRNPVQWKSVRGLNTDTSPKCVVKGFTPKGRSDTGEMFQAAML

SEQ ID NO: 12968 - protein, 81 aa, Fukomys damarensis
MEEWQHLDLAQKSLYRDVMLENYFNLISVGCQVPNPEVIFSWNPEEEPCSRGSKNSSQSYPSGDIGIESLQQELSEELFFQ

SEQ ID NO: 12969 - protein, 81 aa, Fukomys damarensis
VTFEDVAVNFSMEEWALLDPSQKKLYRDVMWENFRNVTAIGRNWDDQKIEDKFSNYRKTLRIHTGEKPYVCQQCGKAFSRR

SEQ ID NO: 12970 - protein, 81 aa, Rattus norvegicus
LQALMAFHDVAVAFSQTEWKLLSPAQRILYREVMLENYSHLVSLGIAFPKPKLITQLEQGTEPWRDGCLLDLCSEPRTELE

SEQ ID NO: 12971 - protein, 81 aa, Mus musculus
MDALTFDDVHVHFTREEWSLLDPSQKRLYKDVMLEIYKNLTAIGYKWKDHNVGEHSQNDRRYGRHERSPAGENHNEYTQCD

SEQ ID NO: 12972 - protein, 81 aa, Mus musculus
MLENYQNLATVGYQLIKPSLISWLEQEEFSKGQKIVFPEWKLQLETKCSAFQQEFLRGNISSRMQMQTGINRGRELCDGTQ

SEQ ID NO: 12973 - protein, 81 aa, Mus musculus
GLLTFGDVALDFSQEEWECLDSAQRALYIDVMLENYINLVSVDLYSKELIVERKHTIVGNALGVAQASVHIRDFTLERNHG

SEQ ID NO: 12974 - protein, 81 aa, Mus musculus
YRDVMFENYSHLVFLGLASCKPYLVTFLEQRQEPSVVKRPAAATVHPGGKPYKCQEFDKTFDWNSLLLQRQRVHPVEKPYK

SEQ ID NO: 12975 - protein, 81 aa, Mus musculus
PQGLLTFKDVAVEFSLEEWERLSFAQRSLCIDVMLENYNNLLFVENHFICAKCGKALDEDSQYIVHEHMNIQEKSSKWNKL

SEQ ID NO: 12976 - protein, 81 aa, Dipodomys ordii
QESMTFEDVAVNFTNKEWQRKCLTYSQKDLYKDVMLEIYDNIIFLGLLFPKPPLISHLEQRPKPCNQHPQDEECPSCTSPV

SEQ ID NO: 12977 - protein, 81 aa, Dipodomys ordii
KLVSFDDVAVDFSWEEWQDLDFSQRTLYRDVMLETYNNLVSLWPCVPKPNLIVKLEEGAEPWIGEASDKNFTNVQEMEDMI

SEQ ID NO: 12978 - protein, 81 aa, Dipodomys ordii
GNKLVSFDDVALDFSWEEWQDLDIAQRTLYRDVMLETYSNLMSLGHCIPKPKLIVTLEQGAEPWVGEASHKNFTVLQGERK

SEQ ID NO: 12979 - protein, 81 aa, Octodon degus
RKEMVTFRDVAVVFSEEELGLLDSAQRKLYRDVMLENFRNLLSVAHQPFKPDLIAHLEREEKVFMVETETQRYEYPGSNIQ

SEQ ID NO: 12980 - protein, 81 aa, Octodon degus
EAVTLEDVLVNFTLEEWAVLNPSQKELYREVMWETFMHMTAVGMTWDNQQMEEYKNCLRNLRNEKVSPFDQNTVWNQHEKI

SEQ ID NO: 12981 - protein, 81 aa, Octodon degus
LTGAVTYGDVAIDFSQEEWKWLQPALRDFYRCVMLANYGHLVSLVGLSISKPNVLFLLEQGQEPWLGEGEMNRDLFSVLNG

SEQ ID NO: 12982 - protein, 81 aa, Octodon degus
EAVTMEDVAVNFTKEEWALLNPSQKKLYRDVMWETFRNIKAIGRTWDNQMEEKYKNCSRNLSGEKPHDHLGFDDKLSKYNG

SEQ ID NO: 12983 - protein, 81 aa, Octodon degus
MLENYRNLVSLGIHRFDLGVVSMLEQGTEPWSVDGRVKVARNLDEWESVRDVNTDTSLQSVIKEFPPKRKSDTGEMFQSVM

SEQ ID NO: 12984 - protein, 81 aa, Rattus norvegicus
ESVSFEDVAVKFTQEEWAVLDPSQKKLYKDVMQETLRNLASIGNKLSKQKVVSEYEKLWRKLSSQLVEKFCDYHESRQCAE

SEQ ID NO: 12985 - protein, 81 aa, Rattus norvegicus
GEPPATFEDLASYITKWKPKLREKLTLELYVCDTMRTSFNLNVSPEPPAATPDLITKLEQRAAPWIEDPNGLKSGKSRSLG

SEQ ID NO: 12986 - protein, 81 aa, Rattus norvegicus
SQHTVCGSVTFRDVAVDFSQEEWACLDATQKVLYRDTMLETYSHLVTVVGSCISKPHLITLLEQEKEPWMAVKEETDRPSP

SEQ ID NO: 12987 - protein, 81 aa, Rattus norvegicus
MASSSSQHTVCGLVTFRDVAVDFSQEEWACLDATQKVLYRDTMLETYSHLVTVDVELPSPPAPSLPGGCHASCYDDNGLNL

SEQ ID NO: 12988 - protein, 81 aa, Dipodomys ordii
SQESVTFQDVAVDFTEKEWPLLDSSQRKLYKDVMLENYSNLTSLGYQVGKPSLISHLEQEEDLRTEERSMERSPLSNWETP

SEQ ID NO: 12989 - protein, 81 aa, Fukomys damarensis
ELPEATTFKDVEVTFSQDEWGCLDSTQRNLYRDVMLENYGNAASLAGSCSKPALISWLEAREPWGLKVQTAQSKRLPGSTP

SEQ ID NO: 12990 - protein, 81 aa, Rattus norvegicus
FQEMLSFRDVAIDFSAEEYECLDPAQWKLYRDVMLENYSNLVFLGLASAKPYLVTFLEQTQEPSDVKGGTATIKHPGMSKG

SEQ ID NO: 12991 - protein, 81 aa, Rattus norvegicus
VSFEDVAVHFTQEEWALLDPSQKNLYRDVMLETCRSLAAIGYKWEEQNVEDDCKNVGRIQRHVISDSEYLPEEQEGYGSKP

SEQ ID NO: 12992 - protein, 81 aa, Rattus norvegicus
FKQLCVFRDVAIEFGKEEWECLGPEQRSLYRDVMLENYSHFVSLGLAISKPSVISLLEQGKEPWRVEQAGWYPDLLSVNEA

SEQ ID NO: 12993 - protein, 81 aa, Rattus norvegicus
SQEFVTFQDIAVDFTEKEWPLLDSSQRKLYKDVMLENYSNLSSLGFQVGKPRLISHLEQEEELRMEERGIQQCPSPDWETT

SEQ ID NO: 12994 - protein, 81 aa, Rattus norvegicus
FQEMLSFRDVAIDFSAEEWECLDPAQWNLYRDVMLENYSNLVFLGLAFSKPYLVTFLEQRQEPSDEKKQVGATTMHPDIKP

SEQ ID NO: 12995 - protein, 81 aa, Mus musculus
KKPVVFSDVSLDFSQEEWECLGPAQRDLYKDVMLENYSNLLSVGKDTCISSAAISAVSASSSRNFSAAFQACHLNSCSLFA

SEQ ID NO: 12996 - protein, 81 aa, Mus musculus
MDLVTYDDVHVNFTQEEWALLDASQKSLYKGVMVETYRNLTAIGYSWEEHTIEDHFQTSRSHGRHERSSSAEQHSEFIQCG

SEQ ID NO: 12997 - protein, 81 aa, Dipodomys ordii
ALTQLTFEDVAVDFTWKEWRCLTPAQRTLYRDVMLDTYRNLVSVGVSPPNVSVILPLELEEEPWVGQNHVKTPGEPSGWEG

SEQ ID NO: 12998 - protein, 81 aa, Dipodomys ordii
QRGSVTFEDVAVDFTPEEWMSLDPTQRSLYRDVMLENYRNLATVGGQLFKPSLISWLEEKVELTIVEQGILQEWEMHIKTK

SEQ ID NO: 12999 - protein, 81 aa, Rattus norvegicus
MLENYSNLVSLGMTLQSLNAVSKLEQNKGPWTVESEAIITRKSNVQEYAIAMNAENIDCMEAKSISNGSSILSSDRIFLSG

SEQ ID NO: 13000 - protein, 81 aa, Mus musculus
MASSNCQDMVCGSVTFRDVAVDFSQEEWACLDATQKVLYRDIMLETYSNLVTVGKPVPHEWGMFPLHCGLSSCELKVMAVF

SEQ ID NO: 13001 - protein, 81 aa, Mus musculus
LTFKDVAVDFSQEEWECLDCAQRALYMDVMLENYNNLFFVGKNTLLVEFLIHFLNLPIVCLCYLSEKSKNSQNEGNSSYKL

SEQ ID NO: 13002 - protein, 81 aa, Dipodomys ordii
MASPSPPVEPKEEWEYLDPAQRSLYKDVMVENYGNLVSLDVLNRDKHEEPIVKQEIEEIEEDVEPQGVIVTRIKSEIEQDP

SEQ ID NO: 13003 - protein, 81 aa, Dipodomys ordii
ESLSFEDVTVNFTLEEWLLLGPAQRKLCRDVMSEIAGHLASVGNTGLIPGTKRCAMLKGTCHEKGCTTTEHKMGECSSRKV

SEQ ID NO: 13004 - protein, 81 aa, Fukomys damarensis
MEFSWEEWQLLDSTQRHLYREVTLENYSNLLSVGYHGTKPELIFKMEQGEEPWIINAKMSTPSCAGWQEWYQKNKDELESV

SEQ ID NO: 13005 - protein, 81 aa, Fukomys damarensis
VTFDDVAVNFTMEEWALLDPSQKKLYRDVMWENFRNVTAIGRNWDNQQIEDQYKNYRNNLRKTSADFQSLQKHAMTNPEEK

SEQ ID NO: 13006 - protein, 81 aa, Fukomys damarensis
MASASSPLEPKEEWDYLDPAQRSLYKDVMMENYGNLVSLDVMNRDKEEEPTVKQEIEELEEEVEPQGVIVTRIKSEIDQDP

SEQ ID NO: 13007 - protein, 81 aa, Fukomys damarensis
PRAPLAVQAVTLTLVPLLCAVGVAGNAMVVLVVVRGRHMVTPTNCYLGLCVTKPELICRLEQGEEPWILKREMQSYSHWEA

SEQ ID NO: 13008 - protein, 81 aa, Rattus norvegicus
VCGSVTFRDVAVDFSQEEWACLDATQKVLYRDTMLETYSHLVSVVGRCISKPHLITLLEQEKEPWMAVKEESDRPSPGVKT

SEQ ID NO: 13009 - protein, 81 aa, Mus musculus
MDALTYDDVYVNFTQEEWALLNPSQKSLYKDVMLETYRNLNAVGYNWEDSNIEEHCESSRRHGRHERSHTGEKPFEGIQYG

SEQ ID NO: 13010 - protein, 81 aa, Dipodomys ordii
SVTFDDVFVNFTLEEWALLDAAQQQLYRDVMVETFRNLASVEKEKESQIIEDEEDQTVEEVCENPEPDLRVSILNEKTQKP

SEQ ID NO: 13011 - protein, 81 aa, Dipodomys ordii
MEAVTFGDVAVHFSREEWQCLDSGQRALYREVMLENHSSVAGLGKAALCDSQPPCQASLRSKECGRIAVPSQPSQKDSASR

SEQ ID NO: 13012 - protein, 81 aa, Dipodomys ordii
AEESVTFKDVAVDFTQEEWGQLDSPQRALYRDVMLENYQNLLALGPPVHKPDVICHLERGEEPWRVYREVHTRICAEWEPK

SEQ ID NO: 13013 - protein, 81 aa, Dipodomys ordii
LQSLVSFEDVAVDFTREEWQDLDDAQRTLYRDVMLDNYSSLVFVGHCLAKPELIFKLEQGLGPRRVDGTPRLPGLRRATIL

SEQ ID NO: 13014 - protein, 81 aa, Dipodomys ordii
SLKLISFDDVAVYFTWKEWQDLDTGQRTLHRDVMLETYSNLMSLGHCVPKPELIVKLEQGAEPWIREASDKNFTEKSFIKR

SEQ ID NO: 13015 - protein, 81 aa, Dipodomys ordii
SLRLVSFEDVAVDFSWEEWQDLDNAQRTLYRDVMLETYSSLVSLGHCVPKPEAIIKLEQGAEPWVGEPSGQSFAGHCVHKP

SEQ ID NO: 13016 - protein, 81 aa, Octodon degus
SQTPVTFKDVLVDFTREEWKLLDAAQQIMYKDVMLENYKNLISLGHQLPKPDVILQLENEEEPWLMEKGIYHGTHPDSDTT

SEQ ID NO: 13017 - protein, 81 aa, Octodon degus
FKEAVTFRDVAVVFSEEELGLLDSAQRKLYREVMLENFRNLLSVEHQFITLDILPQLESDEKLWMRKRTTQSGDTSGDKNL

SEQ ID NO: 13018 - protein, 81 aa, Octodon degus
FSELVDFEDITLAFTPEEWGLLDLKQKSLYREVMLENYKNLVSVEHQLSKPDVVSQLEEAEDFWPVEREILQHTIPECPGT

SEQ ID NO: 13019 - protein, 81 aa, Octodon degus
MRGNYETLVSLDYAISKPDILTRLEKEEDPWLKAVWGQEGSREPAVHPGVPGPTRCPEQVSGPTSISHKEPAEGPAPVQPR

SEQ ID NO: 13020 - protein, 81 aa, Octodon degus
RALENDGVCFSEQEWENLADWQKELYRNVMQSNYEALVSLIILSPLEKMCWLGLPCCAAVSPFSAVGWSQSQCGLKVLGQP

SEQ ID NO: 13021 - protein, 81 aa, Octodon degus
MLTFRDVAIDFSMEEWEFLEPAQQNLYRDVMVENYKNLLSLGLAVTKPYLISFLEQSREPWDVKSQGTTGIHPAVSSYHIQ

SEQ ID NO: 13022 - protein, 81 aa, Octodon degus
MASPSSPLEPKEEWDYLDPAQRSLYKDVMMENYGNLVSLDVLNKDKDEEPSVKQEIEELEEEVEPQGVIVTRIKSEIDQDP

SEQ ID NO: 13023 - protein, 81 aa, Octodon degus
VTFEDVAVNFTLEEWALLDPSQKRLYRDVIQETFWNLAAIGNNWEEQNIADEYENSRRNLREDTEQEPYVYEEYGEMLDKF

SEQ ID NO: 13024 - protein, 81 aa, Octodon degus
LQESFSFEDLSVDFTQKEWQLLEPHQKNLYRDVMLENYSSLVSLGYTVMKPDVIFKLEQGEEPWAGDEVQHAEVWQVHDPI

SEQ ID NO: 13025 - protein, 81 aa, Mus musculus
MDALTYDDVHVNFTQEEWALLNPTQRNLYKDVMLEIYRNLKAVGYNWEDQNTEEYCQSSRKHGRHERSRTGEKPSENTKCG

SEQ ID NO: 13026 - protein, 81 aa, Mus musculus
GELPATFEDLAVYFSREEWSLLDKQQKELYRDGMQMSYELLASLEPPAAKPDLITKLEQRAAPWIKDPDGLKPGKSPSLGR

SEQ ID NO: 13027 - protein, 81 aa, Dipodomys ordii
SLRMVSFEDVAIDFSWEEWEYLDDDQKTMYRDVMLETYSNLVSLGHYVPKSKVIVKLEQGAEPWMREAPDKKLTDVQEMDD

SEQ ID NO: 13028 - protein, 81 aa, Dipodomys ordii
SLGLVSFEDVSMDFSWEEWKDLNGAQRTLYRDVMLETYSNMVSLGYCIPKPEVIVKLEQGAEPWLGEAPDKSITDVQQVDG

SEQ ID NO: 13029 - protein, 81 aa, Dipodomys ordii
KLVSFDDVAVDFSWEEWQDLDFSQRTLYRDVMLETYSNLVSLWPCVPKPNLIVKLEEGAEPWIGEASDKNFTNVQEMEDMI

SEQ ID NO: 13030 - protein, 81 aa, Dipodomys ordii
VSFADVAVYFSPEEWGCLRPAQRALYRDVMRETYGHLGALGDAPNQKEGEPKGRPEAVGPGKEKPKPLVKHKRDSAVSKTS

SEQ ID NO: 13031 - protein, 81 aa, Dipodomys ordii
MLETYSNLLSLGHCVPKPKLIAKLEQGAEPWIREASNKNLTDVQEKEYRTKTYQKSPYDCLSEVGVMNTNTGKKKVKLITT

SEQ ID NO: 13032 - protein, 81 aa, Rattus norvegicus
EPVTFEDVALNFSPGEWALLDSSQKKLYRDVMTETFLNLISIGKTEENIEEDYANVRRNLRTQTIERDCKSEDGSQHGEAH

SEQ ID NO: 13033 - protein, 81 aa, Rattus norvegicus
AKGLVSFEDVSVDFTWDEWQDLDDAQRKLYRDVMLETYRSLESLGHCVTKPEVIFKLEQGTGPWRAEDIPKQSRPDVRKVR

SEQ ID NO: 13034 - protein, 81 aa, Rattus norvegicus
MFSDVSVVFSKEEWDCLDLDQRTLYRDVMMENYHNVLSLGCFISKPDVISLLEQGKEPWKRRRCPDSGVKDETHQLFSENG

SEQ ID NO: 13035 - protein, 81 aa, Rattus norvegicus
GYRVVKPSMISKLKKGKEPWPLGAEFLRRSCGDKRRTVHDPKARHQEQQAGTARKGELAKRQKTPTRHESYDCSKCGKSFC

SEQ ID NO: 13036 - protein, 81 aa, Fukomys damarensis
MLENYRNLVFLGLAVSKPYLVTFLEQRKELWNVEREEIVAIYSDNGFKNEEISKCDQFENSFRKSSPCKQETISPFVKTQN

SEQ ID NO: 13037 - protein, 81 aa, Rattus norvegicus
ALVTFEDVAVRFTQEEWALLDPSQKILYRDVMRETYRNLTSVGINWECWDLEACFRSLGRNLRVQVVKRKCELTNSGPCAE

SEQ ID NO: 13038 - protein, 81 aa, Castor canadensis
PKVPVTFVDIAVYFSEDEWKNLDEWQKELYKHVMRGNYETLVSLDYAISKPEVLSQIEQGKEPCTWRRAGPKVPEVPVDPS

SEQ ID NO: 13039 - protein, 81 aa, Peromyscus maniculatus
VTFEDVAVNFTLGEWTMLDSSQKKLYRDVMKETFMNLISIGKTEEEDIEEYQKPKGDLRTLMVERLCKYDRGNQNRETHQQ

SEQ ID NO: 13040 - protein, 81 aa, Peromyscus maniculatus
EEGCVSFEDVAVYFSWEEWKLLNDSQRLLYQTVMTEIFALMSSLGLMPSGIHGVTQLESWGEPSVPALRFLTPGCWIKVKS

SEQ ID NO: 13041 - protein, 81 aa, Peromyscus maniculatus
FQSEVMFRDVTVNFSQEEWECLNSYERDLYKDVMLENYSHLVSLGCSISKPDVITLLEQGKEPWMIVRDERRRWSQDLETR

SEQ ID NO: 13042 - protein, 81 aa, Peromyscus maniculatus
YEGLVSFEDVSVDFTWEEWQDLDDAQRKLYRDVMLETYSSLLSLNQCDPKPELILKLEQEAEPWKEDDVPNPSLPDMQHAN

SEQ ID NO: 13043 - protein, 81 aa, Peromyscus maniculatus
VTYDDVHVDFTWEEWILLDPSQKNLYKDVMLETYRNLTTIGYIWKDHNTEEHFQSSRRHERTHTGEKPYECNQCGKAFAPH

SEQ ID NO: 13044 - protein, 81 aa, Ictidomys tridecemlineatus
FDDITVYLLQEEWMLLSQQQKDFYGSDKLVPPLGPTVTSPELFCEFGKVSKPWPGNVQGQRSLLDHHPGKDQVGYMGEMDV

SEQ ID NO: 13045 - protein, 81 aa, Marmota monax
VTFEDVAVNFNQEEWALLDFSQKNLYRDVMLEVLRYLTSIGNKWEDKTIEDQIEHSGSILRHIACHSGHEPYKHEECEEKP

SEQ ID NO: 13046 - protein, 81 aa, Heterocephalus glaber
SVSFEDVVVSFTREEWQVLDDAQRTLYRDVMLETYCSLLLLGHCITKPEVIFKLEQGAEPWMGEEPLNQSPSDVQKVGNVI

SEQ ID NO: 13047 - protein, 81 aa, Mus musculus
MEPVTFEDVAVNFSLGEWALLDSSQKKLYRDVMTETFMNLISIGKTEEKENIEDNYQNLRKNVRTLVAERSCDYGDVSQCG

SEQ ID NO: 13048 - protein, 81 aa, Mus musculus
MGVVTYDDVHVNFTQEEWALLDPSQKNLYRDVMLETYRNLAAIGYSWEDHNPEEHFQSSRRHGRHEKSHIEEKPSEFTQCG

SEQ ID NO: 13049 - protein, 81 aa, Rattus norvegicus
LQDAVTFKDVAIDFSQEEWEWLNPAQRSLYRNVVLENYRNLVSVGACISKPSLISLLEHGKEPWEVKGQVTRSPVQGGESV

SEQ ID NO: 13050 - protein, 81 aa, Heterocephalus glaber
FAVDPRSVWCLSQDKRRPTCGTHARVLHTWRPGPASSIFFFAAHTAGFLVFKPELISRLEQGQEPWILDLQGAEGTKAPRT

SEQ ID NO: 13051 - protein, 81 aa, Mus caroli
PQALLTFKDVAVDFSLEEWECLNFAQKSLYMDVMLENYNNLLFVENHFICAKYGKALDEDSQYIIHDHMNIQGKSSKWNKL

SEQ ID NO: 13052 - protein, 81 aa, Heterocephalus glaber
EAVTFEDVAVNFTMEEWALLNPSQKNLYRDVMGETFRNMVSIGQFITAKPWNQPRCPSVDPWIKKNFEVFENREEWRGNEE

SEQ ID NO: 13053 - protein, 81 aa, Heterocephalus glaber
IQDSLTFEDLAVDFTPEEWALLDLAHRKLYRDVMLENFQNLTSLGFKILLKTNESVVLPHNNLEKVSNEQKECGKAFHFLA

SEQ ID NO: 13054 - protein, 81 aa, Mus caroli
SQESLTFKDIAVDLSQEEWGQLAPAYRDLYREVMLENYRNLVSVAGYQLSKPTVISQLEKGEGPCMAESQGPEDPILDVKN

SEQ ID NO: 13055 - protein, 81 aa, Mus caroli
DALTYDDVYVNFTQEEWTLLNPSQKSLYKDVMLENYTNLIAVGYNWEDQNIEEHCQSSRRHGRHERTHSGEKAYECKQCSK

SEQ ID NO: 13056 - protein, 81 aa, Mus caroli
MDALTYDDVHINFTPEEWALLDHTQKNLYTDVMLETYKNLTAIGYKPEDKIIEHLQNFRIPGRHKGSLTREKLYEYTQCGK

SEQ ID NO: 13057 - protein, 81 aa, Mus caroli
SQESVSFEDVSVDFTQEEWNQLDPIQRSLYRDVMLENYSHLVSLGYPITKPEVITSLEQGVLGIIKREIPSSSCTDGQAEY

SEQ ID NO: 13058 - protein, 81 aa, Neotoma lepida
LLTFKDVATDFRQEEFGCLDSAERTLPGNHKLKNYTNLVSTALSYHQTQEVSHRSTNTILYRNKEQAYLKLVVLTCYIQGS

SEQ ID NO: 13059 - protein, 81 aa, Mus musculus
QCLLTFKDVFLDFSSEEWECLNFAQRTLYMDVMLENYNNLLFVENHCICGNYEKEKVVEQDTQHIFNEHGHIQEKSFKCNE

SEQ ID NO: 13060 - protein, 81 aa, Mus musculus
MCSFPVLKKIFWAGLFVYRPHLFSLLEKGQDPWMILRDETRGPYPDIDFSSQNKKFLGKPSTYEELSQREMKEYFRKRSLE

SEQ ID NO: 13061 - protein, 81 aa, Mus musculus
MAAVTYEDVHVNFTHEEWALLDSSQKSLYKDVMLETCRNLTAIGYRLEDHNIEEHCQSSRRPGRYICNCGYKPCENEDHGK

SEQ ID NO: 13062 - protein, 81 aa, Mus musculus
RKNLLTFEDVSVNFTQEEWQWLSDTQRDLYRKVTLENYKSLVSLGVPVYKPAVISLLEQGKDPWMVQKKGARDTCPDWQYV

SEQ ID NO: 13063 - protein, 81 aa, Dipodomys ordii
LQGLVTFRDVVIVFSQEEWKYLEPAQRNLYRNVTLETFSHLVSVGLSISKPDVIFLLEQGREPWIIADDMERLWYPDLEPR

SEQ ID NO: 13064 - protein, 81 aa, Dipodomys ordii
SLKLVSFDDVAVDFSWEEWQDLDHAQRTLHRDVMLETYSNLLSLGHWVPKPKLIAKLEQGAEPWIREASDKNLTDVQEKEY

SEQ ID NO: 13065 - protein, 81 aa, Dipodomys ordii
MESFSFKDVSVKFTKEEWALLNPSQKTFYRDVMLETFSNFNCIGHKWTDLNMNDQHKNCQRNIRHVISHSGYKYEHKECRQ

SEQ ID NO: 13066 - protein, 81 aa, Dipodomys ordii
MVTFRDVAVDFSLDEWGWLSPAQRNLYRTVVLENYQNLLSVGVCISKPYVISLLEQGKEPWETSTMTRSLLADGEPMYEGQ

SEQ ID NO: 13067 - protein, 81 aa, Octodon degus
VSLEDVAVNFTMEEWALLNPSQKKLYRDVMLETFMNMTDIGRNWDNHPIEEEYKNTSKNQSNEEVARWCQYKHWNQYINLF

SEQ ID NO: 13068 - protein, 81 aa, Octodon degus
PVTFADVFVYFSPEEWELLEEAQRFLYRDVMLENFALVATLGCSCEAGNEEAHAEQSISVKKVSQIRTEPGLFFQRAHPCG

SEQ ID NO: 13069 - protein, 81 aa, Fukomys damarensis
DWALVTFSDLAIYFSQEEWEWLSPMQKELYEEVMLENYRNLVSVGLCLRRPRVITLLEKGKEPWLVELPRRPWCRASKCET

SEQ ID NO: 13070 - protein, 81 aa, Fukomys damarensis
FQELVTFGDVAIDFSRQEWEYLDLRQRDLYRDVMLENYRNLVSLGHSISKPDVIDLLEQGKEPWTDLDLQYKIISYLKMPA

SEQ ID NO: 13071 - protein, 81 aa, Fukomys damarensis
CLGSVTFDDVAVHFSWDEWHLLDEAQRCLYHDVMMDNLALITSLGCWLGVEDVAASSEQSASSDGMSHVRTPRAGLSPQKA

SEQ ID NO: 13072 - protein, 81 aa, Fukomys damarensis
MTFKDVAMDFTPEEWGNLDPAQRDVMLENYRNLVSLWLPVSKPENYNLDNGKEPLKFERKPPKHSYSDMETIPESKDSTSM

SEQ ID NO: 13073 - protein, 81 aa, Ictidomys tridecemlineatus
RPRALKFVDVAVYFSPEEWGCLRPAQRALYRDVMRETYGHLGSLGCAGPKPALISWLERNTDDWEPAALDPQEYRRGLTVQ

SEQ ID NO: 13074 - protein, 81 aa, Ictidomys tridecemlineatus
AHESLAFRDVAIDLSQEEWECLDTAQRDLYREVMLENYSNLISLGCIIPKPDVIVLLEQEKDPWLETREETRRRSSDFTKK

SEQ ID NO: 13075 - protein, 80 aa, Ictidomys tridecemlineatus
MYFLLKAFVVFRDVAVDFTQEEWRLLSPAQKILHREVMLENYSHLVSLEIAFSKPKLITQLEQGEEPWREVRKHLPDLCP

SEQ ID NO: 13076 - protein, 81 aa, Marmota monax
SKGSVSFKDVTVDFTQEEWQQLDPAQKALYRDVMLENYCHFISVGFHITKPDMIRKLEQGEELWSERIFASQSYLEDGKAE

SEQ ID NO: 13077 - protein, 81 aa, Marmota monax
MLENYGNVASLGFSLLKPAVISRLEGGDLDIQTGSNLSKEMCEEKVSTSFELHKDSSQETDFSEAFMLEQQQEVHLAGSMK

SEQ ID NO: 13078 - protein, 81 aa, Marmota monax
EPGTVSFADVAVYFSLEEWGCLRPAQRALYRDVMRETYLHLSALGGGGTKPALISWVEEEAELWHPDAQDPEVAKCPTEAD

SEQ ID NO: 13079 - protein, 81 aa, Marmota monax
MTCFSSLRSTINNLYTFPRAAENEQIAGYDVTKPNVIIKLEQGEEPWTIEDDFPSQSHSEVWEVDDIVERIQEDEDQHSRQ

SEQ ID NO: 13080 - protein, 81 aa, Marmota monax
MLENYSNLISVGFRVSKPDVIFKLEQGEEPWIVEEISRESYTEDDDALEKDKEIQDKYLSQNSTTLITKRVNAFGTMFTLG

SEQ ID NO: 13081 - protein, 81 aa, Marmota monax
QVPISFMDLAVRFSEEEWRLLEERQREFYRDVMRENYETLVSVGTDELLPLSAFLSPTEPGAAMGGGSHGDEGQEPPVKGS

SEQ ID NO: 13082 - protein, 81 aa, Marmota monax
VQGSVSFDDVTVNFSRDEWLCLSSTQRILYRDVTLENYSHLVFVGYCLTKPDVILRLEQGENPWTLEGEHPGQAYPKAQKL

SEQ ID NO: 13083 - protein, 81 aa, Marmota monax
FQESVTFRDVAIAFSQQEWQSLDSSQRDLYRDVMLENYRNLVSLAGHSLSKPHVITLLEQWKDPWETGRKDKRRRCADLQL

SEQ ID NO: 13084 - protein, 81 aa, Marmota monax
MLETYYSLVSLGHCIIKPEVIFKLEQGAEPWMVEEHPNQTLSDVQKVDDQIDRSQESQDRRLWQVVITNSNSSTKERVEVE

SEQ ID NO: 13085 - protein, 81 aa, Marmota monax
MLENYQNLLALGPPVCKPDVISHLERGEEPWQVHSKVTGRTCSEWEPMPEMKEESSQQQNFFQKNPSLKPIVEQLKRTSLH

SEQ ID NO: 13086 - protein, 81 aa, Heterocephalus glaber
MLETYSHLVSLGQQVTKPDLILKLEVEEPCPAEGKVPIWSFSEVCQIDEQIDKQHQDDRDKCLLMQVGFPGKKIITTKSGC

SEQ ID NO: 13087 - protein, 81 aa, Heterocephalus glaber
MLENYSSLVSLGYTVMKPDVIFKLEQGEEPWVGDGEVQHSDCPEAWQVDDHMTWQQENQDQPRSLKRGHEWDVFGKNFTLN

SEQ ID NO: 13088 - protein, 81 aa, Heterocephalus glaber
SVLFITGLCVTKPELIRRLEQGEEPWILKRDLPSYSHWEAQRASNTKESQENEDKYLIQALFIKNKTVNKDRSKTLREMVD

SEQ ID NO: 13089 - protein, 81 aa, Heterocephalus glaber
ALVSFEDVAVTFTGEEWRHLDLTQRTLYQEVMLETCELLVSLGCPVPKAELMYPLEYGQGLWMVKRGLLQHTCTGEKAKLD

SEQ ID NO: 13090 - protein, 81 aa, Heterocephalus glaber
AVSFEDVAVNFTVEEWALLDPFQKKLYRDVMCETFRNVAALGRTWDNEEIEDEYKNCRRSLSSGEVQKCCEYELWYQHGKM

SEQ ID NO: 13091 - protein, 81 aa, Heterocephalus glaber
MLENYNNLVSVGCHIIKPDVIIKLEQGEEPWIVEGAFPPQSYPDEAWQADDLMERVQQDADMFFINKTLVEERGNVSGKAF

SEQ ID NO: 13092 - protein, 81 aa, Heterocephalus glaber
VSFEDVVVDFTCEEWQDLDDAQRTLYRDVMLETYRSLVLLGHCITKPEVIFKLEQGAEPWMGEPPPNLSPPDGQKMDDIIQ

SEQ ID NO: 13093 - protein, 81 aa, Mus caroli
MDAVTYEDVHVNFSREEWALLDPSQKSLYKDVMLETYWNLTCIGYKWNNHDNEEYCQSSGRHGRCINCPSAYGKKQCTNLF

SEQ ID NO: 13094 - protein, 81 aa, Mus caroli
MGSVSFEDIAVDFSWDEWQHLDMAQRTLYRDVMLENYSSLLFLGHCMTKPEVIFQLEHGFGPWPVGDSSVRSLPGIHKVTT

SEQ ID NO: 13095 - protein, 81 aa, Mus caroli
VQDLVTFKDVAVLFTQEEWGRLSSAQRALYRDVMLENYSNLVSLAGLLGSRPDMFFPLEEVEECVSEEAPEGFVLDAADEP

SEQ ID NO: 13096 - protein, 81 aa, Mus caroli
ARFPLTFEDVAIYFSEQEWQHLEAWQKELYKQVMRTNYETLISLDNGLPKPELISWIELGRELFSSWGEKKKPDKEVHCSI

SEQ ID NO: 13097 - protein, 81 aa, Mus caroli
MAVVTYEDVHVNFSHEEWALLDSSQKSLYRDVMLETYWNLTAIGYKLEDHNVEEYYQSYRRHRRYNICHCEYKPCEHKGYG

SEQ ID NO: 13098 - protein, 81 aa, Mus caroli
AHSMVMFRDVTVDFSQEEWECLSSYERDLYRDVMLENYSHLVSLGCSISKPDVITLLEQGKEPWMIVRAEKRRWSRDLESR

SEQ ID NO: 13099 - protein, 81 aa, Mus caroli
MDALTYDDVHVNFTQEEWALLNPTQRNLYKDVMLEIYRNLKAVGYNWEDQNTEEHCQSSRRHGRHERSHTGEKPSENIQCG

SEQ ID NO: 13100 - protein, 81 aa, Mus caroli
PQGLLTFKDVALDFSLEEWEALSFAQRTLYMDVMLENYNNLLFVENHCICGKYEKVLDQDSQYIVHEHMNIQEKSSKWNKL

SEQ ID NO: 13101 - protein, 81 aa, Mus caroli
ARVSVVFSDVSIAFSQEEWESLDLEQRNLYKDVMMENYHNVASLAGCFIAKPDVISLLEQGKEPWKVVRQRKPCPDSETKD

SEQ ID NO: 13102 - protein, 81 aa, Mus musculus
TQGQLSFSDVAIEFSQEEWECLDHAQRALHRDVMLENYSNLLSLGVTLPNLNAMSKLEQYKGPWTVESEAIRIRKSNGKEY

SEQ ID NO: 13103 - protein, 81 aa, Mus musculus
PQGLLTFKDVALYFSLEEWECLSFAQRTLYKDVMLENYNNLLFVENHCICGKYRKVLDQDSQYIVHEHMNIQEKSSKWDKL

SEQ ID NO: 13104 - protein, 81 aa, Mus musculus
RADALTYDDVYVNFTQEEWALLNPSQKSLYKDVMLETYRNLIAVGYNWEDSNIEEHCESSRRHGRHERSHTGENPDEGIQC

SEQ ID NO: 13105 - protein, 81 aa, Rattus norvegicus
MEAVTFKDVAVIFTKEEFRLLDSTQRKLYQDVMVENFRNLLSVEYQLFKQEKPQLEREEKPREQGSGMNNQSERGAVQGGR

SEQ ID NO: 13106 - protein, 81 aa, Heterocephalus glaber
ITFDDVALYFLEQEWEILEMWQKEIYAQVMKANYEALDFLAGDYAASREAVMAEPASVTITFDDVALYFLEQEWEILEMWQ

SEQ ID NO: 13107 - protein, 81 aa, Mus musculus
SASLENTAQCLLTFKDVFLDFSSEEWECLNFAQRTLYMDVMLENYNNLLFVENHCICGNYEKEKVVEQDTQHIFNEHGHIQ

SEQ ID NO: 13108 - protein, 81 aa, Mus musculus
LQVPISFKDLAVRFSEEEWRLLQEGQREFYRDVMRENYETLVSVGTSELLPLSAFLSPAEAGGATSGESHQDKGQKPHLEH

SEQ ID NO: 13109 - protein, 81 aa, Mus musculus
KPGTVSFADVAVYFSPEEWRCLRPAQRTLYREKSGATNQRSSAGWRKSPKCGDPVPRSQRWPCAGQKSTQIAGTRRKGRDQ

SEQ ID NO: 13110 - protein, 81 aa, Mus musculus
PQGQLTFKDVAVDFSQEEWECLDCAQRALYMDVMLENYNNLLFVENQYMCPEFENMLNQDLQHIVHEHANTQVKSYECHEL

SEQ ID NO: 13111 - protein, 81 aa, Mus musculus
VEEPVTFKDVAVALPQEEWRQLDLVQRTLYRDVMLETYGHLLSVGNQIAKPEVISLLEQGEEPWSVEQGYPKSSCPEWMRN

SEQ ID NO: 13112 - protein, 81 aa, Mus musculus
MDALTFDDVHVHFTREEWSLLDPSQKRLYKDVMLENYRNLTTIGYNWKDHNIGEHSQNDRRYGRHKITPAGEKPYEYTQWD

SEQ ID NO: 13113 - protein, 81 aa, Mus musculus
LRTPNMDLVTYDDVHVNFTQEEWALLDASQKSLYKGVMVETYRNLTAIGYSWEEHTIEDHFQTSRSHGRHERRSSAEQHSE

SEQ ID NO: 13114 - protein, 81 aa, Dipodomys ordii
SLKLMSFDDVAVNFTRKEWQDLDPGQRALHREVMLETYSNLMSLGHCVPKPILIVKLEQGAEPWMREDSEENFTDVPEMED

SEQ ID NO: 13115 - protein, 81 aa, Dipodomys ordii
PEKSISFTDLTVDFTHEEWLRLGPVQRLLYREVMLENYSNLISVGIHTSKPDVIFKLEQGEEPWIGDEITRQNHTEDDGAL

SEQ ID NO: 13116 - protein, 81 aa, Rattus norvegicus
FQDMLSFCDVAMYFSAEEWECLGPDQWKLYRDVMLENYSNLVFLGLASSKPYLVTLLEQIKDSSDMKKQEAITVHPGAKGY

SEQ ID NO: 13117 - protein, 81 aa, Rattus norvegicus
MDFTPEEWGKLDPVHRDVMLENYRNLVSLWLPISKPDDYDSEDGKELLKLERKSPKCSDSDVETRPESKESTSVLDFPKEE

SEQ ID NO: 13118 - protein, 81 aa, Rattus norvegicus
MLSFCDVAMYFSAEEWECLGPDQWKLYRDVMLENYSNLVFLGAKGYMCKEYGKGFEHKNVYQNHQRTHLRVKSYKCEECGK

SEQ ID NO: 13119 - protein, 81 aa, Marmota monax
LQEPVTFRDVAVDFTQEEWGQLEPAQRTLYRDVMLETFGHLLSVGPELPKPEVISQLEQGAELWVVGKGVAQGCHPGWELA

SEQ ID NO: 13120 - protein, 81 aa, Marmota monax
SQGTVTFKDVAIAFTQEEWKQLDPAQRNLYRNVMLENYNNLITVGYPFTKPEVIFKLEQEEEPWVVEEEVFRRHCSGEIWG

SEQ ID NO: 13121 - protein, 81 aa, Marmota monax
PKVPVTFDDVAVYFSEQEWGKLEDWQKELYKHVMRGNYETLVSLDYAISKPDILTRIERGEEPCPEDQQSKEKGTEEEAAC

SEQ ID NO: 13122 - protein, 81 aa, Marmota monax
CVTFEDVFVYFSWEEWELLEEAQKFLYRDVMLENFALVATLGCWCDADNEKALFEQSISVERQLEIRHPESDLFIQKAYPC

SEQ ID NO: 13123 - protein, 81 aa, Marmota monax
LEVSISFEDVTVNFSREEWQHLDPVQRRLYWDVTLENYHHLISVGYQVPKLEAIYKLEQGERPWTLEGEAPCQSCSGENIR

SEQ ID NO: 13124 - protein, 81 aa, Marmota monax
MLENYRNLVALGHQLYKPEVITQLEKEELRLTERDGPLETPPDAENIPEVKKSALNQSISDENQTQDMIMQRLTRDSFWYS

SEQ ID NO: 13125 - protein, 81 aa, Marmota monax
PKVPVTFDDVAVYFSEQEWGKLEDWQKELYKHVMRGNYETLVSLDYAISKPEVLSQIEQGKEPCTWRRAGPKVPDVPVDPS

SEQ ID NO: 13126 - protein, 81 aa, Heterocephalus glaber
SEESVTFKDVAVDFTQEEWGQLDSPQRALYRDVMLENYQNLVALGPPVCKPDVISHLERGEEPWRVYREGSGGACSEWGPA

SEQ ID NO: 13127 - protein, 81 aa, Heterocephalus glaber
GPVSFKDVAVDFTQEEWQQLDRDEKMTYRDVMLENYNNLISVGYDVTKPNVIIKLEQGEEPWTIEGDFSQTCPEVWKIDDL

SEQ ID NO: 13128 - protein, 81 aa, Mus musculus
SQGALTFMDVAIEFSKEEWECLNSAQRALYRDVMLENYNNLVSVGVAVSKREVIICLEQNKEPWIVDAEETQVREPALSCE

SEQ ID NO: 13129 - protein, 81 aa, Mus musculus
RHAPPPLQIPAAATWPLTNPPRRWMAFEDVAVYFSQEEWMFLNAAQRALYRHVMLENFALVDSIELSKAFQISMGQRRDVG

SEQ ID NO: 13130 - protein, 81 aa, Mus musculus
EAVTFGDVAVHFSREEWQCLDSGQRALYKEVMLENHSSVAGLDSAIRTDRKQTCEYTSLLQRQIPGFGDNLDSKVWSENCP

SEQ ID NO: 13131 - protein, 81 aa, Dipodomys ordii
SQASVSFMDVCVDLTEEEWQCLGPAHRTLYRDVMLEIYSHLVSVGYCSTKPELIFKLEQGDNLWSLNKKNQLLSPNSPEDC

SEQ ID NO: 13132 - protein, 81 aa, Dipodomys ordii
SLRLVSFEDVAVDFSWEEWQDLDNAQRTLYRDVMLETYSSLVSLGHCVHKPEVIVAEPQVGGAPDQNFPDVQQVDDQIEMC

SEQ ID NO: 13133 - protein, 81 aa, Dipodomys ordii
SQDCVTFDDVAVEFTPEEWTLLDSAQRTLYRDVMLENYKNLATLGCQFFMPRVILWLTQEVLGPVEGAGIQELEEQPRTCG

SEQ ID NO: 13134 - protein, 81 aa, Octodon degus
LQGSVLFEDVSMAFTQKEWQLLDPSQKCLYRDMMLENYGHLESLGLCVTKPELICRLEKGEEPWISKKELPSHSHWEYQRA

SEQ ID NO: 13135 - protein, 81 aa, Octodon degus
SLGLVSFEDVAVDFSWEEWQDLDDAQKTLYRDVMLETYSSLVSLGHCSPKPEVIIKLELGAQQWMGEEHPSQAHTDVQKVE

SEQ ID NO: 13136 - protein, 81 aa, Octodon degus
QELAESVTFEDVAVTFTLEEWALLDPSQKKLYRDVMREIQQNMAAIGRNWENQQNDEKYKNSWRHLRNEEVEKSYQYKAWN

SEQ ID NO: 13137 - protein, 81 aa, Fukomys damarensis
PKVPVAFDDVSIYFSTPEWEKLEEWQKELYKNIMKGNYESLISMDYAMSQPDVLSQIQPEGEHNTEDQAGPEGSDIAAVPN

SEQ ID NO: 13138 - protein, 81 aa, Fukomys damarensis
QMPVTFEDVALYLSREEWGRLDHAQQNFYRDVLQKKNGLALGSPFSGPFWAPQVPGKVETSSSSRRTGAKEEESDPGSGAV

SEQ ID NO: 13139 - protein, 81 aa, Fukomys damarensis
KVPVTFVDIAVYFSEDEWKNLDEWQKELYNNLVKENYKTLMSLDAEGPVAKPDTSAPVEPREEPCVWEQRHPEEREIPVDT

SEQ ID NO: 13140 - protein, 81 aa, Fukomys damarensis
SQGLVTFEDVAVYFSLEEWERLDSDQRGLYQEVMQENYGILVSLGYPVPKPDLIFRLEQGEEPWVPDSPHPEEGDIVTGVY

SEQ ID NO: 13141 - protein, 81 aa, Rattus norvegicus
MSSFCLQAGFLFTKPKVISLLQQGEDPWQVEKEGPRYFSLGLKCSHRTTKSTQTQDSSFQELIVRKSKRTFAFEPLNMKSE

SEQ ID NO: 13142 - protein, 81 aa, Rattus norvegicus
PVTYDDVHVNFTHEEWALLDPSQKNLYKDVMLETYLNLCGIGCKWEDCNIEEHCQSSGRHERMSRRWGDNPALSASTVVDM

SEQ ID NO: 13143 - protein, 81 aa, Rattus norvegicus
EQLTFRDVAIDFSGEEWECLNSEQQNLYTDVMLENYRNLVFLGLAVSKPYLVTCLEQRKEPWSVKRQKPVALFPALFPHHN

SEQ ID NO: 13144 - protein, 81 aa, Mus musculus
CSISKPDVITLLEQGKEPWMIVRAEKRRWSRDLESRYSSNGLLPEKNTYEINLSPWEIMGRIQRRGPEDSPLGKDFEYKIF

SEQ ID NO: 13145 - protein, 81 aa, Mus musculus
SSFTRTAQCRNTAAAIEEDAVTYDDVHVNFTREEWNLLHPSQKSLYKDVMLETYWNLTVIGYTWENHHIERHCQSSRRNER

SEQ ID NO: 13146 - protein, 81 aa, Mus musculus
YREVMLENYSNLVFLGLAFSKPYLVTFLEQSSDPWSMKRKESAAIHLGSKPHKCKECGKAFDRNSVLIQHQRIHTGERSYK

SEQ ID NO: 13147 - protein, 81 aa, Dipodomys ordii
SLNLVSFDDVAMDFSWEEWQDLDIAQRTLYKDVMLETYSNLASLGHCVPKPKLIVKLEQGAEPWMGETLNKNFPDVQEMED

SEQ ID NO: 13148 - protein, 81 aa, Dipodomys ordii
LQKPVSFKDVVVGFTHEEWHRLTPAQRALYRDVMLETYSNLISVGYKGTKPDVILRLEQRKAPWICEAACPSCQWPEKIWK

SEQ ID NO: 13149 - protein, 81 aa, Dipodomys ordii
MEWEYLDPAQRSLYKDVMVENYGNLVSLDVLNRDKHEEPIVKQEIEEIEEDVEPQGVIVTRIKSEIEQDPMGQETFELVGR

SEQ ID NO: 13150 - protein, 81 aa, Dipodomys ordii
QQELVAFEDVAMDFTQEEWQYLSPSQKTLYRDVMLETCSNFVFVEQQLTKPDRILKLEVEELSPADGKIWNFPEAYQVDDE

SEQ ID NO: 13151 - protein, 81 aa, Octodon degus
ALALVSFEDVAVTFTGEEWRYLDLAQRTLYKEVMLETCELLVSLAGHPVPKAELMYLLECGQGPWMMKRGLLQRTCTGRKA

SEQ ID NO: 13152 - protein, 81 aa, Octodon degus
MGLVSFEDVSVNFTWEEWKDLSDAQRNLYREVMLETYSNLVALGHCSTKPDVIFKLEQGSEPCLVEEASSQSLPDVQKVNG

SEQ ID NO: 13153 - protein, 81 aa, Octodon degus
AVTFEDVTVDFTREEWALLDVSQRSLYREVMLENCRNLASLDLETVLKTKWLTPKKGVFRQEQVKSVKTEKSRRGVKINEC

SEQ ID NO: 13154 - protein, 81 aa, Octodon degus
MEPVSLEDVAVTFTLEEWALLNSSQKKLYRDVMWETFMNLTDIGRTWDNQQAEEYKTCLRNLSLDAYHGMHGNRACGVNST

SEQ ID NO: 13155 - protein, 81 aa, Octodon degus
PTAPVAFSDLTICFSQEEWGWLSPTQKLLYEEVMLENYQNLVSVGLCTRKPHIITLLEKGKDPWIAEPLRKRGGPDPASRY

SEQ ID NO: 13156 - protein, 81 aa, Rattus norvegicus
AGYQVSKPEVIFKLEQGEEPWISERELQRPFCPDWKTRPDIKSWSSQQGVSEVSHSANVWSHATFGDIWGVNTQRHQESWR

SEQ ID NO: 13157 - protein, 81 aa, Rattus norvegicus
KLGAVSFADVAVYFSPEEWGCLRPAQRALYREVMRETYSLLGSLGVRGAKPALICWVEEETELWGPRAQDPELAMCKTEVH

SEQ ID NO: 13158 - protein, 81 aa, Mus musculus
YREVMLENYNHLVSLGYQVSKPEVISNWSKEKSHGYARKKSKDLSVQTGRPGLSPHGVLSRAYLKYSSEQMLSHTTIGDTW

SEQ ID NO: 13159 - protein, 81 aa, Dipodomys ordii
MPVTFEDVALYLSREEWGRLDHAQQSVYKDMLQKRNGLAWAFPLGRPFWAPQVPGKGEASCSGGPPGAGKERRGPASGELL

SEQ ID NO: 13160 - protein, 81 aa, Dipodomys ordii
MLETYSLLLSLGHCVPKPKLIAKLEQGAEPWIREASDKNLTDVQEMEYRIKTCQESPYEYLSEVAVMNSNTGEEKVRLLTT

SEQ ID NO: 13161 - protein, 81 aa, Dipodomys ordii
SLRLVSFEDVAVDFSWEEWQDLDNAQRTLYRDVMLETYSSLVSLAGHCVPKPEAIIKLEQGAEPWVGEPSGQSFADVQQVD

SEQ ID NO: 13162 - protein, 81 aa, Dipodomys ordii
RPRALKFADVAVYFSPEEWGCLRPTQRALYRDVMRETYGLLGALGCAGPKPSLISWLERNTENWEPAALDPQEYRKGVTVQ

SEQ ID NO: 13163 - protein, 81 aa, Dipodomys ordii
ALTQLTFENVAVDFTQEEWRCLTPAQRALYRDVMLDTYRNLVSVGVSPPSVSVILPLELEEEPWVAQSHVTTPGELNGWEG

SEQ ID NO: 13164 - protein, 81 aa, Dipodomys ordii
CYEDSVTFDDVAVGFTQEEWILLDRAHRELYREVMLETYQNLASLGREPIKPSLISWLEEDVWLVQSGALHDWEMQLNTKE

SEQ ID NO: 13165 - protein, 81 aa, Dipodomys ordii
SKETVKFKDVAINFTLEEWTLLNLSQKKLYRNVMVEILRNLVSIESKTSLKSLETPSQKVDEHFYPVLQAARSPQDNLSPE

SEQ ID NO: 13166 - protein, 81 aa, Dipodomys ordii
LQFSVSFEDVTVDFSKEEWQSLDHGQRRLYWDVTLENYCHLLSVGYHIAKTETVFKLGQEEEPWTPEEEAPQESCLGEAIW

SEQ ID NO: 13167 - protein, 81 aa, Octodon degus
MYFSQEEWELLDTTQKALYNDVMQENYKNVISIALFGLPKPKVISCLEQGEEPWVQGSLDFKDTPRESLTELKLRNDTENH

SEQ ID NO: 13168 - protein, 81 aa, Octodon degus
VPISFKDLAVRFSEEEWRLLEEGQREFYRDVMRENYETLVSVGRQLQHSLHLTALVQLVKEIPEFLFGETKGTDDSPESGR

SEQ ID NO: 13169 - protein, 81 aa, Octodon degus
FQEAVTFKDVAVVFTTEELGLLDPTQRELYEDVMVENFKNLVAVGHLPFKPDMVSQLEAEEKLWVMETETHGNCINQNEMT

SEQ ID NO: 13170 - protein, 81 aa, Octodon degus
MDLVTFEDVAVHFTQEEWALLDPFQKNLYRDVMEETVSNLASVGIKLDDLNIEELYQSPDENLRSHVVERLWARVEDGQCR

SEQ ID NO: 13171 - protein, 81 aa, Octodon degus
EPWAVTFADVAVYFSSEEWRCLRPAQRALYRDVMRDTYGLLSALGGGGTKPALISWVEGEAELWDPDAQDPEVVRWPAEAD

SEQ ID NO: 13172 - protein, 81 aa, Octodon degus
AVTLEDVTVNFCEEEWALLNPAQKKLYRDVMLETFGNINAIGTTLENQQMEEEYKNCLENLRNEEIAMFDREKSCNEHANI

SEQ ID NO: 13173 - protein, 81 aa, Octodon degus
ALALVSFEDVAVTFTGEEWRYLDLAQRTLYKEVMLETCELLVSLGHPVPKAELMYLLECGQGPWMMKRGLLQRTCTGRKAK

SEQ ID NO: 13174 - protein, 81 aa, Octodon degus
PKVPVTFDDVAVYFSEQEWGKLEDWQKELYKHVMRGNYETLVSLDYAISKPEVLSQIEQGKEPCTWRRAAPKIPDAPVDPS

SEQ ID NO: 13175 - protein, 81 aa, Octodon degus
SQEQVSFKDVCVDFTKEEWCLLDPTQKILYRDVILENYSNLVSVGFCIAKPEVIFKIEQGEEPWVLENGFPSHYNPEKKWK

SEQ ID NO: 13176 - protein, 81 aa, Octodon degus
AAITFEDVAVHFTTEEWALLEPSHKKFYRDVMRETFRNVAAVGRAWEHQEVKKEHKNGCRNKRNEELEKCYPVNMPTISHT

SEQ ID NO: 13177 - protein, 81 aa, Octodon degus
AVTLEDVTVTFTKEEWALLNPSQKKLYRDVMWETLRNINAVGRTWDNQQMEEKYKNCSRNRRNEEVAECCQYKTWNQQESL

SEQ ID NO: 13178 - protein, 81 aa, Fukomys damarensis
ARGPALFRDVAVVFSQEEWKRLEPAQRELYREVTLETYGNLVSLGLATSKPDVISFLEQGREPWVEERVTAGGLCPVAGSE

SEQ ID NO: 13179 - protein, 81 aa, Fukomys damarensis
VPAFSNKDSLGDEMLAAALLKAKSQKLVTFEDVAVYFIRKEWKRLEPAQRDLYRDVMLENYGNVFSLGKELLWFLSFLPCW

SEQ ID NO: 13180 - protein, 81 aa, Fukomys damarensis
VQGCVTFEDVTVYFSQEEWGLLSEAQRLLYCDVMRENFALIASLGLTSFRCHVVAQLEMGKEPWVPDRVAMTSAMARGALG

SEQ ID NO: 13181 - protein, 81 aa, Fukomys damarensis
QQGCVTFEDVTVYFSQDEWGLLSEAQRLLYCDVMLENFALIASLGLTSFRCHVVVPLEMGKEPWMPDRVAMTSAMERGALG

SEQ ID NO: 13182 - protein, 81 aa, Mus musculus
MAAVTYEDVHVNFTHEEWALLDSSQKSLYKDVMLETCRNLTAIDTFVIVDTSPVRMKTMERSNVPLHATVFFKCMKESTMK

SEQ ID NO: 13183 - protein, 81 aa, Mus musculus
MNAVTYEDLHVNFTQEEWALLDPSQKKLYKDVMVETYRNLNAIGFNWEAHNIEEYCQSSRRHRRCERSQSAEKPSEYTQCG

SEQ ID NO: 13184 - protein, 81 aa, Mus musculus
LKPGTVSFADVAVYFSPEEWRCLRPAQRTLYREVMRETYGLLASLVGGDKPALICWVEEESEVWGPGAQEPEVAMCRTEVH

SEQ ID NO: 13185 - protein, 81 aa, Mus musculus
YKEVMLENYSHLVFLGLALSKPYLVTCLEKIQETSGVKRGAAPFMLPGGKCYTCTECGKIFEWKKVFQNHQMLDLRMNPYK

SEQ ID NO: 13186 - protein, 81 aa, Dipodomys ordii
AQEAVVFSDVSIDFSQEEWECLTDGQRDLYRDVMLETYSILVSMGHSISKPHVILYLEQGKEPWLGDGELTRGQWSVLESP

SEQ ID NO: 13187 - protein, 81 aa, Dipodomys ordii
SKESVTFKDVAVDFTQEEWYHVDPAQRSLYRDVMLENYSHLVSLGYQVSKPEVIFKLEQGEEPWISEREIQRPFCPDQKTR

SEQ ID NO: 13188 - protein, 81 aa, Dipodomys ordii
SLKLVSFDDVAVDFSWEEWQYLDVAQRTLYRDVMLEIYRNIVSLGHCVPKPNLIVKLEQAVETRIREASSKNFTSVSHEAG

SEQ ID NO: 13189 - protein, 81 aa, Dipodomys ordii
VKLLSFKDVSINFSPEEREYLSPAQCTLYRDVMLENYRNLVSLAVSSQCTEPSKKHSLQKVIKGRHGKHGLSNLNLRKALD

SEQ ID NO: 13190 - protein, 81 aa, Dipodomys ordii
ALGCVTFEDVAICFSQEEWRLLDEAQRFLHLNVTLQNLALINSLGCGHEIEGEAEPRLPGGAPQVKTSKTSQSTQKTDLCG

SEQ ID NO: 13191 - protein, 81 aa, Dipodomys ordii
SNKLVSFDDVAVEFSWEEWQELDISQRTLYRDVMLETYSMLVSLGHTGPKPQLIVKLEQDEESYMREASDKNFSDVQKMKH

SEQ ID NO: 13192 - protein, 81 aa, Dipodomys ordii
SCEGSVSLRDVTIDFSREEWQHLEPAQRNLYRDVMQETYSHLLSVGYQVPEPEVFMVDQRKEPWALQGESPHQNCPELQQS

SEQ ID NO: 13193 - protein, 81 aa, Dipodomys ordii
PRSLMTFEDVAVYFSWEEWLLLDATQKALYRHVMLENFALVTSLGLSASRPRVVVLIQRGEEPWVLSEMDTGLAGSTDERH

SEQ ID NO: 13194 - protein, 81 aa, Dipodomys ordii
MLETYSNLMSLGHCVPKPELIVKLEQGAEPWIREASDKNFTDVPEMEDVISTCQESHHKYLSEVAVMNSNPGEEKVRLIRN

SEQ ID NO: 13195 - protein, 81 aa, Octodon degus
VLTFEDVAVNFTKEEWTLLNPLQKKLYRDVMEETFMNMAAIGRAWDNQEFEEQYKKYWRNLRNEQIAKCCEYKALSQYEKI

SEQ ID NO: 13196 - protein, 81 aa, Octodon degus
MDSVVIEDVVVRFTQEEWALLDSAQRDLYRDVMLETFWNLASIDDEYQFKASDSVSEQNICGGNISKKLEMAKFMKNDSWA

SEQ ID NO: 13197 - protein, 81 aa, Octodon degus
SKDLVTFGDVSINFTEEEWEWLNPVQRNLYRKVMLENYRSLVSLGISVSKPDVISLLEQGKEPWVMETEGAGDIRPDRESV

SEQ ID NO: 13198 - protein, 81 aa, Octodon degus
GGCPGPEPAKRPAGLQPAARALRPEQRTLYQEVMLENCGLLVSLGCPVPTPELMQRLEQGQQPWPVRLGDSGKTKTAEPAT

SEQ ID NO: 13199 - protein, 81 aa, Octodon degus
TQDLLTFRDVAVEFSQEEWECLDPAQRTLYREVMLENYRTLVSLGGEPWSVDGQVKVSRNRNEWKCVTSVNTDSSPKCMIK

SEQ ID NO: 13200 - protein, 81 aa, Fukomys damarensis
NLTTPHIKFPLGVILFGGSVSGDWVRQQQSVTFLRTTENVQTAGYDVTKPNVIIKLEQGEEPWTIDGDFSQTCPEVWKIDD

SEQ ID NO: 13201 - protein, 81 aa, Fukomys damarensis
GWVPALFDEVAIYFSDEEWEVLTEQQKALYREVMRMNYETVLSLEFPFPKPDMISRLEREEESQNSDEWQLQRATFAENED

SEQ ID NO: 13202 - protein, 81 aa, Fukomys damarensis
IEDVADVAVSFILEEWGHLDQSQKSLYRDDRKEIYGSITSLDYEPKDNNRELVAKQISNEASSPNSHWVAVGSTERNIPRS

SEQ ID NO: 13203 - protein, 81 aa, Rattus norvegicus
AQGGVAFHDVAIYFLREEWRLLDDSQRRLYHHVMMEVFVLMSSSGLVPSGTDITQLESSGDRFIPALRFLTPRVEPAKIPC

SEQ ID NO: 13204 - protein, 81 aa, Heterocephalus glaber
QELVTFGDVAIDFSQQEWEYLDLRQRDLYRDVMLENYRNLESLGHSISKPDVIDLLEQGKEPWTGENKRSQHELWKELQLC

SEQ ID NO: 13205 - protein, 81 aa, Heterocephalus glaber
LVTFRDVALNFSQEEWEWLDPSQKDLYREVMLENYKNLVWLDWESWCEMKELSSKWFTDEEEISQGMALERIKSHGLQCSN

SEQ ID NO: 13206 - protein, 81 aa, Mus musculus
VSFEDLVVHFTQDEWDLLAPSQKTLYGDVMLETFRNFTDTGCEWEDQKIEDHFEEPEINLRNIVTHSEYTQYEHEEYEEKP

SEQ ID NO: 13207 - protein, 81 aa, Mus musculus
LEELVSFEDVTVQFTQEEWALLDPLQRTLYRNVTLENWKNLASLGQHLDKPNLISQLEEEDKVIREDRGIIPGIHPDLEKV

SEQ ID NO: 13208 - protein, 81 aa, Mus musculus
SQVSLTFEDVAVLFTRDEWKKLVPSQRSLYREVMLENYSNLASLAGFPFTKPKVISLLQQGEDPWKVEEEGPGGFSLGLKC

SEQ ID NO: 13209 - protein, 81 aa, Octodon degus
EKELLTFSDVAIDFSPEEWECLDSVQQNMYKDVMLETYGNLISLGFSGSPPSLISFLEQIQEPYSVKRQEPLAVCPAVSSH

SEQ ID NO: 13210 - protein, 81 aa, Octodon degus
FMVPVTLEDVAVNFTMEEWECLDASQRALHRDVMSETLRNLLSVAKILMLKPGLIANPKQEERQRREDLHSPRGEALPSGS

SEQ ID NO: 13211 - protein, 81 aa, Octodon degus
MLENYGNVASLGFPFLKPAVISQLEQGGELEHPLPLATGSGIGPQVGTNMQTNSNLTKEVCEEKDSTSFELPRAFPLEINF

SEQ ID NO: 13212 - protein, 81 aa, Octodon degus
MTKPDMILKLEQGEEPWTSFADHACLKENWKAEDFLMKFKEHQDKYSRSVVCINHNKLIKQKSSICEKTLAIVKKPINQKN

SEQ ID NO: 13213 - protein, 81 aa, Octodon degus
YQEAVSFEDVAVDFTLDEWTSLDPPQRKLYSDVMLENFQNLAAVGCELLKPSLISWLEQEELRTGEGSTLKEWKVELKTKG

SEQ ID NO: 13214 - protein, 81 aa, Octodon degus
CVDFEDVAVYFSQEEWGHLSEAQRILYCDVMLENLALLSSLGCWHGAKGEEAVPEQGISAGGSQVTAAKPESPTEKTKPRE

SEQ ID NO: 13215 - protein, 81 aa, Octodon degus
MELLTFRDVAIDFSSEEWECLDPAEQKLYTEVMLENYSNLVFLGLNVSKPKLIAFLEQKKDDCILKSKGTAAIHPGMTSSP

SEQ ID NO: 13216 - protein, 81 aa, Fukomys damarensis
GGAVWRSEVVSAWHVSVVSEGKIWELLGSKPESLFRDQCWYQAPKPDMICKLEKGEEAWSGKRKRSSQNHLSKLARSKQTG

SEQ ID NO: 13217 - protein, 81 aa, Fukomys damarensis
YQDSVTFEDVALDFTQEEWVLLDQSHRDLYREVMLENYENLASMGCELVKPSLISWLENKKDWRTGQRGDPREWEMQLSTK

SEQ ID NO: 13218 - protein, 81 aa, Fukomys damarensis
MEEWALLYPSQKKLYRDVMGETFRNIAAIGRMWNNQEVEEDYRNYWRNLRNEEVEKCYQYKAWNQYEETFLCTPVANVHGK

SEQ ID NO: 13219 - protein, 81 aa, Rattus norvegicus
SQCLLTFRDVAVDFPQEEWECLDSTQRALYIDVMLENYRNLVSVENYCICDATYQHVKTDKESHHFNEFGEMLPEPSHSAL

SEQ ID NO: 13220 - protein, 81 aa, Rattus norvegicus
QEMLSFRDVAIDFSAEEWECLDLAQWNLYRDVMLENYSNLVFLGLASCKPYLVTFLEQRQEPSVVKRPPAATMHPGGKPYK

SEQ ID NO: 13221 - protein, 81 aa, Rattus norvegicus
MLDNYRNLASLGLCASKPDMIALLEQGTDPWMMGRGRCTDLKAVQETKELPPKDLSEETSQAVLRRRLLHRRPMCYMSGAS

SEQ ID NO: 13222 - protein, 81 aa, Rattus norvegicus
LQVPVSFEDVAVDFSRGEWQQLNSFQRCLYQDVMLENYSHLLSVGLKVPKPEVILKLEQGEEPWTLQEVAPYQNFSGGKFR

SEQ ID NO: 13223 - protein, 81 aa, Mus musculus
PQGQLTFKDVAVDFSQEEWQCLDCAQQALYMDVMLENYNNLFFVENHCMCPKFEKMLDQDLQHIVLEHVNTQVKSYECHEL

SEQ ID NO: 13224 - protein, 81 aa, Dipodomys ordii
EEWTLLDPSQKNLYREVMLDALWSLACEAVTFDDVFVNFTLEEWALLDAAQQQLYRDVMVETFRNLASIRRTTIICTSKMF

SEQ ID NO: 13225 - protein, 81 aa, Octodon degus
MPLTFQDVAVYFSRAERRQLGPRQRALYRDVMLENYGNVASLGFPIPKPELISQLEQGEELWVVDLLGAEEPEVLRTCRTD

SEQ ID NO: 13226 - protein, 81 aa, Octodon degus
VEKGLLTLEDVAVRVTQEEWQLLGPAQRSMYQNVMLENYCSLVSVGYQASKLDALSKLLHGEPWRAEDELHCQALSDIRKA

SEQ ID NO: 13227 - protein, 81 aa, Octodon degus
SHDLVMFRDVTVDFSAEEWECLNFYQRNLYRDALLENYSKLVSLECSITKPDVITLLEQGKEPWMLVADEKRWSLGLESAY

SEQ ID NO: 13228 - protein, 81 aa, Octodon degus
SQGLVTFGDVVVDFSRDEWQWLNSMQRSLYRKVMLENYRNLASLGLCASKPDMISFLEQGQDPWMARKRRTGGRRPDSGAV

SEQ ID NO: 13229 - protein, 81 aa, Octodon degus
QEISVSFKDVVVGFTQEEWHRLNPAQRALYRDVMLETYSNLVSVGYEGTKPDVILRLEQEEAPWICEASCPGCYCREDIWQ

SEQ ID NO: 13230 - protein, 81 aa, Octodon degus
MALLTFRDVVIDFSLEKWKCLDLAQRTLYRDVTLQNYRNIFSLGLAVFKPHLVTCLEQNRDPWNVQPRNKAAAPPVHISEK

SEQ ID NO: 13231 - protein, 81 aa, Rattus norvegicus
MSGLKEEWGYLDAAPRSLYKDVVMDSYGKLVSLDVLNRNEDEEPTVKEEIEKDIEPQGIIVTRIKSELDQDPMGSETFELV

SEQ ID NO: 13232 - protein, 81 aa, Phytophthora kernoviae
EQEQVVKEVMEYYTQQEQQIQETKQRLLAMNITLPVQVTVRPVPDAWQNEDQQLPGLLEGDEDQWSLQRREGHSTGPFADA

SEQ ID NO: 13233 - protein, 81 aa, Cervus elaphus
LQDTVTFKDVAIDFTQEEWQQLDPAQRNLYRNVMLENYNNLITVGCPFTKPDVIFKLEQEEEPWVMEEEVLKKHCPGEIWG

SEQ ID NO: 13234 - protein, 81 aa, Cervus elaphus
PEGRVTFEDVAVYFSWEEWGLLDEAQRLLYHRVMLETFSLMASLGLTSFRTHDMTQLEQWEEPCVPAEGVSTTATPAGCWC

SEQ ID NO: 13235 - protein, 81 aa, Cervus elaphus
RSLTFRDVAIDFSQEEWGFLDPAQRELYTAVMSETYQNLVWLGISVADPNIAFLLERGPQPWVMREEDAEAPGAGESGTKL

SEQ ID NO: 13236 - protein, 81 aa, Cervus elaphus
FQVPVTYEDVAVTFTQEEWGHLGPVQRTLYWEVMLETCRLLVSLGCPLPEPELISPAEPGPESQTSKRGPTPGSCSCDNKN

SEQ ID NO: 13237 - protein, 81 aa, Colobus angolensis
KKKLISFQDLTVNFTQEEWQQLDPAQRLLYRDVMLENYSNLVSVGYHVSKPDVIFKLEQGEEPWIVEEFSNQNYPEVDDAL

SEQ ID NO: 13238 - protein, 81 aa, Colobus angolensis
AAVSVTFKHVTMTFTQKEWKQLDPAQRNVYHDVMLENYSNQASMGYQAPKPDMISKLEKGEAPWLGKGKRPSQGCPSKIAR

SEQ ID NO: 13239 - protein, 81 aa, Colobus angolensis
MDSVAFEDVAVSFTQEEWALLDPSQKNLYRDVMQETFRNLTSVGKTWKVQNMEDKYKNPRRNLRWSFALVAQAGMQWCDLG

SEQ ID NO: 13240 - protein, 81 aa, Colobus angolensis
AQVSVTFEDVAVTFTQEEWGQLDAAQKTLYQEVMLETCGLLVSLGCPLFEPELIYQLDRREELWIVKKDVSQSSCPGDNTK

SEQ ID NO: 13241 - protein, 81 aa, Colobus angolensis
ALALVSFEDVVVTFTGEEWGHLDLAQRTLYQEVMLETCRLLVSLGHPVPKPELIYLLEHGQDLWTVKRGLSQSTCAGEKAK

SEQ ID NO: 13242 - protein, 81 aa, Colobus angolensis
SEELLTFRDVAIEFSPEEWKCLDPAQQNLYRDVMLENYRNLVSLGVAISNPDLVTCLEQRKEPYNVKIRKIVARPPAVCSH

SEQ ID NO: 13243 - protein, 81 aa, Colobus angolensis
QLLFRDVAIEFSQEEWKCLNPGQKALYRDVMLENYRNLVSLDFSLLARDPRVFRVKAWRTSGGAQEPTSPNFGGNESPLPS

SEQ ID NO: 13244 - protein, 81 aa, Colobus angolensis
LQGSVSFKDVTVDFTQEEWQQLDPAQKALYRDVMLENYCHFVSVGFHMTKPDMIRKLEQGEELWTQRIFPSYSYLEEDGKT

SEQ ID NO: 13245 - protein, 81 aa, Colobus angolensis
SQGSVTFRDVAIDFSQEEWKWLQPAQRDLYRRVMLENYGHLVSLGLSISKPDVVSLLEQGKEPWLGKRNVKRDLFSASESS

SEQ ID NO: 13246 - protein, 81 aa, Mustela putorius
EGIVTFEDIAVSFSWEEWDLLDEAQRHLYQDVMLENLALITSLGCWHGAEDEEARSEQSISVERESQVRTPKTGLFPQKAN

SEQ ID NO: 13247 - protein, 81 aa, Mustela putorius
GQGSVSFRDVTVDFTRDEWSQLTGTQRTLYRDVMLENYSHLVSVGCHLAKPEVIFRLEQGEELWPSDAGIPDQGDQDRNQE

SEQ ID NO: 13248 - protein, 81 aa, Mustela putorius
PQKSVTFEDVAVYFTQTEWDGLSPAQRALYRDVMLENYGNVASLGFSLLKPAVISQLEGAGELGRPSPLVAGTEIGLQGLW

SEQ ID NO: 13249 - protein, 81 aa, Mustela putorius
AQELVTFKDIAIDFTQEEWALLDTSQRKLYRDVMLENISHLVSVGYHLCKSDVISQLEQGVELWREGRGFLQGLNPDRKSG

SEQ ID NO: 13250 - protein, 81 aa, Mustela putorius
LQEQVSFKDVCVDFTQEEWYLLDPAQKILYRDVILENYSHFVSVGYCITKPEVVFKIEQGEEPWILEAGFPSHCHQEDWKV

SEQ ID NO: 13251 - protein, 81 aa, Mustela putorius
KSLGSVSFKDVTVDFSKEEWQQLNLAQKSLYRDVMLENYFNLISVGCQVPKQEVIFSLEQEEPRMLDGETSSHSALGGDIG

SEQ ID NO: 13252 - protein, 81 aa, Mustela putorius
QEPVTFADVAVLFTPEEWMFLDSAQRSLYRDVMLENYRNLASVGAGDQLGKPSTLSLSEPGEDLWAPERRTFPGTHPEPQH

SEQ ID NO: 13253 - protein, 81 aa, Tupaia chinensis
NTVTFEDVAVEFTKEEWVLLDSSQRKLYRKVMLETYDNVASLGHKLSKPILIIQLEQECTLNTAERIRRHPHSAFRKKESL

SEQ ID NO: 13254 - protein, 81 aa, Tupaia chinensis
MPLTFQDVAVYFSEAEGQQLGPQQRALYRDVMLENYGNMASLGFPVPKPELISQLEQGEELWVLDLMGEEKPEVARLCQTA

SEQ ID NO: 13255 - protein, 81 aa, Tupaia chinensis
QKFQRSVSFKDVTVGFTQDEWQQLDPSQRSLYRDVKLENYSHLVSVGFCVTKPEVIFRLEQGEEPWILEKEFPSQNFPGNN

SEQ ID NO: 13256 - protein, 81 aa, Carlito syrichta
EVGLLSFKDVAIEFSPEEWACLNSPQRTLYRTVMLENHRNLVFLGLAVSKPDLITCLEQRKEPWDMKRHGTLAKIPAVTSH

SEQ ID NO: 13257 - protein, 81 aa, Gulo gulo
DLVVLEDVAVDFTLEEWALLDSVQKNLYRDVMLETLQNLVSVDYETLFKASGLVSQQDTLEKKKSIEQKMAKFTGNHSCAY

SEQ ID NO: 13258 - protein, 81 aa, Tupaia chinensis
MLENISHLVSVGYQFCKSDVIFHLAKDEMEWTVEGRGFSQGQSPASFAFTMTPEATFTLRLGPVHSNFVSINFTIFHGLLG

SEQ ID NO: 13259 - protein, 81 aa, Odobenus rosmarus
STEPVIFRDVAMYFTQKEWQLLEPAQKDLYREVMLENYGNLASLGYRLFKPKLITRLEQGDEPCVKERDVPRAPQQGGAGV

SEQ ID NO: 13260 - protein, 81 aa, Odobenus rosmarus
GTVTFEDIAVSFSWEEWDLLDEAQRHLYQDVMLENLALITSLGKQQQKQHVSDKPFGNNVSRASVVKSCRLQVSGKPFICG

SEQ ID NO: 13261 - protein, 81 aa, Odobenus rosmarus
WEAWLEKPVTFDDVAVNFTQEEWVCLDASQRVLYQDVMSETFRNLMSVDLIIELEQEDKQWRAELQLHPPNGEGLPSGGRK

SEQ ID NO: 13262 - protein, 81 aa, Odobenus rosmarus
CEGSVSFEDVTMDFSREEWQQLDPAQRCLYWDVMLEIYSHLLSVGYHIPNPEIISRREKGKKSWVRGAQLPHQRHRVVFGL

SEQ ID NO: 13263 - protein, 81 aa, Delphinapterus leucas
MDSVVFEDVAVNFTVEEWALLDLAQRKLYRDVMLETFRNLASVGSCPQVKTSGSSPQWDILENELCSEKKIVRCTRNDSCS

SEQ ID NO: 13264 - protein, 81 aa, Delphinapterus leucas
PLQGSVSFRDVAVDFSREEWQQLDLDQKNLYRDVMLETYSHLLSVGYQVPETEVFMLEQGKEPWALQGESPHQSCPEGLWQ

SEQ ID NO: 13265 - protein, 81 aa, Delphinapterus leucas
FQGSVSFKDVTVDFSREEWQQLDLAQKSLYRDVMLENYFNLISVGCQVPKPEVIFNLERGEQPCMLDGEISSQSYLDQGIG

SEQ ID NO: 13266 - protein, 81 aa, Delphinapterus leucas
MAQESVMFSDVSIDFSQEEWEYLNDDQRDLYREVMLENYSNLVSMDVISFLEQGKEPWLVDRELTRDQWPVLESRCETKKL

SEQ ID NO: 13267 - protein, 81 aa, Delphinapterus leucas
GQLTLSDVAIEFSPEEWECLDLAQRALYRDVMLETYRNLISVDISHIHVVRKLQLKSNIDRGGVFQTVILGRHEIQEPFYL

SEQ ID NO: 13268 - protein, 81 aa, Delphinapterus leucas
SQGPVSFEDVSMGFTQEEWQHLDPAQRTLYRDVMLGNYSHLISVGYCVIKPEAIFKLQQGEEPWMLEEESQSQSHPDFCVV

SEQ ID NO: 13269 - protein, 81 aa, Delphinapterus leucas
SLGSDLFRDVAVVFSQEEWEQLVPAQRDLYRDVMLEIYSNLVSLGFAISKPDVISFLEQGREPWMVEKVATGGQCPVLESR

SEQ ID NO: 13270 - protein, 81 aa, Delphinapterus leucas
TPEPLSFADVAVYFSPEEWGCLRPAQRALYRDVMRETYGHLGALGFRGTKPALISWVEEEAELWGPDARDPETGECLREAD

SEQ ID NO: 13271 - protein, 81 aa, Carlito syrichta
FQEVVTFGDVAVHFSREEWQCLDPGQRALYREVMLENHSSVAGLAGFLVFKPELISRLEQGQEPWFLDLQGAERTETPRTS

SEQ ID NO: 13272 - protein, 81 aa, Carlito syrichta
CVTFKDVSIYFSQEEWELLDESQRHLYLEVMLENSALITSLAYWHGMEDEEISSTQSVSVGKTSQVRTPRACLSPQKTHPC

SEQ ID NO: 13273 - protein, 81 aa, Delphinapterus leucas
AQGLMAFEDVAVYFSREEWGLLDAAQRALYRRVMLENFTLLASLGLSVSRPHVVIQLECGKEPWVLNGTDVTLARNAQRRP

SEQ ID NO: 13274 - protein, 81 aa, Carlito syrichta
MSQVTFSDVAIDFSHEEWTWLDSAQRNLYKDVMVQNYKNLVSLGLSVTKPYVITLLEDGKEPWMVEKKLSKGMFPDWESRW

SEQ ID NO: 13275 - protein, 81 aa, Carlito syrichta
SQGLLTFRDVAIEFSPEEWECLDPIQRILYRNVMLENHRNLVSLGLAVSKPDLIMCLEQRKEPWNVNRHNMLEKPTAMTSH

SEQ ID NO: 13276 - protein, 81 aa, Delphinapterus leucas
SHTLVTFKDILVNFTREEWKLLDPAQQLMYKDVMLENYRNLVSLGHQLPKPEVILQLEKGEEPWLLERGIHQETYPDLETA

SEQ ID NO: 13277 - protein, 81 aa, Delphinapterus leucas
QSQETLTFDDVTVDFTWEEWQLLTPPQKDLYQEVMLENYSNLLSVGYQARKPDVLSNLDHGEPWMIEDEIHCRTHSGYQAS

SEQ ID NO: 13278 - protein, 81 aa, Delphinapterus leucas
APFPVAFDDVALYFLEREWEILEKWQKDMYQQEMKNNYESLDSLGCISSKPDLITWMEQGRMLLIRDQGHLEKTQMTLSLS

SEQ ID NO: 13279 - protein, 81 aa, Carlito syrichta
SQKSLTLEDVVVEFTWEEWQLLDPAQKDLYQDVMLENYRNLVSLGYQASKPDTLSKLEQGEPPWTIEDKIHCEGPSEIWKV

SEQ ID NO: 13280 - protein, 81 aa, Delphinapterus leucas
MLEIYGNLTSLGYPVPKPALVSLLERGDLPWGLETQDDPPAQGTKHICKNAGTNTDNELTPTWGVSEERDMMMSHGPQKNV

SEQ ID NO: 13281 - protein, 81 aa, Erinaceus europaeus
SLGTVSFDDVKVTFSWEEWQLLSDAQRNLYQTVMLETYSSLTALGRGVSKPEVIVKLEQGAEPWTVAEPPPRSLSAFRIFH

SEQ ID NO: 13282 - protein, 81 aa, Mustela putorius
MLENYSNLVSLGYCVTKPEVIFRLERGEEPWILEEEFPSQSFPEIWKTDHKKERNHKNQPKHVWEVAFINNKTLTKEQGNV

SEQ ID NO: 13283 - protein, 81 aa, Mustela putorius
APLPLTFDDVAIYFSEQEWQNLQARQKELYKHVMRTNYEILVSLDNGLPKPELISWIEQEKEFFQNWREAQKSGTIICSSA

SEQ ID NO: 13284 - protein, 81 aa, Mustela putorius
YQDVMLENFRNLVSVGHQPFKRDKWLTEREERRPWLTKTAPQIERNVGGNSQSALRTVRGREPHEELSCWQIWQHITDDLS

SEQ ID NO: 13285 - protein, 81 aa, Mustela putorius
DSVTFEDIAVYFSWEEWRLLDEAQRCVYHDVMLENFTLVSSLGCCCGAENEEAPFAQSASVGVSQTWMPRAALSSRKTHPC

SEQ ID NO: 13286 - protein, 81 aa, Tupaia chinensis
GPLTFKDVAVEFSQEEWKRLDPAQRALYRDVMLENYRNLVSVDKSPKSVISELPLRENSNTGQIFQTVMLERPKSHDMEDF

SEQ ID NO: 13287 - protein, 81 aa, Vicugna pacos
PQKSVTFEDVAVYFTQTEWDGLSPAQRALYRDVMLENYGNVASLGFPLLKPAVISQLEGGVDIDIQTDNNLTEEMYEEKHN

SEQ ID NO: 13288 - protein, 81 aa, Vicugna pacos
DPVAFEDVAVNFTLEEWALLDPSQKKLYRDVMRETFRNLASLGETWKDHIIEDQYRQQGRKLRSCKVGRICEEKEDSPCEE

SEQ ID NO: 13289 - protein, 81 aa, Vicugna pacos
WSQMPVTFEDVALYLSREEWGQLDHTQQSFYRDVLQKRNGLSFGFPFSRPFWASQVQGKGEASSSSRQTGDEERRGAMEVG

SEQ ID NO: 13290 - protein, 81 aa, Vicugna pacos
RESGKAPVTFDDITVYLLQEEWMLLSQQRKELCGSDKLEAPLGPTIANPELFYKFERGPEPWLASVQGQRTLLSHHPGKSK

SEQ ID NO: 13291 - protein, 81 aa, Vicugna pacos
LRGLFTLKDVAIEFSQEEWECLVPAQRALYRDVMLETCRNLLSLGEENFPPEVGSHSAGLAIKELLPKEDIHKGELYHLVI

SEQ ID NO: 13292 - protein, 81 aa, Vicugna pacos
MWRFLAGDISHDLSFFLSCTLTVLHSLPAPAENDHVPGYCIPKPEVILKLEQGEEPWILEEESSSQSVPELINSSENYSRN

SEQ ID NO: 13293 - protein, 81 aa, Vicugna pacos
LGTVTFEEVAVYFSQEEWRLLDETQRLLYRDVMLENFVLVASLGCWRRAEDKETTCVQEVSGKGPQVNTSKADLSTQKAYP

SEQ ID NO: 13294 - protein, 81 aa, Vicugna pacos
MASRSPPPEPKEWDYLEPAQRSLYKDVMMENYGNLVSLDVLNRDKEEEPTVKQEIEEIEEEVEPQGVIVTRIKSEIDQDPM

SEQ ID NO: 13295 - protein, 81 aa, Vicugna pacos
SQGSLSFRDVTVGFTWEEWQQLDPAQRALYRDVMLETYSHLLSVGYCIPKPEVILKLEQGEEPWILEEESSSQSVPELINS

SEQ ID NO: 13296 - protein, 81 aa, Odobenus rosmarus
WSQMPVTFEDVALYLSREEWGRLDHVQQSFYRDVLQKRNGLSLGFPFSRPFWASQGQGKGEASSSCRQMGDEEEKPGATEM

SEQ ID NO: 13297 - protein, 81 aa, Odobenus rosmarus
PQDLMTFEDVAVEFTQWEWGKLDPAQKDLYRAVMLENFKNLASLGLPVSKPYVISQLEEGKEPYVLEGEISTDWEKRPKAK

SEQ ID NO: 13298 - protein, 81 aa, Odobenus rosmarus
FQVPLTFSDVAIDFSQEEWECLNSSQRDLYRDVMLENYTNLVSLDFDFTTETNKLSSEKSSYEVNSYHRETLKRSKTFNLM

SEQ ID NO: 13299 - protein, 81 aa, Odobenus rosmarus
AHRSVTFRDVAIDFSQQEWEYLDSLQKNLYRDVMMENYDNLVSLGHSISKPDVITLLEQGKDPWMVVREDTRRWCTDLESR

SEQ ID NO: 13300 - protein, 81 aa, Odobenus rosmarus
SHGPLSFEDVAIAFTKEEWQQLDPAQRTLYRDVMLENFSHLVSLGHPVSKPDIISRLEQGEEPWIIKRDISDWICPERETR

SEQ ID NO: 13301 - protein, 81 aa, Delphinapterus leucas
LELVTFKDVAVNFTQEEWQQLEPAQRGLYKDVMLENFQNLSSLAGPGRSGRWLPLGLCIRRGRDSFRKGPFRASARRPPAR

SEQ ID NO: 13302 - protein, 81 aa, Gulo gulo
MLENYANVASLAFPFPKPDLISQLESGEAPWGPDPWEAELLRGICPGGESWIKEEEPAVKQEASEQAELPRTPGGGLLRNV

SEQ ID NO: 13303 - protein, 81 aa, Erinaceus europaeus
AVISLEFRDVAIDFSPEEWEYLGPSQKALYRDVMLENYSNLVSLGCSIPKPEVITLLEQEKEPWMIKREGTRSVCTDLESN

SEQ ID NO: 13304 - protein, 81 aa, Erinaceus europaeus
CKELVTFKDVAVDFTREEWGQLDSPQRALYCDVMLENYQNLLALGPLVCKPDVISHLERGEEPWHIPRGVPGGPHTEWGPR

SEQ ID NO: 13305 - protein, 81 aa, Erinaceus europaeus
QESVTFQDVSVDFSREEWGLLDPTQRTKYHDVMLETLGNLVSVGWETTLESKQLTPESSTSKEVPGLGTEVLREESSNSGN

SEQ ID NO: 13306 - protein, 81 aa, Erinaceus europaeus
GVAFEDVAVFFSLDEWELLGEAQRLLYHTVMLENLGLLLSLGCGHGAEDEGPSERSISVLQLGVSRGGPPQTHLPSRKALP

SEQ ID NO: 13307 - protein, 81 aa, Erinaceus europaeus
AQGPLSFEDVAVDFSREEWQLLTPSQKALYRDTMLETHSNLVSVGGGAAEPGSLLCLEQGEPLWTLEGAAQSQSCAVLSSG

SEQ ID NO: 13308 - protein, 81 aa, Erinaceus europaeus
PWDMVSFEDVAVMFTWEEWQELEEDQRSLYRDVMLETYSILASVGLCITKPEVIISLECGAEPWSIRKPLIHSLSGEKLFE

SEQ ID NO: 13309 - protein, 81 aa, Tupaia chinensis
MLETYSSLVSLGHCITKPEVIFKLEQGAEPWTLEELPNQSLPDVQIVKDLERCQENQDRYLWQVLITNSNPSSQERVETKK

SEQ ID NO: 13310 - protein, 81 aa, Tupaia chinensis
GSIAFEDVTMAFSQKEWKQLDPAQRNLYKDVMLENCNNLASVEKHKTLSRISSSKHDKSQASVKPYECNQCGKVLSHKQGL

SEQ ID NO: 13311 - protein, 81 aa, Vicugna pacos
MGMAGLFSEGFIQRCHVGKLQELGLSISKPNMISLLEQGKEPWLVEREMSDGQYADWESWYEIKALSPKWYIDEEEISQGM

SEQ ID NO: 13312 - protein, 81 aa, Vicugna pacos
AQESLTYDDVAMKFTWEEWQLLAPDQKVLYRDVMLENYSHLVSVGYQASKPDTLSRLERGEELWTIEAEIHRRVHAGRWVR

SEQ ID NO: 13313 - protein, 81 aa, Vicugna pacos
PQAKVTFEDVAVLLSQEEWDRLGPAQRGLYRHVMMETYGNVVSLGLPGSKPRVISQLERGEEPWVLDRQGAEEHRGLGSEH

SEQ ID NO: 13314 - protein, 81 aa, Vicugna pacos
SQEPVTFEDVAVYFTQDQWVSLAPAQRALYREVMLENYANVVSLAAFPFPKPDLVFQLERGGAPWGLDAWTAIGAKALRGI

SEQ ID NO: 13315 - protein, 81 aa, Vicugna pacos
MDPVAFEDVAVNFTLEEWALLDPSQKKLYRDVMRETLRNLASVGGKWEDHNTEDKYKDQGRNLRSHTFERDCESNEGSQDG

SEQ ID NO: 13316 - protein, 81 aa, Vicugna pacos
PQESVTFKDVAVNFTQEEWHHVDPAQRRLYKDVMLENYSHLVSLGYQVSKPEVIFKLEQGEEPWIAEGEIQRPFYPAAFNC

SEQ ID NO: 13317 - protein, 81 aa, Vicugna pacos
AQGSVMFSDVSIDFSQEEWECLNDDQRDLYRDVMLENYSNLVSMGHCISKPDVISFLEQGKEPWLVDREPTRYQWPVLESR

SEQ ID NO: 13318 - protein, 81 aa, Vicugna pacos
FKEALTFKDVAVVFTEEELRLLDSTQRELYQDVMLENFRNLVSVGHLPFKPDMVSQLEAEEELWMTERETQRNGCSGENRA

SEQ ID NO: 13319 - protein, 81 aa, Vicugna pacos
PQGSVSFKDVTVDFTQEEWQQLDSAQKALYRDVMLENYCHFVSVGFHMTKPDMIHKLEQGKELWTTGRIFPSRSYPEDDGK

SEQ ID NO: 13320 - protein, 81 aa, Vicugna pacos
GQGPVTFEDVAVSFSQEEWGLLSDAQRLLYHDVMLDTLSLLASLGCWPGVHAEVVTSEQGVSVEQVAQARSPKPDPSTLKT

SEQ ID NO: 13321 - protein, 81 aa, Vicugna pacos
MAEDLKFKDVAIYFSQKEWEGLLSAQKDLYRDVMLESYDNLLSLGFSDSKPDVISLLEQGKDPWMVKSKESKEWCPGWESR

SEQ ID NO: 13322 - protein, 81 aa, Vicugna pacos
FWPPVSFKDVAVTFTWEEWGQLDPAQRTLYRDVTLETCSHLVSLGLLLSKPDVICRLEQGEDPWRVQRGPPRDWKITLEKK

SEQ ID NO: 13323 - protein, 81 aa, Vicugna pacos
CQGSLSFEDVTVGFTQEEWQQLDPAQRTLYRDVMLENYSHLISVGYCISKPELIFKLEQGEQPWVLEKESPSQDYPEVCRV

SEQ ID NO: 13324 - protein, 81 aa, Odobenus rosmarus
SVGPVSFRDVAVDFTQEEWQQLEPEQKTTYRDVMLENYSHLVSVGCHIIKPEVIIKLEQGEEPWIVEGAFLPQSYPEELWK

SEQ ID NO: 13325 - protein, 81 aa, Odobenus rosmarus
QESVTFKDVAVDFTLEEWGQLGPGQRELYRDVMLENYQNLLSLGVGPLGSKPDVISRLERGEEPRMEKKEVRQATCPALHT

SEQ ID NO: 13326 - protein, 81 aa, Odobenus rosmarus
MFKEAVTFKDVAVAFTEEELGLLDSAQRKLYQDVMLENFRNLVSVGHQPFKRDKWHIEREERPWLMKTASPIERNVGGSNQ

SEQ ID NO: 13327 - protein, 81 aa, Odobenus rosmarus
SKDLVTFGDVAVDFSQEEWEWLNPAQRNLYRKVMLENYRSLVSLGVSVSKPDVISLLEQGKEPWMVKKEGTRGTCPDWEYT

SEQ ID NO: 13328 - protein, 81 aa, Odobenus rosmarus
GPGGVSFADVAVYFSPEEWGCLRPAQRALYRDVMRETYGHLGALGFRGAKPALISWVEEEADLWGPAARDPEVGECLTEAD

SEQ ID NO: 13329 - protein, 81 aa, Odobenus rosmarus
SQAPVTFEDMAMYLTREEWRPLDPTQRDLYRDVMQENYGNVVSLDFEIRSENEVNPKQEISEDVEFGTASERPVENTEENP

SEQ ID NO: 13330 - protein, 81 aa, Odobenus rosmarus
VMAHMAFRDVAVDFSQEEWMLLSPAQRSLYREVMLENYSNLVSLGIPFSKPKLITQLEQGKETWREERTCPPATRPVEPKP

SEQ ID NO: 13331 - protein, 81 aa, Odobenus rosmarus
GRKGSLSFKDVAVVFTWEEWQLLDPIQKNLYQDVMLENYSNLVSLGYQITKADAFYQLEHGTPWITEEEIQSQIHPEDTWQ

SEQ ID NO: 13332 - protein, 81 aa, Odobenus rosmarus
SQGPLTFRDVAIEFSQEEWECLTHTQQELYRDVMLENYRHLLFLGLIVSKPDLIIFLEQEEQFWGVKRKETVTFHPGISSL

SEQ ID NO: 13333 - protein, 81 aa, Odobenus rosmarus
NFWILRLPPGSKGEAPKEWGKLDEWQKELYKHVMRGNYETLVSLDYAISKPEVLSQTEQGKEPCSWRRPGPKVPDVPVDPS

SEQ ID NO: 13334 - protein, 81 aa, Odobenus rosmarus
SQEPVTFEDVAVYFTQNQWASLDPMQRALYLEVMLENYANITSLAALPFPKPDLILQLEQGEAPWGLDPWTPLEREALGGV

SEQ ID NO: 13335 - protein, 81 aa, Delphinapterus leucas
FQEPVSFKDVAVVFTEGELGLLDSAQRKLYRDVMLENFRNLLSVGNQPFKPELIFQLEREEELLMMETETQRDGCSGTKSQ

SEQ ID NO: 13336 - protein, 81 aa, Delphinapterus leucas
ARMIVTYEDVAVTFTQEEWGQLDPAQRTLYQEVMLETCGLLVSLGCPLPKPELIHPLEHSPELQTWKRGLSPSSCPVRESG

SEQ ID NO: 13337 - protein, 81 aa, Delphinapterus leucas
SQPPVSFKDVAVTFTWEEWGQLDLAQRMLYREVTLETCSHLVSLGLLLSKPDVIARLEQGEDPWRVEPGPPRDWKTTLEKK

SEQ ID NO: 13338 - protein, 81 aa, Delphinapterus leucas
KHGCAISEDVFVYFSREEWVLLDEDQRLLYRDVMLENFALLAFLGIASSRSHLVTQLEQGEELWMPAQVDMTPATEKEAQK

SEQ ID NO: 13339 - protein, 81 aa, Delphinapterus leucas
SQESVSFEDVAVYFTRNQWASLDSAQRTLYREVMLENYANVTSLAAFPFPKPDLIFQLERGKAPGGLDPWTPIRREVRGVC

SEQ ID NO: 13340 - protein, 81 aa, Carlito syrichta
SQGLLTFKDVAIEFSPEEWECLDPPQRILYRNVMLENHRNLVFLGLAISKPDLIKCLEQRKEPWDVKRHSTLAKPPAVTSH

SEQ ID NO: 13341 - protein, 81 aa, Carlito syrichta
SKDLVTFGDVAVNFSQEEWEWLNPAQRNLYRRVMLENYRSLVSLGVSVSKPDVISLLEQGKEPWMVKKEGTRGACPDWEYV

SEQ ID NO: 13342 - protein, 81 aa, Carlito syrichta
PQDLVTFKDVAIDFSKEEWQWMNPAQKRLYRGMMLENYQCLESLGLCISKPYVISLLEQGKEPWEVKSEMTRSPFSDRESI

SEQ ID NO: 13343 - protein, 81 aa, Carlito syrichta
KMNMAQKGSVSFEDVTVELTREEWRLMGPRERSLYRDVMLENYGHLVAVGCCFTKPKVILKLEQGEEPWPLEVKFLNRKYP

SEQ ID NO: 13344 - protein, 81 aa, Carlito syrichta
PLESVTFEDVVIDFTQEEWALMDTSQRNLFRDVMLENIKHLVSIGYELCKSDMIFQLEQGKELWREGVLLQGQSLGRKSAL

SEQ ID NO: 13345 - protein, 81 aa, Carlito syrichta
SQGLLTFMDVAIEFSLEEWECLDPTQRMLYKNVMLENHRNLVFLGLAVSKPDLITCLEERKEPWNVKRHNTLAKPPDPGDH

SEQ ID NO: 13346 - protein, 81 aa, Carlito syrichta
AHVSLTFRDVAIDLSQEEWEYLDPTQRDLYRDVMLENYSNLVSLGCTVPKPDVITLLEQEKEPWIVLREGTTSWYTDLEYV

SEQ ID NO: 13347 - protein, 81 aa, Carlito syrichta
FQESLTLEDVAVEFTWEEWQLLDCFQKDLYRDVMLENYNHLVSLGYQDSKSDALSKLAQGQEPWIMEDKIQRRNCPGISKI

SEQ ID NO: 13348 - protein, 81 aa, Carlito syrichta
SQETVTFKDVAIDFTQEEWKQLDPAQRNLYRNVMLENYNNLITVGYPLTKPEVIFKLEQEEEPWVVEEEVLRRHCPGEIWE

SEQ ID NO: 13349 - protein, 81 aa, Carlito syrichta
SQGPVSFKDVAVDFTQEEWQQLDLNEKITYRDVMLENYSNLVSVGCDITKPNVIIRLEQGEEPWIIESEFSSQSSPEEVWE

SEQ ID NO: 13350 - protein, 81 aa, Carlito syrichta
LQESLTFKDVFVDFSREEWQQLDSAQKTLYRDVMLENYSHLVSVGYLLAKPDVIFRLGPREESWMADGGTRIRTCPGEHTP

SEQ ID NO: 13351 - protein, 81 aa, Carlito syrichta
AQGLVTFRDVAIDFSQEEWKCLEPAQRDLYRDVTLENFSNLVSLGLSISKPDVISLLEEGKEPWVIANDATRPWCPDLESR

SEQ ID NO: 13352 - protein, 81 aa, Delphinapterus leucas
SVTFEDVAVYFSQEEWRLLDEAQRFLYHDVMLETFALVASLGCWHGAKVKETPSEQNVFVEVPRINTSKTNLSTQEAYPWE

SEQ ID NO: 13353 - protein, 81 aa, Delphinapterus leucas
MARQDLAVRFSEDEWRLLGEGQRALYLDVMRENYETLASLGTVELLPLSAFLCPSEPGGAVGGGGCAADGQDPPRGGGPLG

SEQ ID NO: 13354 - protein, 81 aa, Delphinapterus leucas
PKVPVTFDDISIYFSTPEWEKLEEWQKELYKNIMKGNYESLISMDYAMNQPDVLSQIQPEGDHNTEDQAGPEESEIPTDPT

SEQ ID NO: 13355 - protein, 81 aa, Carlito syrichta
FQDLVTFEDVAVDFSQEEWEWLSSAQRHLYRKVMLENYRNLVLLGLCVSKPDVISSLEQGKEPWTVKRKTRGQCPDLKAVQ

SEQ ID NO: 13356 - protein, 81 aa, Gulo gulo
SQGPVSFRDVAVDFTQEEWQQLEPDEKTTYRDVMLENYSHLVSVGYDSVKPKVILKLEQGEEPWVADGEVPCQSQPEEVWK

SEQ ID NO: 13357 - protein, 81 aa, Gulo gulo
IQEPVTFKDVAVDFTQEEWGQLDPVQRTLYRDVMLETYGHLLSVGNQIAKPEVISLLEQGEEPWSVEQAYPQSTCPEWMRN

SEQ ID NO: 13358 - protein, 81 aa, Erinaceus europaeus
MVENVALFFTQKEWDYLDPTQRSLYQDVVMDNYGNLLSLDVLNSDKDEEPIIKQEIEEIEEEVEPQNVILTKIKSEIDQDP

SEQ ID NO: 13359 - protein, 81 aa, Erinaceus europaeus
PLTLTSEDVIIIFTWDEWTILNSQKKLAREVMRQNYTNVMSYLLISIDAQVIISTHVPGYGNYELTFEGKSQGNLKYTKFI

SEQ ID NO: 13360 - protein, 81 aa, Cervus elaphus
CLLFQGSDLFRDVAIVFSQEEWEQLAPTQRDLYRDVMLETYSNLVSLGLAVSKPDVISFLEQGKEPWTVGEVATGGPCPGE

SEQ ID NO: 13361 - protein, 81 aa, Cervus elaphus
EHEPVTFNDVAVDFTQEEWGQLDLVQRTLYRDVMLETYGHLLSVGNQITKPEVISLLEQGEEPWSMESAYPLQGTCPEWMK

SEQ ID NO: 13362 - protein, 81 aa, Cervus elaphus
MSQKNLFRNVMMETVTHLVSVGYQISKSDVISQLEQGKELWTEAAGSERPLRRQEMIVMQSVYRKHISPTMAMLRSERRIV

SEQ ID NO: 13363 - protein, 81 aa, Cervus elaphus
FQELVTLEDVAVDFSPEELPYLSASQRNLYREVMLENYRNLVSLGYQFPKPDIISQLEEEESHAREEDGSTMTCQDWEEQS

SEQ ID NO: 13364 - protein, 81 aa, Cervus elaphus
AALLKAKAQELVTFEDVAVYFIRKEWKRLEPAQRDLYRDVMLENYGNVFSLGPGSGTELWATWYEQDKPCPVFPHEQESLF

SEQ ID NO: 13365 - protein, 81 aa, Colobus angolensis
RESRPGAVSFADVAVYFSPEEWGCLRPAQKALDTFGHLGALGEAACSSWDPQSSVEREVEAWSPEAQDPEGESPAALSKGQ

SEQ ID NO: 13366 - protein, 81 aa, Colobus angolensis
SQGLFTFKDVAIEFSQEEWECLDPAQRALYRDVMLENYRNLLSLDEDNIPPENGSHLAACGQSTLPLLKNPTKSDPFILPP

SEQ ID NO: 13367 - protein, 81 aa, Colobus angolensis
FQGSVTFEDVAIAFSQQEWESLDCSQRGLYRDVMLENYRNLMSMAGHSLSKPHVITLLQQWKEPEVTVRTDERRWCTDLQL

SEQ ID NO: 13368 - protein, 81 aa, Colobus angolensis
EKETLTFRDVAIEFSLEEWECLNPAQQSLYMNVMLENYKNLVFLGIAVSKQDPVTSLEQEKEPWNMKRHEMVDEPPGYMCR

SEQ ID NO: 13369 - protein, 81 aa, Vicugna pacos
CQDSVTFEEVSVKFSMEEWALLDLSQKKLYRDMMQETCRNLTSIEEKLKDPDIEGQYENHGKNLRHMTSHTTPNPYEYLGY

SEQ ID NO: 13370 - protein, 81 aa, Vicugna pacos
AQGPVVFSDVSVDFSQEEWECLDPAQRDLYKDVMLENYSNLVSMGLYIPKPQVISLLEQGKEPWMVGRELTRGLCSDLESM

SEQ ID NO: 13371 - protein, 81 aa, Odobenus rosmarus
AQGGVTFEDVAVYFSQEEWGLLNEAQRCLYLDVMLENFALTSSLGCSCQTEAAEVPFEQSISVGVSQARTPKEPRSSQKTH

SEQ ID NO: 13372 - protein, 81 aa, Odobenus rosmarus
LQALLTFRDVAIEFSQEEWRCLNHTQRQLYRDVMLENYGHLLFLGLTLSKPDLIMFLEQEKQLWDVKRKETVAFHPGIKTY

SEQ ID NO: 13373 - protein, 81 aa, Odobenus rosmarus
FQGSVTFRDVAVAFSQQEWESLNPAQSQLYRNVMLENYSNLVSLAGHSISKPHVITLLEQWKEPWMIVRKDQRRQYTDFQL

SEQ ID NO: 13374 - protein, 81 aa, Odobenus rosmarus
KVPVTFVDIAVYFSEDEWKNLDEWQKELYNNLVKENYKTLMSLDTEGAVPKPDAPSQVEPREEPCVWEQRDPEEREILMDP

SEQ ID NO: 13375 - protein, 81 aa, Odobenus rosmarus
AQGCVTFEDVTIYFSQEEWGLLDEAQRLLYCDVMLENFALIASLGLTSFRSHIVAQLQMGAEPWVPDRVDMTSAMARGAYS

SEQ ID NO: 13376 - protein, 81 aa, Delphinapterus leucas
STGLSSFKDISMEFTWEEWQLLDSAQKHLYRDVTLENYSNLVSVGYHGTKPDLVFKLEQGEEPWIINAEVSRQSCPEGWKE

SEQ ID NO: 13377 - protein, 81 aa, Delphinapterus leucas
KAQETLTFDDVAVAFTWEEWQFLAPPQKDLYRDVMLENYSNLLSVGFQASKPDILSKLDQGEPWTMEDEIHCRTHSVWKVD

SEQ ID NO: 13378 - protein, 81 aa, Delphinapterus leucas
ASQGLLTFQDVVIEFSQDKWEFLDSTQWELYRDVMLENYKNLVSLGPVSKPDLVTFMEQKKGPWDVKGMETIAIHPGTGDP

SEQ ID NO: 13379 - protein, 81 aa, Delphinapterus leucas
PQACVTFEDVAIYFSQEEWGLLDEAQRFLYHDVMLENFELTTSLDCQCGAEDEEIPSEQSVSGGESQVRTSQLVPSNQKTR

SEQ ID NO: 13380 - protein, 81 aa, Erinaceus europaeus
EGTVSFEDVTVTFSREEWQLLSATQRTLYRTVMLDTYSSLAALGGTAVRWKPSSPLATPMADRKTSSRGPSLAFPPRPAPK

SEQ ID NO: 13381 - protein, 81 aa, Erinaceus europaeus
VTFNDVAVTFTQEEWEQLRPAQRALYHEVMLDNYSLLVSVGDKGILKLIDPATFKPVLSEGVSVHEQLAQGTPRESQKEQT

SEQ ID NO: 13382 - protein, 81 aa, Ornithorhynchus anatinus
YWVPALFDEVAVSFSDEEWDLLTEEQKTLYREVMKMNYETVVSLEFPFPRPDVISQLEEGEGLWAAPFPADSEEWLFPRGA

SEQ ID NO: 13383 - protein, 81 aa, Cervus elaphus
ESVTFEDVAVNFSHEEWQCLTHAQRHLYKDVMLENYGNMVSLAAKTWPENEKARSEQEVFENGEVCWVKFRSLLKVVSRDP

SEQ ID NO: 13384 - protein, 81 aa, Colobus angolensis
PQGLLTFRDVAIEFSQEEWKCLDPAQRTLYRDVMLENYRNLVSLAISSKCRMKKFSSTGQGNTEVIHTGTLQRQASHHIGE

SEQ ID NO: 13385 - protein, 81 aa, Colobus angolensis
MTEEFVTLKDVGMDFTLEDWEQLGLEQGDMFWDSALDNCQDLFLLDPPRPNLTSHADGVEDLEPLPGGSPEATGPDVTETK

SEQ ID NO: 13386 - protein, 81 aa, Colobus angolensis
SVMGSVTFQDVAIDFSEEEWGFLNPAQRDLYTAVTLENYQNLVWLGLSISKSVISLLEKRKLPWIMGKEEIRVPLPGEYEE

SEQ ID NO: 13387 - protein, 81 aa, Colobus angolensis
TSKEAVTFKDVAVFFTEEELGLLDLAQRKLYRDVMLENFRNLLSVGHQPFHRDTFHFLREEKFWMMDIATQREGNSGGKIQ

SEQ ID NO: 13388 - protein, 81 aa, Colobus angolensis
IQGPLTFGDVAVAFTRIEWRHLDAAQRALYRDVMLENYGNLVSVGLLSSKPKLITQLEEGAEPWMEVREAPSGTRAVQDYW

SEQ ID NO: 13389 - protein, 81 aa, Colobus angolensis
TEGESGQQDLVLCWGEGPVTFEDVAVLFTEAEWKRLNLEQRNLFKEVMLENLRNLVSLGEDILGSLRSGLLHVDMNLDLWL

SEQ ID NO: 13390 - protein, 81 aa, Colobus angolensis
EKEPLTFRDVVIEFSQEEWQCLDTAQQDLYRKVMLENFRNLVFLGIDVSKPDLITCLEQGKDPWNMKRHSTVATPPGVFFV

SEQ ID NO: 13391 - protein, 81 aa, Mustela putorius
SQDLMTFEDVAVEFTKWEWGQLDPAQKDLYRVVMLENFKNLASLGLPVAKPYVISQLEKGKEPCVLEGEISTDWEKRPKAK

SEQ ID NO: 13392 - protein, 81 aa, Mustela putorius
TQDSVVFEDVAVDFTQEEWALLDLAQRSLYRDVMLENFQNLASLGYPLHTPYLISQWKQEEDLETVEGGPVQGEHQEGFEI

SEQ ID NO: 13393 - protein, 81 aa, Mustela putorius
KDQVTLTLEDVAVDFTWEEWQLLAPAQKNLYRDVMLENYRNLVSVGYKASKPDALSRWEQGALWTTEDEIRSRICPEIKKD

SEQ ID NO: 13394 - protein, 81 aa, Mustela putorius
TQGCVTFEDVTIDFSQEEWGLLDEAQRLLYCDVMLENFALIASLGLTSFRSHVVAQPQMGAEPWVPDRVDMTSVMARGAYS

SEQ ID NO: 13395 - protein, 81 aa, Mustela putorius
GPVTMTFDDVALYFSEQEWEILEQWQKEMYQQVMKTNYETLDSLGGIFSKPNLITWIEQGRMLLIRDRGPLEKNMTFSPST

SEQ ID NO: 13396 - protein, 81 aa, Mustela putorius
ARLLPPPAGPQAKVTFEDVAVLLSQEEWDRLGPAQRGLYRHVMMETYGNVVSLGLPGSKPSVISQLERGEEPWVLDGHGAE

SEQ ID NO: 13397 - protein, 81 aa, Mustela putorius
SLSFRDVAVGFTRKEWQQLDPTQRTLYRDVMLENYSHLVSVGYQVTKPAVISRLEQGQEPWMEEEEILRWSFPGENLQVDH

SEQ ID NO: 13398 - protein, 81 aa, Tupaia chinensis
LTLEDVIVKFTWEEWQLLGPAQKDLYQDVMLENYSNLLALEVWEADAHLWEHLHHGSAVNRLQQWHEHNAWENILHQSKTQ

SEQ ID NO: 13399 - protein, 81 aa, Tupaia chinensis
SLGPVSFNDVAVDFTQEEWQQLDPEQKMTYRDVMLENYNNLVSVGYHIIKPDVIIKLEQGEEPWIVGEFLLQNYPDEMWQT

SEQ ID NO: 13400 - protein, 81 aa, Tupaia chinensis
REGLVSFKDVTVSFSKEEWQQLDPAQRHLYQDVTLEIYSHLSSVGCSIPSPEVIFRMIKGKESWTGEAELPYQRVEGGEFG

SEQ ID NO: 13401 - protein, 81 aa, Vicugna pacos
FPEPVIFEDVTLGFNPEEWEMLDLEQKSLYREVMLENYRNLVSVEHQLSKPDVVSQLEEEEELWSVERGIPQDTSSECPEA

SEQ ID NO: 13402 - protein, 81 aa, Vicugna pacos
PQDLMTFEDVAVEFTWWEWGQLDTAQKDLYREVMLENFRNLASLGFPVSKPHVICQLEKGEEPYMMEREVSTGAHPDWERR

SEQ ID NO: 13403 - protein, 81 aa, Vicugna pacos
LQETVTFKDVAIDFTQEEWQQLDPAQRNLYRNVMLENYNNLITVGCPFTKPDVIFKLEQEEEPWVVEEEVLKRHCPGEIWG

SEQ ID NO: 13404 - protein, 81 aa, Vicugna pacos
PQGRVTFEDVAVYFSWDEWGLLDETQRLLYRSVMLENFALMASLGFTSSRTCEITKLEWWGEPFLPPPGVRTAAVPRGCGC

SEQ ID NO: 13405 - protein, 81 aa, Vicugna pacos
RPESVTFEDVAIYFSENEWTGLAPAQRALYRDVMLENYGALASLAAFPFPKPALIFQLEQGEAPWSSAPQGALDGEGPRGI

SEQ ID NO: 13406 - protein, 81 aa, Odobenus rosmarus
FREPVTFEDVTLGFTSEEWGLLDLEQKSLYREVMLENYRNLVSVEHQLSKPDVVSQLEEEEALWSVERGIPQDTFSEYPAA

SEQ ID NO: 13407 - protein, 81 aa, Delphinapterus leucas
SQGLLSFNDVAVDFTWEEWQLLDLVQKNLYRDVMLENYSNLMSLGYHVTKPEPVMHLEKGEEKEKAVVEREFPSQCGPERP

SEQ ID NO: 13408 - protein, 81 aa, Delphinapterus leucas
FQEAVTFKDVAVTFTEEELGLLDSAQRKLYKDVMVENFRNLVSVGHLPFKPDMVSQLETEEKLWMMEREIQRNGHSGENRK

SEQ ID NO: 13409 - protein, 81 aa, Delphinapterus leucas
SQEAVTFEDVAVNFSNEEWQCLTHAQRHLYKDVMLENYGNVVSLGFPFPKPPLISHLEQEAELCVQDGQDREFLSCSHPVS

SEQ ID NO: 13410 - protein, 81 aa, Gulo gulo
WSQMPVTFEDVALYLSREEWGRLDHAQQSFYRDVLQKRNGLSLAGFPFSRPLWGSQGQGKGEASSSCQQMGDDREKTGAIE

SEQ ID NO: 13411 - protein, 81 aa, Mustela putorius
SRSLENDGVCFSEQEWENLEDWQKELYRNVMKSNYETLVSLKVLGQPEEEAELGAGMLGDLEEEGPGDVHPAEGVMIKQEI

SEQ ID NO: 13412 - protein, 81 aa, Tupaia chinensis
FQESVTFQDVIINFTQEEWTLLDTSGKKLYKDVMLENMNHLVSLGYDLCQSDLIFHLLWMVEGRGLPECQSPDWESAHRKQ

SEQ ID NO: 13413 - protein, 81 aa, Tupaia chinensis
EPVTFEDVAVHFTQKQGARLDPAQRALYKEVMLENYAHVASLEAESCIKSEEPVVKQEAPEGTEFHGMPAGTLLRNVSEPA

SEQ ID NO: 13414 - protein, 81 aa, Tupaia chinensis
MLENFALIASLGLMSFRSHVVAQLEMGEEPWVPDRVDISSAMARGAYSRPASGHMIAREQEPSSVKSPDSQKLLDTLLQNL

SEQ ID NO: 13415 - protein, 81 aa, Delphinapterus leucas
PQDLMTFEDVAVEFTRWEWGQLDPTQKDVYREVMLENFKNLASLGFPMSKPYVICQLEEGEEPCILEREISTGAPADYQLL

SEQ ID NO: 13416 - protein, 81 aa, Delphinapterus leucas
VTESVTFRDIAVLFSRNEWLHLDSAQRTLYREVMLENYSTLVSLGIPFSMPNLICKLQHGEDPCMVEREIPQDTCLGFKTW

SEQ ID NO: 13417 - protein, 81 aa, Carlito syrichta
PQGSTSFSSVTVAFAQDRWRYLVPTPRDRFKEGISETSRNLFLLGIPVSQPRMNSQLEQREGPWMLEGEDLRSTCPDWKTV

SEQ ID NO: 13418 - protein, 81 aa, Delphinapterus leucas
RQVSMAFQDLAVRFSEDEWRLLGEGQRALYLDVMRENYETLASLGTVELLPLSAFLCPSEPGGAVGGGGCAADGQDPPRGG

SEQ ID NO: 13419 - protein, 81 aa, Delphinapterus leucas
SRDSVTFADVAVDFTQEEWTLLDPIQRKLYRDVMLENYKNLTTAGYQSLKPTLISWLEQEDDLRTVERRGVLQASCFFLQT

SEQ ID NO: 13420 - protein, 81 aa, Delphinapterus leucas
RLKGPLSFMDVFVDFTWEEWQLLDPAQKHLYRSVMLENYSNLVSLGYQLTKLNIIFQLEQEELWMMQIPTQGHLGIGFPRV

SEQ ID NO: 13421 - protein, 81 aa, Carlito syrichta
SQDLLTFRDVAIEFSQEEWTCLDPAQRTLYRDVMLENYRNLVSLGISLSDLPVISMLEQEREPWIVKSEVKIAKNPDGWEC

SEQ ID NO: 13422 - protein, 81 aa, Delphinapterus leucas
SVTFEDIAVYFSWEEWRLLDETQRRLYLDVMLENFALISSLGCCCGAEDAEAPFEQITSLGVSQARTPKAALSFQKTHPCE

SEQ ID NO: 13423 - protein, 81 aa, Carlito syrichta
PQAKVTFEDVAVLLSQEEWDRLGPAQRGLYRNVMMETYGNVVSLGLPGSKPKVISQLERGEEPWVLDRKGTEESQGREHGC

SEQ ID NO: 13424 - protein, 81 aa, Carlito syrichta
AQGSVSFEDVTMELTWEEWRQMGPGERSLYRDVMLENYGHLVAVGCCITKPKVIHMLEQGEEPWSLEVKFLNRKYPGYYKI

SEQ ID NO: 13425 - protein, 81 aa, Carlito syrichta
LRPAQLQEPVTFGDVAVLFSQDEWLRLDPTQRTLYREVMLETYSSLAALGVLFSKPKVISQLEQGEDPWMVEAGDLQGTRL

SEQ ID NO: 13426 - protein, 81 aa, Carlito syrichta
QTGSVTFRDVAIDFSQEEWEFLDPAQRDLYRDVMWENYSNFISLGPSISKPGVITLLDEEGKEPGMIVREETRRYCADLES

SEQ ID NO: 13427 - protein, 81 aa, Carlito syrichta
VKNPVTFEDVAVNFTQEEWEYLDASQRVLYQDVMSETFKNLASVARIFLHKPYLITKLEQEEKQWRTHLHLTYRERLLSGG

SEQ ID NO: 13428 - protein, 81 aa, Carlito syrichta
SQGLLTFKDVAIEFSPEEWKCLDSAQQILYRNVMMENHRNLVSLGLAVSKPDLIVCLEQRNKPWNVMRHNMLEKPTGLHGQ

SEQ ID NO: 13429 - protein, 81 aa, Carlito syrichta
LQKLVTFEDVAVYFTQTEWDGLSPAQRTLYRDVMLENYGNVASLGFPLLKPAVILQLEGGGELGGPSPLAVGTRTDSQDLW

SEQ ID NO: 13430 - protein, 81 aa, Delphinapterus leucas
SQGLVTFKDVAVCFSQDQWSDLDPTQKEFYGEYVLEEDCGIVVSLSFPIPRLDEISHMGEEEPLIPEIPEAQEPQEPEILS

SEQ ID NO: 13431 - protein, 81 aa, Carlito syrichta
PVAFRDVAVIFTEAEWMSLSLEQRNLYKEVMLENYRNLLSLAEPKSGVYPCSSCLLVSSCQQFLSQHVLQIFQGLCTENHS

SEQ ID NO: 13432 - protein, 81 aa, Carlito syrichta
MSQVTFSDVAIDFSHEEWTWLDSAQRNLYKDVMVQNYKNLVSLGLSVTKPYVITLLEDGKEPWMVEKKLSKDWESRWENKK

SEQ ID NO: 13433 - protein, 81 aa, Delphinapterus leucas
SQEQVSFKDVCVDFTQEEWYLLDPAQKILYRDVILENYSHLVSVGNCITKPEVIFKIEQGEEPWILEERFPKQCRSDWKVD

SEQ ID NO: 13434 - protein, 81 aa, Delphinapterus leucas
ARLTFKDVVIEFSPEEWECLDPAQRALYRDVMVETYRNLISVDLSHIHVIKKLQLKSNTDVGEIFPTVMLGSHGSCEIKHF

SEQ ID NO: 13435 - protein, 81 aa, Carlito syrichta
EMGLLSFKDVAIEFSPEEWECLDSPQRILYRTVMLENHRNLVFLGLADSKSDLIMHLEQRKEPWDVKRHDILAKLPAVTSH

SEQ ID NO: 13436 - protein, 81 aa, Carlito syrichta
LKGSVSFEGVTMEVTREEWQQMAPMEWSLYRDVTLEIYGHLVAVGCCITKPKVILKLEQGEEPWSLEVKFLNGKYPGYYKI

SEQ ID NO: 13437 - protein, 81 aa, Carlito syrichta
EPEGLFTFKDVTIEFSPEEWEYLDPSQQRLYRTVMLENHRNLVFLGLAVSKPDLITCLEQRKEPWDVKRYSTLTKPPGRWE

SEQ ID NO: 13438 - protein, 81 aa, Carlito syrichta
LQAEVTFEDVAVLLSREEWGRLGPAQRGLYRDVMLETYGNLVSLVCETRTEYKELTSWETFDEQELDHLRGIFSQGPEPVE

SEQ ID NO: 13439 - protein, 81 aa, Carlito syrichta
MNLYKEVMLENFSNLVSVGLSNSKPAVISLLEQGKEPWMVNRELTRGLCSDLESMCDTKILSLKKRHFSQVILTHEDMPTF

SEQ ID NO: 13440 - protein, 81 aa, Delphinapterus leucas
FQGSLSFRDVAVGFTRKEWQQLDPTQRTLYRDVMLENYSHLVSVGCQVTKPAVISRLEQGQEPWMKEEEILRWSFPEVLQV

SEQ ID NO: 13441 - protein, 81 aa, Carlito syrichta
SQGPVSFEDVAVNFTWEEWQHLDPAQRTLYRDVMLENYSHLVTVGGPVSKPDVISKLEQGGEPWIIMRDRPNWIYPGANVA

SEQ ID NO: 13442 - protein, 81 aa, Gulo gulo
MDFPQEEWALLNSQQRKLYRDVMLENYRNLASLEKQLSKPTLITQMEQEEEMKTETRYHQDSSSNGMVLLKTKQAQHKQDI

SEQ ID NO: 13443 - protein, 81 aa, Erinaceus europaeus
MKPAQRNLYRDVMLENYSNLVIVGCQFTKPDVIFKLEKEEEPWVVEEEMFKGHCSEVWEVDQKIKKQQEILVRKVTSISKK

SEQ ID NO: 13444 - protein, 81 aa, Erinaceus europaeus
SQGPVSFRDVAVDFTRDEWQQLDREQRATYRDVMLENYNHLEAVGCDEHKPNVIIKLEQGEEPWETESEPPSLSHAEVWKV

SEQ ID NO: 13445 - protein, 81 aa, Erinaceus europaeus
TQVKVTFDDVAVLLTQEEWDHLGPAQRGLYRNVMMETYGNVVSLGLPGSKPNVISQLERGEEPWVRDGQETKESWDPGIGH

SEQ ID NO: 13446 - protein, 81 aa, Erinaceus europaeus
AISCEDVTVNFSQEEWALLNPSEKKLYNDVMWEIFHNLFSIGKLLEYSFIEQSEDEEGSKQRNIEDKIAEKEGSLYREKPH

SEQ ID NO: 13447 - protein, 81 aa, Ornithorhynchus anatinus
MCENYRHLLWLGFSLPKPEIISLFKRGEEPWIANLPRNVKVEFPRESRPVMHNRTIDSEFFLLGLTDVQGLQTFLFALLLL

SEQ ID NO: 13448 - protein, 81 aa, Oryctolagus cuniculus
QVTITFKDLAVRFSEEEWRLLEERQREFYREVMRENYETLVSVGTAELLPLSAFLSPMEPGRAIGGGERADKGQEPLARGG

SEQ ID NO: 13449 - protein, 81 aa, Rhinopithecus bieti
EQGYVTFEDVAVYFSQEEWRLLDEAQRLLCRNVMLENFSLLASLGLASSKTHDITQLESWKEPFMPAWGVVTSAIPRGCWH

SEQ ID NO: 13450 - protein, 80 aa, Ursus americanus
LQGLLTFGDVAIEFSQEEWRCLSHTQRELYSDVMLENYGHLLFLGLVVSKPDLVIFLEQKRELWDVRRKETVFIHPGRWE

SEQ ID NO: 13451 - protein, 81 aa, Propithecus coquereli
TQESLTPEDVAVEFTWEEWQLLGPAQKDLYRDVMLENYSNLVSVGYQASKPDALSRLEHGDPPWRREDEIHRGARSEVWKV

SEQ ID NO: 13452 - protein, 81 aa, Saimiri boliviensis
MLENYGSVASLAAFPFPKPALISQLEQGEAPWCLAPRGALDGEGQRGISGEILELPGATIWSLRIKPIPKKTVAKQRETRS

SEQ ID NO: 13453 - protein, 81 aa, Lynx pardinus
AQGCVTFEDVTIYFSQEEWGLLDEAQRLLYCDVMLENFALTASLGLTSFRSHIVARLEMGAEPWVPDRVDMTSAMARGAYG

SEQ ID NO: 13454 - protein, 81 aa, Balaenoptera acutorostrata
LSQTSVSFRDVTVEFTQEEWQCMSSAQRTLYRDVMLENYSHLVSSGYCLTKPDVIVKLEQDDPLLLEEEILSKSHADCKLD

SEQ ID NO: 13455 - protein, 81 aa, Saimiri boliviensis
SQELVTLEDVVVHFSLEELSSLSAAQRNLYREVTLENYRNLVSLGYHFSKPDIISRLEKEESRAVETGSNAVICQGESHDD

SEQ ID NO: 13456 - protein, 81 aa, Balaenoptera acutorostrata
MDPVAFEDVAVNFTLEEWALLGPSQKKLYRDVMRETLRNLASVGEKWEDHNTEDQYKNQGRNLRSHTLRRRCESEESSQGG

SEQ ID NO: 13457 - protein, 81 aa, Vombatus ursinus
WGCLGPSEKELYRNVMLENYGHLVYLGLAISKPDVICHSERGDPPWKPVIKECNKFQRSFNQELDLTLSVQQTVRTGKIHH

SEQ ID NO: 13458 - protein, 81 aa, Balaenoptera acutorostrata
AKDCVTFEDVTIYFSQEEWGLLDEAQRLLYCDVMLENFALIASLGLTSFRSHVVAQLEMGAEPWVPDQVDMTSAMARGAYR

SEQ ID NO: 13459 - protein, 81 aa, Lynx pardinus
DPGQVNFEDVAVYFSREEWGLLDEAQRLLYRDVMLENLALTASLGYESSMSLGVASLELGGEPWVSDWADVTPARTREAQG

SEQ ID NO: 13460 - protein, 81 aa, Saimiri boliviensis
GTVTFEDVAVKFSQEEWSLLSEAQRCLYHDVMLENLTLISSLGCWYGAKDETPSKQTLSIQQQSPLRSHWTGVCTKKAHPW

SEQ ID NO: 13461 - protein, 81 aa, Lynx pardinus
QAQESLTFEDVAVGFSREEWRLLAPAQKDLYRDVMLENYRNLVSVGYLASKPDALSKLEGGELWTAEDEIDSRICPEIRKV

SEQ ID NO: 13462 - protein, 81 aa, Lynx pardinus
PQVSVSFKDITVEFTQEEWRQMDSAQRTLYRDVMLENYSHLVSVGYCFTKPELIFTLEQGEDPWLFKKEFLRKGFPEEYQP

SEQ ID NO: 13463 - protein, 81 aa, Saimiri boliviensis
AQVSVTFDDVAVTFTQEEWGQLDLAQRTLYQEVMLENCGLLVSLGCPVPRPELIYHLEHGQEPWTRKEDLSQGTRPGDKAK

SEQ ID NO: 13464 - protein, 81 aa, Vombatus ursinus
MFEDMAMYLTPEEWGQPDPTQRALYRDMMLESCRNDILLDDGSETENMESLSNLEVSEDVESEEKLSSEFPIALPQGPDFG

SEQ ID NO: 13465 - protein, 81 aa, Balaenoptera acutorostrata
SYESLSFADVTLGFTQEEWQQLDPDQRTLYRDVMLENYSHLVSVGYCIPKPELIFRLEQGEQPWVLEEESPSQSYPEVCKV

SEQ ID NO: 13466 - protein, 81 aa, Balaenoptera acutorostrata
LSQALLTFRDVAIEFSQEEWECLNPAQRALYRDVMLENYRNLVSLDMSTRCMIKELSPKEDINNGDLFQTLVFERLESPGQ

SEQ ID NO: 13467 - protein, 81 aa, Lynx pardinus
NSQGLLTFRDVAIEFSQEELQCLNHSQWELYRDVMLENYGHLLFLGLVVSKPDLVIFLEQKKDVWAVKRKETVATHPGRWE

SEQ ID NO: 13468 - protein, 81 aa, Lynx pardinus
MDLSQRNLHKDVMLENYRNLVSLGLAVSKPDMISHLEDGKGPWVVVREIARTPYPELETKPAAKNVVSTENTSEDVSQETI

SEQ ID NO: 13469 - protein, 81 aa, Saimiri boliviensis
RPGAVSFADVAVYFSPEEWGCLRPAQRALYRDVMRETCGHLGALGFSGPKSAFISWVEGEVEAWNPEVQDPEGESPGTVSR

SEQ ID NO: 13470 - protein, 81 aa, Lynx pardinus
CEVSVSFEDVTMDFSREEWEQLGPAQRCLYWDVMLEICSHLLSLGYPIPRPEMIFRMEKEQESWIREAQLPHQWRPEGEFG

SEQ ID NO: 13471 - protein, 81 aa, Saimiri boliviensis
MLENYRNLVFLGIAVSKPDLITSLEQGKEPWNMKSHAMVAKPPVIWSHFAQDLWPEEGIKDSFQKGILRTYGKYGHESLQL

SEQ ID NO: 13472 - protein, 81 aa, Lynx pardinus
SVAFQDLAVRFSEDEWQLLGEGQRALYQDVMRENYETLLSLGTAELLPLSAFLSPTEPAGTMEGRSYAGEGQEPPQGGGPL

SEQ ID NO: 13473 - protein, 81 aa, Balaenoptera acutorostrata
AQGSVMFSDVSIDFSQEEWEFLDPVQRDLYRDVMLENYSNLVSVGLYIPKPQVIFLLEQGKEPWMIGRELTRGLCSDLESM

SEQ ID NO: 13474 - protein, 81 aa, Colobus angolensis
RPEPVTFWDVAVDFTQEEWGQLDPTQRILYRDVMLETFGHLLSIGPEFPKPEVISQLEQGTELWVAERGTIQGCHPGWEAP

SEQ ID NO: 13475 - protein, 81 aa, Colobus angolensis
SYEGSVSFRDVAINFSREEWQHLDLSQRNLYRDVMLETYSHLLSVGYQVPEPEAVMLEQGKEPWALQGERPRQSCPGEKLW

SEQ ID NO: 13476 - protein, 81 aa, Colobus angolensis
VVIFQGSVSFKDVTEWQYLDSAQRTLSRDVMLENYNHFVSVGYCIPKPEVILKLEKGEEPWILEEKFPFRVIWVKLINTSR

SEQ ID NO: 13477 - protein, 81 aa, Colobus angolensis
MALVTFRDVAIDFSQKEWEYLDTTQRKLYRDVMLENYSNLVSLGYSGSKPDVITLLEQGKEPCVVVRDVTGRQYPGWLSRH

SEQ ID NO: 13478 - protein, 81 aa, Colobus angolensis
MDSVAFEDVAVNFTQEEWALLDSSQKNLYREVMQETCRNLASVGNKWKDQNIEDHFEKPEKDIRNHVVQRLCESKDSSQYG

SEQ ID NO: 13479 - protein, 81 aa, Colobus angolensis
LRGLVTFEDVAVEFTQEEWALLDPTQRTLYRDVMLENCRNLASLGFRVNKPSLISQLEQDKKVMTEERGILPSTCPDLETL

SEQ ID NO: 13480 - protein, 81 aa, Colobus angolensis
SKGSVMFRDVSIDFSQEEWECLDSGQMNLYKEVMLENFSNLVSVGLSNSKPAVISLLEQGKEPWMVERELTRGLCSDLESM

SEQ ID NO: 13481 - protein, 81 aa, Colobus angolensis
MSNVTFSDVAIDFSHEEWAWLDSAQRDLYKDVMVQNYENLVSVAGLPVTKPYVIMLLEDGKEPWMVEKKLSKVYPFPLSHS

SEQ ID NO: 13482 - protein, 81 aa, Colobus angolensis
EKGPLTFRDVAIEFSLEEWQCLDTAQQDLYRKVMLENYRNLVFLGIAVSNPDLITCLEQGKEPWNMKRHAMADEPPVIYSH

SEQ ID NO: 13483 - protein, 81 aa, Mustela putorius
SLDSVTFTDVAIDFSQDEWEWLNLAQRTLYKKVMLENYTNLLSLGLCLSKPDVISLLEQGREPWMMEGEMTRGFCSDLEYV

SEQ ID NO: 13484 - protein, 81 aa, Tupaia chinensis
VTFRDVAVDFSQEEWDCLDSSQRHLYSNVMLENYRVLVSLGWESICETGELTPKEDLYEEQSSQKIIETLTRYDFEYSNLK

SEQ ID NO: 13485 - protein, 81 aa, Tupaia chinensis
VSFEDVVVDFSLEEWQLLNPIQKNLYRDVMLENYSNLIFLGYQIIKLDESLKLEQEESWIIDEGFLGQNISEKVWLNDNCK

SEQ ID NO: 13486 - protein, 81 aa, Delphinapterus leucas
SQASVSFKDVTVELTQEEWQQMGPIQKTLYRDVMLENYNNLVSVGNCIFKPEVIFKLEQGEEPWFLEEEFSNQSHKEDYRD

SEQ ID NO: 13487 - protein, 81 aa, Cervus elaphus
SHTLVTFKDILVNFTREEWKLLDTAQQIMYKDVMLENYRNLVSLGHQLPKPDVILRLEKGEEPWLVEKEIHQETHPDLETP

SEQ ID NO: 13488 - protein, 81 aa, Colobus angolensis
SKDLVTFGDVAVNFSQEEWEWLNPAQRNLYRKVMLENYRSLVSLGVSVSKPDVISLLEQGKEPWMVKKEGTRGTCSDWEYV

SEQ ID NO: 13489 - protein, 81 aa, Colobus angolensis
MGPLTFRDVAIEFSLKEWQCLDTAQRNLYRNVMLENYRNLVFLGIAVSKPDLIACLEQGKEAWSMKRHEIMVAKPPVMCSY

SEQ ID NO: 13490 - protein, 81 aa, Colobus angolensis
WSQMPVTFEDVALYLSREEWGRLDHTQQNFYRDVLQKRNGLSLGFPFSRPFWAPQAQGKGEASGSSRQTGDEKEEWRGAYT

SEQ ID NO: 13491 - protein, 81 aa, Colobus angolensis
KPGAVSFADVAVYFSPEEWGCLRPAQRALYRDVMRETYGHLGALGFPGPKPALISWMEQESEAWSPAAQDPEKGERLGGAR

SEQ ID NO: 13492 - protein, 81 aa, Colobus angolensis
DSVVFEDVAVDFTLEEWALLDSAQRDLYRDVMLETFQNLASVDDETQFKASGSVSQQDIYGEKIPKESKIAAFTRNVSWAS

SEQ ID NO: 13493 - protein, 81 aa, Colobus angolensis
RDVAIEFSLKEWHCLDTAQRNLYRDMMSENYRNLVFLARPDHLSGVKKIKPLTMKRHEMIAKHSGPGTVVALICNPKILGG

SEQ ID NO: 13494 - protein, 81 aa, Colobus angolensis
PKVPVTFDDVAVYFSELEWGKLEDWQKELYKHVMRGNYETLVSLDYAISKPDILTRIERGEEPCLDRWGQEKQNEVEVGHP

SEQ ID NO: 13495 - protein, 81 aa, Colobus angolensis
RQAFLAFGDVTVDFTQKEWRLLNPAQRALYREVTLENYSHLVSLGILHSKPELIRRLEQGEAPWGEERRCRPVPRAGIYAE

SEQ ID NO: 13496 - protein, 81 aa, Colobus angolensis
MLETYSHLLSVGYQVPEAEVVMLEQGKEPWALQGERPRQSCPGEKLWDHNQCRKILSYKQVSSQPQRVYPGEKPYECAEFE

SEQ ID NO: 13497 - protein, 81 aa, Vicugna pacos
QKPLTFKDVAVVFTKEELGLLDSAQRELYQDVMLENFQNLVSVGKGNFWVIETALIGVFLFPEEIRFLSHRELPCWKIWEQ

SEQ ID NO: 13498 - protein, 81 aa, Vicugna pacos
MAFEDVAVYFSREEWGLLDAAQRALYRRVMLENFALLASLGLSVSRPHVVIQLERGEEPWVLSATDVTLARSAQRRPSPGS

SEQ ID NO: 13499 - protein, 81 aa, Vicugna pacos
FEGSLSFEDVAVDFTRQEWHRLDPAQRTMHKDVMLENYSNLASVGLCVAKPEMIFKLERGEELWILEEESSGHGYPGSLSL

SEQ ID NO: 13500 - protein, 81 aa, Vicugna pacos
AQELVTFEDVAVYFIRKEWKRLEPAQRDLYRDVMLENYGNVFSLDGETRTEHDQHISEDTGSHGVLLGRFQKDISQGLKFE

SEQ ID NO: 13501 - protein, 81 aa, Vicugna pacos
SQGLLSFTDVSMEFTWEEWQLLDSTQKHLYRDVTLENYNNLLSVGYHGSKPDLIFKLEQGEEPWIINARLSRQSCPEGWKE

SEQ ID NO: 13502 - protein, 81 aa, Vicugna pacos
PVELVTFEDVAIDFTQEEWALLDASQRKLFRDVMLENLSHLVSVGYQHCKSDVIFQLEEGEELWSEAGGFLQSHSPGREGA

SEQ ID NO: 13503 - protein, 81 aa, Vicugna pacos
SRSLENDGVCFSEQEWENLEDWQKELYTNVMKSNYETLVSLKVLGQPEGDSELGTEMLGDLEEEGPGRVHPGAAMIKQEIQ

SEQ ID NO: 13504 - protein, 81 aa, Odobenus rosmarus
QGSAAYQFLSVDYTERKWKGPALSQRAVYRSIVPENYCSMASLAGETRMRRSELPARQEVSKGPASSDGISGGLCGVVSGE

SEQ ID NO: 13505 - protein, 81 aa, Odobenus rosmarus
CQESVTFEDVAVIFTDEEWRHLVPIQRDLYKEVMLENYKSIVSLGLPVPRPDVIFQLKRGDEPWIVDLHGSEERECPENVS

SEQ ID NO: 13506 - protein, 81 aa, Odobenus rosmarus
KEAVTFKDVAVAFTEEELGLLDSAQRKLYQDVMLENFRNLVSVGGSNQSELRTVQDRGPHEELSCWQIWQHIANDLSRCQN

SEQ ID NO: 13507 - protein, 81 aa, Carlito syrichta
GIMTFEDVAVYFSWEEWGLLEEAQRCLYHNVMQENLALIISLGCCCGAENEEAPSQQSISPQGVSQVRIFKAIPLLQKAIP

SEQ ID NO: 13508 - protein, 81 aa, Carlito syrichta
MGPGGRSLYRDVTLETFGHLVAVGYCFTKPKLIFTLEQGEDPWSLQKEKELLSRHSPEVSQPDDISEKSPENQGKHLWQVL

SEQ ID NO: 13509 - protein, 81 aa, Delphinapterus leucas
MNSVVFEDVAVDFNLEEWALLDSAQRELYRDVMLENFRNLASVGKIWEELSLEDQHIDQGRHLRNHVVERLHESTDQCGEG

SEQ ID NO: 13510 - protein, 81 aa, Delphinapterus leucas
SQERLTFEDVAIEFTQEEWECLDPAQRALYSDVMVETYRNLISLGKIQETEAFFYQEESRHLERLLVSRRVHTGEKPYQCN

SEQ ID NO: 13511 - protein, 81 aa, Delphinapterus leucas
FQEAVTFKDVAVTFTEEELGLLDSTQRKLYREVMLENFRNLLSVGHQSSKPDMISQLEREEKLWMTEVQTQRGARNHNEME

SEQ ID NO: 13512 - protein, 81 aa, Carlito syrichta
SQGLVSFKDVAVDFTQEEWQQLDIAQRTLYRDVMLENYSHLVSMGYPVSKPDVISKLEQGEEPWIIKRDRPNWIYPGEDQA

SEQ ID NO: 13513 - protein, 81 aa, Cervus elaphus
QLTFKDVFIDFTPEEWECLDPAQRTLYKDVMVETLRNLLSVAGPCSVRFGPVRPRLAPPLATPDRGLSYATPLTRPDAGRR

SEQ ID NO: 13514 - protein, 81 aa, Cervus elaphus
PKVPVSFEDVAVYFTKAEWKLLDHRQRKLYKQVMLDNHHNLVSLGFSSSKPQLIIQLEQGEKPWVADVHRMRITTGMQEGD

SEQ ID NO: 13515 - protein, 81 aa, Cervus elaphus
FQEFVTFEDVAVHLTREEWGCLDPVQRALYREVMLENYGNLVSLGILLRLPTTRIHSVNSCPALSHTRASAFSGETLAILS

SEQ ID NO: 13516 - protein, 81 aa, Colobus angolensis
TGGDVTFSDVAIDFSHEEWAWLDSAQRDLYKDVMVQNYENLVSVGLPVTKPYVIMLLEDGKEPWMVEKKLSKDWESRWENK

SEQ ID NO: 13517 - protein, 81 aa, Colobus angolensis
TFKEAVTFKDVAVFFTEEELGLLDPAQRKLYRDVMLENFRNLLSTGHQPFHQDTFHFLREEKFWMMETVTQREGNSGGKIQ

SEQ ID NO: 13518 - protein, 81 aa, Colobus angolensis
PQAKLTFEDVAVLLSQDEWDRLCPAQRGLYRNVMMETYGNVVSLGLPGSKPDIISQLERGEDPWVLDRKGTKKSQSLWSDY

SEQ ID NO: 13519 - protein, 81 aa, Colobus angolensis
VTLRDVVINFSQEEWEYLDSAQRNLYWDVMMENYSNLLSLDLESRNETKHLSVGKDSIENTGSEWEVMESSRLHGLESSIF

SEQ ID NO: 13520 - protein, 81 aa, Colobus angolensis
QEPLTFRDVAIEFSPEEWKCLDRAQQNLYRDVMLENYRNLVSLAMCSHFTQDFLPVQGIEDSFHKCILRRYEKFSSLFSSC

SEQ ID NO: 13521 - protein, 81 aa, Colobus angolensis
QGLVTFEDVAVDFTQEEWQYLNLPQRTLYRDVMLETYSNLVFVGQQVTKPNLILKLEVEECPAEGKIPFWNFPEVCQVDEQ

SEQ ID NO: 13522 - protein, 81 aa, Colobus angolensis
MLETYNHLVSLEIPSSKPKLIAQLEQGEEPWREERKCSLDLCPDGVSLCCLGWSAVVRSWLTATSSSWVQTVVCLSLPRSW

SEQ ID NO: 13523 - protein, 81 aa, Colobus angolensis
DSVTFEDVAVDFTQEEWTLLDQTQRNLYRDVMLENYKNLVAVDWESHINTKWSASQQNFLQGKTSSVVEMVRFRRYNLLPS

SEQ ID NO: 13524 - protein, 81 aa, Vicugna pacos
QPQEALTFKDVEVTFSQDEWGWLDASQRNLYRDVMLENYGNMASLVGPFTKPAVISWLEAREPWGLNVQGAQPKGNPGAAP

SEQ ID NO: 13525 - protein, 81 aa, Vicugna pacos
LLTFEDVALSFSEEEWQILDPSQKILYNDVMQENYENVISLGLKLKNDTGNDQPISLSTLEIQGSGCKVLRKARVKVAQKT

SEQ ID NO: 13526 - protein, 81 aa, Vicugna pacos
ALESVTFRDVAVFFSRDEWLHLNPAQRALYREVMLDNYSALLSLGILFSKPKVILQLEQGEDPWMVENGVSQSACLGWESL

SEQ ID NO: 13527 - protein, 81 aa, Odobenus rosmarus
EELPVVFEDVAVYFTREEWGMLVKRQKELYRDVMRMNYELLASLGPAAAKPDLISKLERRAAPWIKDPNGPKWGKGRPPGK

SEQ ID NO: 13528 - protein, 81 aa, Odobenus rosmarus
MMQENCRNLASLGNQVDKPGLVSELEQEDKVITEEIRILPGNCPDLETLLKAKGLTSKQHVFRKEQYEGVKMERNHLGVKL

SEQ ID NO: 13529 - protein, 81 aa, Odobenus rosmarus
PQGSAAYQFLSVDYTERKWKGPALSQRAVYRSIVPENYCSMASLGETRMRRSELPARQEVSKGPASSDGISGGLCGVVSGE

SEQ ID NO: 13530 - protein, 81 aa, Odobenus rosmarus
VEGRVTFEDVAVYFSWEEWGLLDEAQRCLYQDVMLENLALITSLGCRHGAEDEEAPERKVSVQGVSQVRTFKAVVSPQKAH

SEQ ID NO: 13531 - protein, 81 aa, Odobenus rosmarus
SSQGLLTFRDVAIEFSQEEWGCLNHTQRELYRDVMLENYGHLLFLGLIVWKPDLVIFLEQEKQLWDVKRKETVAFHPGRWK

SEQ ID NO: 13532 - protein, 81 aa, Odobenus rosmarus
QRGVVTFEDIAVYFSWEEWRLLDEAQRCLYHDVMLENFTLISSLGCCCGAEDTEAPFEQSTSIGVSQTRTPKAALSSRKTH

SEQ ID NO: 13533 - protein, 81 aa, Odobenus rosmarus
HGSMPFSNVTVAFTQDGWRHLIPAPRGTPRFKEGIPENARNLVLLGLPVSQPSMNSQLEQREEGPWMLEGGGLRSTCPDWK

SEQ ID NO: 13534 - protein, 81 aa, Delphinapterus leucas
MSKSQGSLSFKDVAVVFTWEEWQLLDRVQKNLYQDVMLENYINLVSVDAFYRLEQETPWIIEEESQSQIHPEDTWQVDNHR

SEQ ID NO: 13535 - protein, 81 aa, Carlito syrichta
LQELLTLEDVSVEFTSAEWQLLDPAQKDLYRDVMLENYSNLVSVGYQASKTDALSKLERGEEPWTVENEMHGQICPENDKV

SEQ ID NO: 13536 - protein, 81 aa, Carlito syrichta
PQVSLTFNDVAVLFTRDEWRKLHPSQRTLYREVMLENYRNLVSLGLLFTTPRLISLLQRGEDPWKVGKEGPGGSSLGGKSS

SEQ ID NO: 13537 - protein, 81 aa, Carlito syrichta
SQGLVTFGDVALDFSQEEWEWLNPSQKDLYRDVMLENYRNLVWLGLSISKPNMISLLEQGKEPWMVEREMSHGQCADWESW

SEQ ID NO: 13538 - protein, 81 aa, Delphinapterus leucas
WSQDSVTFEEVAVDFSQEEWALLDPAQKILYRDVMLENFRNLASVGYHLCKHSLITEVEQEELRPEQRGILQGAYRDRDTQ

SEQ ID NO: 13539 - protein, 81 aa, Carlito syrichta
AQGSVSFEDVTVELTREEWWQMGPGERSLYRDVMLENYGHLVAVGCCITKPKVICKLEQGEEPWSLEVKFLNRKYPGYHKI

SEQ ID NO: 13540 - protein, 81 aa, Carlito syrichta
MLETYGHLLSVGNQITKPEVISLLEQGEEPWSMEQAYPQSTCPEWMRSLENKALIPTQNIFEEEQSHGMKLERYIWDDPWF

SEQ ID NO: 13541 - protein, 81 aa, Carlito syrichta
HKELLTFRDVAVEFSLEEWECLDPTQKCLYRDVMSENYRNLVSLGLAVFKPDVITSLEQMKAPWNVNRQDVVAKNPAVSFY

SEQ ID NO: 13542 - protein, 81 aa, Erinaceus europaeus
KFQGLVSFEDVAVDFTQEEWNYLDPSQRTLYRDVMLENYSHVLSLGYPVTKPDVIASLEKRRIWIIEREIPSSSCTEVWQV

SEQ ID NO: 13543 - protein, 81 aa, Colobus angolensis
ESVTFQDVAVDFTEKEWPLLDSSQRKLYKDVMLENYSNLTSLDWETPSKTKWSLLMEDIFGKETPRGVTMERAGLAEKSTE

SEQ ID NO: 13544 - protein, 81 aa, Mustela putorius
SQHLVTFEDVAVTFTQEEWTLLDQTQRDLYRDVMLENYQNLIILGYESCKPDLYSLMGGAEELRTGGRGILQELDLQLKTK

SEQ ID NO: 13545 - protein, 81 aa, Mustela putorius
QGSVTFEDVVVYFSWEEWGLLDETQRCLYHDVMLENFALVISLGCWYGMEEEEALSVQQVSMGRTSSPAPSVWRAQPCDKC

SEQ ID NO: 13546 - protein, 81 aa, Mustela putorius
PQGSVSFKDVTVDFTQEEWQQLDPAQKALYRDVMLENYCHLISVGFHMTKPEMIRKLEQGEELWTVERIFPSQSDLEEDGK

SEQ ID NO: 13547 - protein, 81 aa, Mustela putorius
GLSDSKPDVISLLEQGKEPWVVKNQDKKEWCPDWESRRETKNLCPKEHSYEIKSLHLEIKRLTSSDLECTRFGNSREIKCH

SEQ ID NO: 13548 - protein, 81 aa, Mustela putorius
SKESVTFKDVAVDFTQEEWGQLDSPQRALYRDVMLENYQNLLALGPPVCKPDVISHLERGEEPWWMPREVPGGSCPGPRTP

SEQ ID NO: 13549 - protein, 81 aa, Tupaia chinensis
LQGFISFKDVAMDFTWEEWQDLEDAQKILYKVVMLETYSNLMFLGEKLYKCKQYKKMFSQNSDLTVHQRSHIKEKFYEKKI

SEQ ID NO: 13550 - protein, 81 aa, Tupaia chinensis
SQELLTFKDVSVDFTPEEWGQLAPAHRSLYREVMLENYGNLVSVGFQLSKPGVISQLEKGKEPWQMEGEISGGPNSDKSTA

SEQ ID NO: 13551 - protein, 81 aa, Tupaia chinensis
MFEDVAVLFTRDEWRKLDPSQRNLYRDVMLENYSNLVSLGLPFTKPKVISLLQQGGDPWMVEKESSGGSCLDRSHKNTEFD

SEQ ID NO: 13552 - protein, 81 aa, Odobenus rosmarus
SQESVTFEDVAVDFTQEEWTLLDRSQRKLFRDVMLENISHLVSIGRQLYKSDTISHLEPGEHLSKEGRGLLQCRSLDREDD

SEQ ID NO: 13553 - protein, 81 aa, Odobenus rosmarus
KSLGSVSFKDVTVDFSRDEWQQLDLAQKSLYRDVMLENYFNLISVGCQVPKPEVIFSLEQEEPCLLDGEISSHSCLDGDIG

SEQ ID NO: 13554 - protein, 81 aa, Odobenus rosmarus
SQESLSFRDVTVGFTQEEWQHLDPAQRTLYRDVMLENYSHLVSVGCSIPKPEVILKLEQGEEPWILEEEIPSQSNPELINN

SEQ ID NO: 13555 - protein, 81 aa, Odobenus rosmarus
VVFADVAVNFTPEEWALLDRGQRRLYRDVMLETYRNLASLVCPSQDKRSASRTQWNVLQNELPSEEKIVIFARNDLCSVFG

SEQ ID NO: 13556 - protein, 81 aa, Odobenus rosmarus
FQELVTFRDVAIDFSRQEWEYLDPIQRDLYRDVMLENYRNLVSLAGHSISKPDVVDLLEQGKEPWMILREETQRQYTDLDL

SEQ ID NO: 13557 - protein, 81 aa, Odobenus rosmarus
SQGSVLFEDISVDFTQKEWQLLDPAQRLLYREVMLENHRLLVSLGCSVTKPELIHKLEQGEEPWTPKRELPGQSRPGEKIY

SEQ ID NO: 13558 - protein, 81 aa, Delphinapterus leucas
AHGSLTFSDVAIGFSQQEWDCLDLVQKTLYRDVMMENYGNLVSLGHSISKPNVITLLEQGKEPWMFMREKTRSWCTDLDSR

SEQ ID NO: 13559 - protein, 81 aa, Carlito syrichta
ERPPEMAVSEDRASAAKEWKQLDPAQRNLYKNVMLENYSNIASMGCQASKPDIISKLEKGEEPWLGKEKRPSQGHLSKTAG

SEQ ID NO: 13560 - protein, 81 aa, Delphinapterus leucas
FESVVFEDVAVDFTPEEWALLDPAQRNLYRDVMLETFRNLASVGENWKCHSIEDQHKNQGTHLRWRVVEIPSENNESNQCG

SEQ ID NO: 13561 - protein, 81 aa, Delphinapterus leucas
AQESVMFSDVSIDFSQEEWEYLNDDQRDLYREVMLENYSNLVSMAGHSISKPDVISFLEQGKEPWLVDRELTRDQWPVLES

SEQ ID NO: 13562 - protein, 81 aa, Delphinapterus leucas
TDGLVTFRDVAIDFSQEEWEFLDPAQRDLYVDVMLENYSNLVSLELESTYETKNTFAKKDIFEINFPQQEIKERSKTLGFE

SEQ ID NO: 13563 - protein, 81 aa, Delphinapterus leucas
GPLTFKDVAIEFTEEEWECLDPAQRALYRDVMLENYRNLISVDISYMHVIKILQLKANTDRGEVFQTVMSERHERNEMKHF

SEQ ID NO: 13564 - protein, 81 aa, Gulo gulo
VQESVTFKDVVVLFTRDEWAQLSPTQRALYRDVMLENYSNLVSLGLLGPQSDVFSRLGKGEEWMLEDASGSFCLDWMTMPV

SEQ ID NO: 13565 - protein, 81 aa, Erinaceus europaeus
MAFRDVAVDFTQEEWMLLSPAQRSLYREVMLENYSNLVSLGIPFSKPELITQLEQGKETWREERKCPPASCPATEPKPKQP

SEQ ID NO: 13566 - protein, 80 aa, Carlito syrichta
MAGSQGLLTFRDVAIEFSREEWKCLDPTQRILYRNVMLENHRNLVSLGLAVSKPDLITCLEQRKEPWNVKRHNTLAKPPG

SEQ ID NO: 13567 - protein, 81 aa, Carlito syrichta
VTFADVVVNFTKEEWSLLDPAQRNLYRDVMLENCRTLASIDEMTQHETKDTTPQPDVLAKRTFLEASRVCLTSSHSQPSPI

SEQ ID NO: 13568 - protein, 81 aa, Carlito syrichta
SLTPVSFKDVTVEFSRDEWRQLDLTQKSLYRDVMLENYFNLISVGCHISKPEVIFSLEQGEEPCMLDGGISSQKCPDGDTG

SEQ ID NO: 13569 - protein, 81 aa, Delphinapterus leucas
RMEAVTFGDVAVHFSREEWQCLDPGQRALYKEVMLENHSSVAGLAGFLVFKPELISRLEQGQEPWVLDLQGAEGREAARTS

SEQ ID NO: 13570 - protein, 81 aa, Gulo gulo
LREPVAFEDVTLGFTSEEWGLLDLEQKSLYREVMLENYRNLVSVEHQLSKPDVVSQLEEEEALWSVERGIPQDTFSEYPTA

SEQ ID NO: 13571 - protein, 81 aa, Gulo gulo
SHVSVTFEDVAVLFTRDEWRKLGPSQRNVYQEVMLENYSNLVSLGLLFSKPRVISLLQQGEDPWKVEKESPGGPSLGWKSS

SEQ ID NO: 13572 - protein, 81 aa, Gulo gulo
AQGLLTFRDVAIEFSQEEWGFLNHTQRELYRDVMLENYGHLLFLGLIVWKPDLVIFLEQEKQLWDVRRKETVAFHPAAAAA

SEQ ID NO: 13573 - protein, 81 aa, Erinaceus europaeus
SMGTVSFEDVTVTFSLEEWQLLSTAQRTLYRTVMLDTYSSLAALGHCAAKPGVIVKLEQGAEPWMGAQAPPRSLAGHCAAK

SEQ ID NO: 13574 - protein, 81 aa, Erinaceus europaeus
AQGPLSFEDVAVDFSREEWQLLTPSQKALYRDTMLETHRNLVSVGGGAAEPGSLLCLEQGEPLWTLEGAAQSQSCARKKSY

SEQ ID NO: 13575 - protein, 81 aa, Ornithorhynchus anatinus
MEVTFQDAAIFPTRREWESLGDAQRELYRPVMLENYGYLRSLGAGRPKPQCIRQLEKGEDPWVPEPPAHHKWIFLKEAWTE

SEQ ID NO: 13576 - protein, 81 aa, Ornithorhynchus anatinus
DRMGVTFEDVAVYFSPGEWGCLDRAQRALYRDVMRENCDSLSSLGKMHSNFLNHQRIHTGEEPYKCTVCGISFCQSAHLIR

SEQ ID NO: 13577 - protein, 81 aa, Carlito syrichta
MRSNYETLVSLDDRLPKPELISWIEQGAEPFRNWKESQKSGNIICSSADLHFDPVIKGQLFWGSQQAVNSGQTKCYLQLDL

SEQ ID NO: 13578 - protein, 81 aa, Delphinapterus leucas
ELELVSFEDVAVTFTGEEWRHLDLAQRTLYQEVMLETCGLLVSLGHPVPKPELIHLLEHGQELRTVKRGLSRSTCTGEKAK

SEQ ID NO: 13579 - protein, 81 aa, Carlito syrichta
MAEPISEGFIQRCHVGELQELGLSISKPNMISLLEQGKEPWMVEREMSHGQCADWESWCEIKELSPKWFTDEDEISQGMEM

SEQ ID NO: 13580 - protein, 81 aa, Carlito syrichta
MFKEAVTFKDVAVAFTEEELGLLDSAQRKLYRDVMVENFRNLLSVGHLPFKRDISHVEREEQLWMMKATNQRERNLGENSQ

SEQ ID NO: 13581 - protein, 81 aa, Carlito syrichta
SQGSVTFRDVAIDFSQEEWKWLQPAQRDLYRCVMLENYGHLVSLGLSVSKPDVVSLLEQGKEPWLGKGDVRGDLFSVSNCE

SEQ ID NO: 13582 - protein, 81 aa, Carlito syrichta
MDPVQRNLHKDVMLENYRNLVSLGLAVSKPDMISHLENGKGPWAMVREISRNPYPDLESKPATKNATLTKNIPEDLSQEAI

SEQ ID NO: 13583 - protein, 81 aa, Carlito syrichta
MLENYSNLVAVGYCATKPEVIFRLEQGEEPWILEEFPTQSFLEIWKTDHLKEKSKENQPKHLWEVVFINNKMLTKERGNVI

SEQ ID NO: 13584 - protein, 81 aa, Carlito syrichta
SQGSVSFEDVAVGFTQEEWQLLDPDQKTLYRDVMLENYHNLVAVGYFINKPEVIFKLEQGEESWILKEDFPYRNYPEDCKA

SEQ ID NO: 13585 - protein, 81 aa, Carlito syrichta
GSVSFTDVTVDFTQEEWEQLDPSQRILYMDVMLENYSNLLSVEVWKADDQMERDHRNPDEQARQFVILKNQTSIEERGSIF

SEQ ID NO: 13586 - protein, 81 aa, Erinaceus europaeus
FQELVTFEDVAVYFIRKEWKRLEPAQRNLYRDVMLENYRNVFSLDGEARTEHHQDISEDTGAHGVLLGRLQEDISQGLKFE

SEQ ID NO: 13587 - protein, 81 aa, Erinaceus europaeus
WEPVTFKDVVVEFSKEEWGQLDPAGKDLYRDVILENLRNLDSLHKGKHQLSEPVTACQLKNKTKKWAMKQEIPRTTVLGPL

SEQ ID NO: 13588 - protein, 81 aa, Erinaceus europaeus
PKVPVTFDDVAVHFSEQEWSNLSEWQKELYKNVIRGNYESLVSMDYAISKPDLMSQMERSERPATQEQEDLEEGEAPTDPS

SEQ ID NO: 13589 - protein, 81 aa, Ornithorhynchus anatinus
AQVPVTFEDVAVYFSREEWAALDGRQKELYRDVMRGNYELVASLGCPAAKPDLICQIERDEELGVGEPQGRPVRRQPQRRS

SEQ ID NO: 13590 - protein, 81 aa, Erinaceus europaeus
PEGNLSFEDVTISFTWEEWQKLDDSQRALYKSVMLETYSHLLLLGKCVTKPAVIIKLEQGAEPWIIKEPPDQRLSDFKAFE

SEQ ID NO: 13591 - protein, 81 aa, Erinaceus europaeus
SQGLVTIKDVSLCFSQEEWRSLDPSQTDFYGEYVMQENCGIVVSLRFPIPKLDMLSQLEGGEEQWVPDTQDMEERDILKVT

SEQ ID NO: 13592 - protein, 81 aa, Ornithorhynchus anatinus
PKVPVIFDDVSVYFSTPEWEKLEEWQKELYKNIMKGNYESLVSMDYAMSQPDVLSQPAPDVPSQPAPDEARTVAEARPEAE

SEQ ID NO: 13593 - protein, 81 aa, Tupaia chinensis
PQKAKEGAPQSLDFTQEEWGQLAPLHQNLYREVLLENYGNLVSVGYQLSKPSVISQLEKGEAPWMTEKKSPRDPSSDLKNK

SEQ ID NO: 13594 - protein, 81 aa, Tupaia chinensis
SGSLENDDIGFSEQEWENLEDWQKELYRNVMQSNYETLVSLKVLGQPEGEADLGTEMLGDLEEEGPAGSHPADGVIIKQEI

SEQ ID NO: 13595 - protein, 81 aa, Odobenus rosmarus
SLESDLFRAVAIVFSQEEWEQLAPAQRDLYRDVMLETYSNLVSLGLAIAKPDVISFLEQGKEPWVVEKTSRGGLWPVLESR

SEQ ID NO: 13596 - protein, 81 aa, Odobenus rosmarus
MLDNYRDLVSVGPQLSKPNVISQRELEELSWMTKGLPVGLSPDWETRLETKESTIKPSITEYLSYGVIMEREDLWPSSLGE

SEQ ID NO: 13597 - protein, 81 aa, Odobenus rosmarus
APVRMTFDDVALYFSEQEWEILEKWQKEMYQQVMKTNYETLDSLGGVFSKPDLISWIEQGKMLLIRDQGPLEKNITLSPST

SEQ ID NO: 13598 - protein, 81 aa, Odobenus rosmarus
QAEVTFEDVAVLFSREEWGRLSPAQRGLYRDVMLETYRNLVSLGAGPAGPKPGVITQLERGDEPWVLDAQGAKGKERLRVS

SEQ ID NO: 13599 - protein, 81 aa, Odobenus rosmarus
MLENYSNLVSLGYCVTKPEVIFRLEQGEEPWILEEEFPSQSFPGEIWKTDHKKERSHENQPKHVWEFAFINNKMLTEERGN

SEQ ID NO: 13600 - protein, 81 aa, Delphinapterus leucas
ISKTSVSFRDVTVEFTLEEWQCMSSAQKTLYRDVMLENYSLLVSSGYCLTKPDVIVKLEQDDPLLLEEEILSKSHADCKLD

SEQ ID NO: 13601 - protein, 81 aa, Delphinapterus leucas
QGPVTFEDVAVYFSQEEWKLLDEAQRLLYRDVLLETFVLVASLGCWHGAEHKEITSEQNVSVEVPQINTSKTDLSIWKSYP

SEQ ID NO: 13602 - protein, 81 aa, Delphinapterus leucas
AQGKVNFEDVFVYFSQEEWGLLDEAQRLLYREVMLENFALMASLGYVSSMFHRIAPLELDREPWLSEWANMTPAMTREAQG

SEQ ID NO: 13603 - protein, 81 aa, Erinaceus europaeus
GSVTYEDVTVIFTQEEWALLNPSEKKLYRDVMCENFRNFLSIEKIQEHFTKEQHNLPGSKQRNTTLKISEGKKSQNGRKSQ

SEQ ID NO: 13604 - protein, 81 aa, Carlito syrichta
TFKEAVTFKDVAVVFTEEELGLLDSAQRKLYRDVMLENFRNLLSVGHQPFHQDTFHFLREEKFWMKNTATQREGNSGSKIQ

SEQ ID NO: 13605 - protein, 81 aa, Carlito syrichta
TQGTVTFEDVAVNFSQEEWSLLSETQRCLYRDVMLENLTLISSLGDWHGREDAAAPSKQSTCIHIYKDQRAHHGERPYDCE

SEQ ID NO: 13606 - protein, 81 aa, Delphinapterus leucas
VMESVTLEDVAVGLIQEWALLDDTRRNLYRYVLLDNCRTLAPRAGTPSCKACLVSQVGPREELMTAEQGILCATGVDWESQ

SEQ ID NO: 13607 - protein, 81 aa, Delphinapterus leucas
CEVSVSFEDVTVDFSREEWQQLDSTQRRLYQDVMLENYSHLLSLGCEIPKPEVIFKLEQGEEPWTLEEETPHQSCSDEKFG

SEQ ID NO: 13608 - protein, 81 aa, Carlito syrichta
QVHVSQGLLTFKDVAIEFSPEEWKCLDSAQQILYRNVMMENHRNLVSLDLIVCLEQRNKPWNVMRHNMLEKPTGLHGQTRF

SEQ ID NO: 13609 - protein, 81 aa, Carlito syrichta
QVNFEDVFVYFSQEEWVLLDEAQRLLYRDVMLENFALMASLGCWHGMEDEEIPFEQSISVEGVSQIWTHKGSPSTQKAHPC

SEQ ID NO: 13610 - protein, 81 aa, Delphinapterus leucas
PQESVTFKDVAVNFTQEEWHHMDPAQRRLYRDVMLENYSHLVSLGYQVSKPEVIFKLEQGEEPWIAEGEIQRPFCPGGRIH

SEQ ID NO: 13611 - protein, 81 aa, Carlito syrichta
LQESVSFEDVAVDFTRQEWHRLDPAQRTMHKDVMLETYSNLASVGLCVAKPEMIFKLERGEELWVLEEESSGHGYSGSLSL

SEQ ID NO: 13612 - protein, 81 aa, Delphinapterus leucas
YQRPVSFKDVVVGFTQEEWHRLNPAQRALYRDVMLETYSNLVSVGYEGTKPYVILRLEQEEAPWICEASCSGCHCRENIWQ

SEQ ID NO: 13613 - protein, 81 aa, Carlito syrichta
MGLLTFSDVAIDFSPEEWECLDPTQRILYRNVMLENHQNLVSLGLAISTPDLIMCLEQRKEPWNVKRQNTVPKPPGLEEAW

SEQ ID NO: 13614 - protein, 81 aa, Gulo gulo
SLDSDLFRDVAVVFSREEWERLAPAQRVLYRDVMLETYGNLVSLGLAVYKPDVISFLEHGGEPWLVEEAAGRGRWPVSESK

SEQ ID NO: 13615 - protein, 81 aa, Colobus angolensis
DSVTFDDVAVDFTQEEWTLLDPTQRSLYSDVMLENYKNLATVGWEMQLETQWSTLQQDFLMGQKSIGIQLEGKHNGGELCD

SEQ ID NO: 13616 - protein, 81 aa, Colobus angolensis
PQASVCFEDVAMAFTKEEWEQLDLAQRTLYREVTLETWEHIVSLGLFLSKSDVISQLEQEEDLHRAEQVSPREKGKLPQED

SEQ ID NO: 13617 - protein, 81 aa, Colobus angolensis
AQESVMFSDVSIDFSQEEWECLNDDQRDLYRDVMLENYSNLVSMGHSISKPNVISSLEQGKEPWLVDRELTRGQWPVLESR

SEQ ID NO: 13618 - protein, 81 aa, Colobus angolensis
RLESVTFEDVAVYFTQNQWASLNPAQRALYGEVMLENYANVASLVAFPFPKPALISHLERGEAPWGPDPWDTKIPRGIGQG

SEQ ID NO: 13619 - protein, 81 aa, Colobus angolensis
SKAPITFGDLAIYFSQEEWEWLSPIQKDLYEDVMLENYRNLVSLGLSFRRPNVITLLEKGKAPWMVEPVRRRQAPDSGSKC

SEQ ID NO: 13620 - protein, 81 aa, Colobus angolensis
TFKEAVTFKDVAVVFTEDELRLLDSAQRKLYRDVMLENFRNLLSVGNQPFHQDTFHFLRKEKLWMMKTTSQREGNSGGKIQ

SEQ ID NO: 13621 - protein, 81 aa, Colobus angolensis
APGSVTFEDVAVYFSWEEWDLLDEAQKHLYFDVMLENFALTSSLGLTSFWSHVVAQPGLGKVSSVLHRMFMTPASARWDQR

SEQ ID NO: 13622 - protein, 81 aa, Colobus angolensis
LVTFRDVAIDFSQEEWECLDPAQRDLYRDVMLENYSNLISLDLESSRATKELSPEKEIYEMESFQWENMGKLINHHLQYNG

SEQ ID NO: 13623 - protein, 81 aa, Colobus angolensis
EMGPLTFRDVAIEFSLEEWQCLDTAQHDLYIKVMLENYRNLVLAGITVSKPNLITCLEQGKDPWNMKRHSMVVKPPVETRF

SEQ ID NO: 13624 - protein, 81 aa, Colobus angolensis
FISFTGQLTFRDVAIEFSQEEWKCLNSTQRTLYRDVMLENYRNLVSLGEDYFLPEHRKEPWTMKSQVQIAGKPKGWEWIKG

SEQ ID NO: 13625 - protein, 81 aa, Colobus angolensis
GEGSLSFEDVAVDLTREEWQSLDWSQKVLYKEVMLENYSHLVSAGYQGTKPDSLFKLEQGEPPWIVEGAAHSQTRPGFVIQ

SEQ ID NO: 13626 - protein, 81 aa, Colobus angolensis
TARSQETVTFKDVAMDFTPEEWGKLDPAQRDVMLENYRNLVSLWLPVSKPENYNLENGKEPLKLERKIPKSSYSGEHILIF

SEQ ID NO: 13627 - protein, 81 aa, Mustela putorius
GWVPALFDEVAIYFSDEEWEVLTEQQKALYREVMRMNYETVLSLEFPFPKPDMITRLEGDEESQNSDEWQLQGGPLAEPEE

SEQ ID NO: 13628 - protein, 81 aa, Erinaceus europaeus
MVSFEDVAVMFTGEEWQHLEDDQRSLYRDVMLETYSILASVGLCITKPEMIINLECGIEPWNISEPLMHSLSGEKPLKCKE

SEQ ID NO: 13629 - protein, 81 aa, Erinaceus europaeus
YEDSVTYEDVTVIFTQEEWALLNPSEKKLYRDVMCENLRNFLSIEKIQEHSTKGLHNLHGSKQSITTVKISKGKDSQNGTI

SEQ ID NO: 13630 - protein, 81 aa, Ornithorhynchus anatinus
AAAAGPVTLEDVSVELSREEWGLLDRARRELYRDVMLDNYPRAGAAGGRRGRTSPDLPPSVERGRSPRATARRPRLFPGFP

SEQ ID NO: 13631 - protein, 81 aa, Tupaia chinensis
MLYQEVMLETCRLLVSLGHPVPKPELIFRLEHGQELWTLKRGPSQGTYAGEKANPRITEPTASQLAFSDESSFQGQLTQRF

SEQ ID NO: 13632 - protein, 81 aa, Tupaia chinensis
MSFEDVAMDFTWEEWQDLEDAQKILYKDVMLETYSNLVFLGQCSAKPAVIYKLEQGGEPWTLELPNQSLPGETTYECKQCK

SEQ ID NO: 13633 - protein, 81 aa, Vicugna pacos
LQEATVFKDVAVYFTRIEWSCLAPDQRALYGDMMLENCGHVASLGFLVAKPALISLLEQGEEPGALILQVAEERGTKASLA

SEQ ID NO: 13634 - protein, 81 aa, Vicugna pacos
AKETVTFGDVALDFTQEEWALLDTSQKKLFRDVMLENIHHLVSVGYQISKSDVILQLEQGKELWREGEGRPQGRGPGSESP

SEQ ID NO: 13635 - protein, 81 aa, Vicugna pacos
MTFTDVAVDITPEDWELMRPVQKELYKTVTLQNYWNMVSLGLTVYRPTVIPILEEPWMVIKEILEGPSPEWEAKAQDCTSV

SEQ ID NO: 13636 - protein, 81 aa, Vicugna pacos
DVCQGSVSFEDVAVEFTQDEWQYVATLYRDVMLENYSHLISVGYCFPTPEVIVKLEQDEEPWSLEEESLNQRYPGRYRVDV

SEQ ID NO: 13637 - protein, 81 aa, Vicugna pacos
ELVTFRDVVISFSQEEWEYLDSAQRDLYWDVMMENYSNLVSLDLESKYDPKTLPIEKDIIEKNDSQWEVIESSTSVGLENS

SEQ ID NO: 13638 - protein, 81 aa, Vicugna pacos
FQGSVSFKDVTVGFTQEEWQHLDPTQRSLYRDVMLENYSNLVSVGYCITKPEVIFRLEQGKEPWIMEEEFPSHSFPEPWKT

SEQ ID NO: 13639 - protein, 81 aa, Vicugna pacos
QNEGSLSFRDVAVVFTWEEWQLLDLIQKNLYQDVMLENYSNLVSVGYQDTRADTFCQLEQGKPWIAEEETHSQIHPEDTWQ

SEQ ID NO: 13640 - protein, 81 aa, Vicugna pacos
RVGSLSFRDVTVGFTWKEWQQLNPAQRALYRDVMLETYSHLLSVGYCIPKPEVILKLEQGEEPWILEEESSSQSVPGQEPG

SEQ ID NO: 13641 - protein, 81 aa, Vicugna pacos
MDSVTFEDVAVNFTMEEWTLLGPSQKKLYRDVMRETFRNLASVGKTWEDHDTEDQYKNQERKLSYVVEALCENKEGNQCGE

SEQ ID NO: 13642 - protein, 81 aa, Odobenus rosmarus
VTFKDVAVVFTEEELGLLDPAQRKLYGDVMLENFRNLISVGEHRRSVGGKIQSKMKTVIEAEPPEELSCWRIWQQIASDLT

SEQ ID NO: 13643 - protein, 81 aa, Odobenus rosmarus
VQEPVTFKDVAVDFTQEEWGQLDPVQRTLYRDVMLETYRHLLSVGNQIAKPEVISLLEQGEEPWSVEQAYPQSTCPEWMRN

SEQ ID NO: 13644 - protein, 81 aa, Odobenus rosmarus
VSLKDVTVDFTWEEWQHLDSAQRNLYRDVMLENYSNLVSVELKSEVTSYTLGLFSDFDIRPKMKELTPWKSISEQVILHNM

SEQ ID NO: 13645 - protein, 81 aa, Odobenus rosmarus
SQGLLTFKDISVDFTQEEWGQLAPAHRNLYREVMLENYGNLVSVGYQLSKPGVISQLEKGEEPWLIEREISGSPSSDLENK

SEQ ID NO: 13646 - protein, 81 aa, Odobenus rosmarus
MTLFQISFEDVAVGFTSEEWQLLNPSQKSLYREVMLENYSNLVFLGYQIIKPDAIFKLEHEEPWIIDEEVLSQNFSEVWLD

SEQ ID NO: 13647 - protein, 81 aa, Odobenus rosmarus
RPRAVKFADVAVYFSPEEWGCLRPAQRALYRDVMRETYGHLGALGCAGPKPALISWLERNTDDWEPAALDPQECPRGLTVQ

SEQ ID NO: 13648 - protein, 81 aa, Carlito syrichta
GLLSFKDISMEFTWEEWQLLDSTQKYLYRDVILENYNNLVAVEDWEEWYQESQDEFESIERSFAYNVFGKLHLSKTHVSSK

SEQ ID NO: 13649 - protein, 81 aa, Delphinapterus leucas
MLENYNNLITVGCPFTKPDVIFKLEQEEPWVVEEEVSKRHCPGEIWGMDEHQKIQDRLLTQLEDKFTKTLTEEKVNECHKK

SEQ ID NO: 13650 - protein, 81 aa, Delphinapterus leucas
QGSVTFEDVAVYFSWEEWCLLDEVQIHLYLDVMLENFALVCMLGSWHWVEDEETPSEQSVSAEGVSQIRTSSAGSSLEKTQ

SEQ ID NO: 13651 - protein, 81 aa, Gulo gulo
PQVLVSFEEVAVFLSREEWGCLGPAQRDLYSDVMLETYGNLISLGLQGSKPDVISRLEKGEEPWAPYSPRIEEGWIWSHGS

SEQ ID NO: 13652 - protein, 81 aa, Gulo gulo
KSQGLLSFSDVAVDFTWEEWQLLDTVQRNLYRDVMLENYSNLMSLGYQVTRPEAMVHLEKEQGVLEREFSSLSSPERSRQC

SEQ ID NO: 13653 - protein, 81 aa, Gulo gulo
PQDLMTFEDVAVEFTQWEWGQLDPAQKDLYRVVMLENFKNLASLGLPVAKPYVISQLEKGKEPCVLEGEISTAAAAAAAAA

SEQ ID NO: 13654 - protein, 81 aa, Cervus elaphus
QGLFTFKDVAVEFTQEEWECLDPTQRALYKDVMLETYRNLLSLGSYSATFAIKELSSPKEDINKGELCHLMTLEKNETYGI

SEQ ID NO: 13655 - protein, 81 aa, Cervus elaphus
VTFEDVAVSFSQEEWGLLGEAQRLLYYDVMLENLSLVASLGKNCVCTHRLCWARPFSLRGSLQPSQPGPWTLLPSLVSWHL

SEQ ID NO: 13656 - protein, 81 aa, Cervus elaphus
LDPVAFEDVAVNFTLEEWALLGPSQKKLYRDVMRETLSNLALIKTTAPPTHEPTVTTRYGADNGRLQAQRGSSPRDNAAGC

SEQ ID NO: 13657 - protein, 81 aa, Colobus angolensis
EKGPLTFRDVAIEFSLEEWQCLDTAQQGLYRKVMLENYRNLVFLAGIAVTKPDLITCLEQGKEPWNIKSHEMVAKPSVICS

SEQ ID NO: 13658 - protein, 81 aa, Colobus angolensis
LQESFSFDDLYVDFTQKEWQLLDPSQKNLYKDVMLENYSSLVSLGYEVMKPDVIFKLEQGEEPWVGDGEIPSSDSSVSGCF

SEQ ID NO: 13659 - protein, 81 aa, Colobus angolensis
MDLMLDVAIEFSLEEWHCLDTAQRNLYRNVMLENYRNLVFLGIVVSKPDLITCLEQGEKPLTMKKHDMVTNPSVLCSHFTQ

SEQ ID NO: 13660 - protein, 81 aa, Colobus angolensis
AEGSVMFSDVSIDFSQEEWDYLDPVQRDLYRDVMLENYSNLVSMGLYTPKPQVISLLEQGKEPWMVGRELTRGLCSDLESM

SEQ ID NO: 13661 - protein, 81 aa, Colobus angolensis
PQGLLTFRDVAIEFSQEEWKCLDPAQRTLYRDVMLENYRNLVSLDISSKCMMNTLSSTGQGNTEVLHTGTLQRQASYHIGA

SEQ ID NO: 13662 - protein, 81 aa, Colobus angolensis
TKGCVTFEDIAVYFSQEEWGLLDEAQRRLYLEVMLENFALVASQGCGHGTEDEETPSEQNVSVRVSQSKAGSSTQKTQSCE

SEQ ID NO: 13663 - protein, 81 aa, Colobus angolensis
GRRAEEAVTFKDVAVIFTEEELELLDPAQRKLYRDVMLENFRNLLSVGHQPFRGDTFHFLREEKFWVMETKSQRERNSGPL

SEQ ID NO: 13664 - protein, 81 aa, Colobus angolensis
AQESLTLRDVAVDFTWEEWQLLGPAQKHLYQDVMLENYSNLVSVGFQASKPDALTKLEQGEPLWALEDEIHSPTHPEIEKA

SEQ ID NO: 13665 - protein, 81 aa, Colobus angolensis
EIRSCAPVTFDDITVYLLQEEWVLLSQQQKELCGSDKLVAPLGPTVANPELFCKFGRGPESWLGSVQGQGSHLEHHSGKKQ

SEQ ID NO: 13666 - protein, 81 aa, Colobus angolensis
CEVSVSFEDVTVDFSREEWQQLDSTQRRLYQDVMLENYSHLLSVGFEVPKPEVIFKLEQGEGPWTSEGEAPHQSCSDGKFG

SEQ ID NO: 13667 - protein, 81 aa, Erinaceus europaeus
SQESVTFQDVAVDFTEKEWPLLDSSQRKLYKDVMLENYSNLTSIGYHVGKPSLISHLEQELEPRTEERGSPSGRCPDREAP

SEQ ID NO: 13668 - protein, 81 aa, Carlito syrichta
AQGSMSFEDVTVELTQEEWQQMGPRERSLYRDMMLENYGHLVTVGCCITKPKVILKLEQGEEPWPLEVKFLNRKYPGYYKI

SEQ ID NO: 13669 - protein, 81 aa, Delphinapterus leucas
FQEPVSFKDVAVTFTKEELGLLDSTQRKLYQDVMLENFWNLVSVGYLPFKLDMILQLGRKKKLWVMEPEAQGAGCSGHGNQ

SEQ ID NO: 13670 - protein, 81 aa, Carlito syrichta
MSQVTFSDVAIDFSHEEWTWLDSAQRNLYKDVMVQNYKNLVSLAGLSVTKPYVITLLEDGKEPWMVEKKLSKDWESRWENK

SEQ ID NO: 13671 - protein, 81 aa, Carlito syrichta
QDTAAYEDLSVDYTQKKWKGPALSQKALYRNMMPENYHSMVSLDANMMEHSVLTLKQKMSKGSLSSDRTSGGLFGVAPGKP

SEQ ID NO: 13672 - protein, 81 aa, Delphinapterus leucas
LEGSVTLQDVAVEFTPEEWQLLDCDQRTLYWDVMLENFRNLISMGCPVTKTVVIFKVEQGQEPWMVEGENPRWRSPEADCP

SEQ ID NO: 13673 - protein, 81 aa, Carlito syrichta
LQELLSFEDLSVDFTQKEWQLLNPYQKNLYKDVMLENYSSLVSLEVWQVDDDMIWPQDNQDKLKNMGREHEYGAFGKNFSL

SEQ ID NO: 13674 - protein, 81 aa, Carlito syrichta
MLENYRNLVSVGLCISKPHMISLLEQEKEPWVTKGEMTRGLCPDLEYVWVTKELSLNQHIYEENLPQGIVMRRLTSYDLEC

SEQ ID NO: 13675 - protein, 81 aa, Carlito syrichta
DPTRDSVAFEDVAVNFTQEEWALLNPSQKNLYRDVMQETFSNLASIGSKGEDQSIEDQYKNSWRNLTHIMYHSGSKSYDCE

SEQ ID NO: 13676 - protein, 81 aa, Erinaceus europaeus
RSEALSFADVSVSFSREEWGCLRPAQKALYRDVMRETCGLLGALGLSGPKPAFISWLEGEMEAWSPEAHEPERESRAADAR

SEQ ID NO: 13677 - protein, 81 aa, Mustela putorius
PKVPVSFEDVSVYFTKTEWKLLDVQQRILYKTVMLENYHHLVSLGCLSTKPHLVSWLEQGEGPWTTDIWRTPATAKTQTEG

SEQ ID NO: 13678 - protein, 81 aa, Mustela putorius
EAAVVSFQDVAVDFTREEWWLLSHTQRMLYRCVMLENYSNLVSLGIPFPKPTLVILLEQGEEPWTEEGEALPSSCSADAKP

SEQ ID NO: 13679 - protein, 81 aa, Mustela putorius
SSVTFEDVAVYFSQEEWRFLNKAQKHLYHDVMLEVFALIASLGGGQGALEAAAPSEQNVSGGGSQKAYAQDCSLDTNPGQT

SEQ ID NO: 13680 - protein, 81 aa, Tupaia chinensis
KKAAVSFKDVTVELTQEEWRHMDPAQRTLYRDVMLENYSHLVSVGYCFTKPELIFTLEQGEDPWLSRKENNFLSKSPPGTS

SEQ ID NO: 13681 - protein, 81 aa, Mustela putorius
QVTFEDVVVDFTREEWGQLEPAQRTLYLDVMLETFRLLVSVDLETRPKTRLSSPKQDITEERSSSDLVERFLWEGLWDAEG

SEQ ID NO: 13682 - protein, 81 aa, Tupaia chinensis
GWVPALFDEVAIYFSDEEWEVLTEQQKALYREVMRMNYETVLSLEFPFPKPDMISRLEGEEESPNSDEWQLQGGTFAEHED

SEQ ID NO: 13683 - protein, 81 aa, Mustela putorius
SLDSDLFRDVAVVFSREEWERLAPAQRVLYRDVMLETYSNLVSLGLAIYKPDVISFLEQGREPWLVEEAAGRSRCPVLESK

SEQ ID NO: 13684 - protein, 81 aa, Mustela putorius
PKVPVTFDDISIQFSTPEWDKLEERQKELYKNIMKGNYESLISMDYAMNQPDVLSQIQPEGEHNTEEQPGPEESEIATDPS

SEQ ID NO: 13685 - protein, 81 aa, Tupaia chinensis
VTFEDVAIYFSQEEWGLLNEAQICLYLDVMLGNFALITSLGYEHGAEDTEATSTQSITVEEGLQGRTSKADSSNQKTHPFD

SEQ ID NO: 13686 - protein, 81 aa, Tupaia chinensis
FQASVAFEDVAVNFTREEWALLDPSQKKLYKDVMQETACNLAFVESRCERDEGVPGDVQKESPPGAKPHNSGVYEEGFVGP

SEQ ID NO: 13687 - protein, 81 aa, Tupaia chinensis
GKESLTFGDVALAFTQIEWRHLDAAQRALYRDVMLENYGNLVSVGLLASKPKLISQLEQGAEPWMEVEEIPFSTCTVEDYW

SEQ ID NO: 13688 - protein, 81 aa, Odobenus rosmarus
ALALITFKDVAVTFTGEEWRHLDLAQRTLYREVMLETCGLLVSLGHPVPKPELTYLVEDGQELWTVRRDLSKSTYTGEKAK

SEQ ID NO: 13689 - protein, 81 aa, Odobenus rosmarus
PKVPVTFDDISIYFSTPEWEKLEEWQKELYKNIMKGNYESLISMDYAMNQPDVLSQIQPEGEHNTEEQAGPEENEIPTDPS

SEQ ID NO: 13690 - protein, 81 aa, Odobenus rosmarus
FQAKVTFEDVAVLLSQEEWDRLGPAQRGLYRHVMMETYGNVVSLGLPGSKPNVISQLERGEEPWVLDGQGAEESRGLGSGH

SEQ ID NO: 13691 - protein, 81 aa, Odobenus rosmarus
MAVSEPGGSAAEWEQLDPAQRNLYKDVMLENYSNLASMGYQAPKPDMISKLEKGEEPWLGKGKRPRQGGPSEIARPKQIGT

SEQ ID NO: 13692 - protein, 81 aa, Odobenus rosmarus
LQGSVTFPDVAVDFTPEEWQLLDCEQRTLYWDVMLENFRNLISVGGPVTKTKAIFKAEQGQEPWMREGANPRWRHPEADCL

SEQ ID NO: 13693 - protein, 81 aa, Odobenus rosmarus
ISFEDVAVGFTSEEWQLLNPSQKSLYREVMLENYSNLVFLEVWLDNSLKMWHQDNQDKLRSMERGHEYDVFRKIFHSSINF

SEQ ID NO: 13694 - protein, 81 aa, Odobenus rosmarus
SLELVSFEDVAVNFSWEEWQDLDDAQRTLYRVVMLETYSSLVSLGHCITKPEVIVKLEQGAEPWTVEEAPAQSLPDVQTAD

SEQ ID NO: 13695 - protein, 81 aa, Odobenus rosmarus
RSQESLTFQDVAVNFTREEWDQLYPAQKNLYRDVMLENYRNLVALGHQLYKPEVISHLEQEEQWVMERDSPLDTHTDGESR

SEQ ID NO: 13696 - protein, 81 aa, Odobenus rosmarus
PQATVSFKDVTVEFTQEEWRQMDSAQRTLYRDVMLENYSHLVSVGYCFTKPELIFTLEQGEDPWLLKKEFLRKTSPEDSQP

SEQ ID NO: 13697 - protein, 81 aa, Odobenus rosmarus
LLTFRDVAIEFSPEEWECLDPAQRALYRDVMVENYRNLVFLDIFTRCVSKELPPKEDINNGELFQTLIFLERHIRHEFEDF

SEQ ID NO: 13698 - protein, 81 aa, Odobenus rosmarus
MAVTFEDVTVIFTWEEWKFLDSSQKKLYREVMWENYTNVMSVGNWKESYKPQEERFRYLEHENLPCWQAWRNASAQIYENR

SEQ ID NO: 13699 - protein, 81 aa, Odobenus rosmarus
WKELLSFEDVAMYFTREEWNKLEWAQKDLYRDVMLENYRNMILLGFQFPKPEVICLLEQWEEPWILDLPRAGTRKASSSAC

SEQ ID NO: 13700 - protein, 81 aa, Odobenus rosmarus
APGSVTFEEVAVYFSQEEWRLLNEAQRHLYRDVMLEVFALVASLGCGRGTEDEAAPSEQNVSVGGSQINSTQKAYTQERGL

SEQ ID NO: 13701 - protein, 81 aa, Delphinapterus leucas
AQVLVTFKDVAVTFTQEEWRQLDLDQRTLYQEVMLEICGLLVSLGHPVPKPELIHLLEHGQELWMGRRGLPRSMCPDDRAK

SEQ ID NO: 13702 - protein, 81 aa, Carlito syrichta
MASPSPPPEPKEWDYLDPAQRSLYKDVMMENYGNLVSLDVLNRDKDDEPTVKQEIEEIEEEVEPQGVIVTRIKSEIDQDPM

SEQ ID NO: 13703 - protein, 81 aa, Carlito syrichta
AERPPEMAVSEDRASAAEWKQLDPAQRNLYKNVMLENYSNIASMGCQASKPDIISKLEKGEEPWLGKEKRPSQGHLSKTAG

SEQ ID NO: 13704 - protein, 81 aa, Ornithorhynchus anatinus
MLENYDHVASLGFPVSKPTVILQLERGVEPWVLNTREAEKRRSPTGARRTGSSVPPQAAGEIEPPASLSARETETGIGSLP

SEQ ID NO: 13705 - protein, 81 aa, Erinaceus europaeus
TQGPLSFEDVAVDFSREEWQLLSPSQKALYRDTMLETHSNLVSVGCQAAKPDSLLWLEKGEPLWMVKGAAKCQSCAGRTSD

SEQ ID NO: 13706 - protein, 81 aa, Erinaceus europaeus
RWRLVTFGDVAVDFSRAEWQRLTSTQKGLYRKVMLENYRSLASLGLCVSKPDLISLLEQRGEPWMKRKTRGLCPDLKALQE

SEQ ID NO: 13707 - protein, 81 aa, Gulo gulo
FQELVSFEDVAVNFSWEEWQDLDDAQRTLYRAVTLETYSSLVSLGHCISKPEVIVKLEQGAEPWAVGEAPAQRLPDVQSAG

SEQ ID NO: 13708 - protein, 81 aa, Erinaceus europaeus
KIPILKGVAMDFTLEDWGQLGLNQGDLFWDKALDNYQNLFLLNPLRSSLTSCPDGVEELEVKGNPEVMGPDKAETKKTLLE

SEQ ID NO: 13709 - protein, 81 aa, Erinaceus europaeus
SPKDTVTFPDVAVSFTQEEWNLLNPSERNLFRDVMLENYKNLISVGYHKVKPSVISWLEQEDLWTVEKEVLQEWELQLKKN

SEQ ID NO: 13710 - protein, 81 aa, Ornithorhynchus anatinus
PKGPVAIENDGAYFSEQEWENLEEWQKELYRNVMKSNYETLVSLDCALPTLELLPPQARGEDPVVPEELGHLEERESLAGP

SEQ ID NO: 13711 - protein, 81 aa, Ornithorhynchus anatinus
PKVPVTFDDVAVHFSEQEWGNLSEWQKELYKNVMRGNYESLVSMDYAISKPDLMSQMERGERPGPGQEPEDSEMPTDPSAA

SEQ ID NO: 13712 - protein, 81 aa, Ornithorhynchus anatinus
GRVEVTFKDVAIFLTQQEWESLADAQRELYTTVMLENYGHLQSLGAGFPKPHCIRQLEKGKDPWIPEPPEEQMPSTAFAES

SEQ ID NO: 13713 - protein, 81 aa, Mustela putorius
MDSVVFEDVVVDFTQEEWALLNPSQRKIYRDVMLETFRNLVSVDDETQFKTTGSISQQDSFGEKLSNEQKIARFTKNDFWT

SEQ ID NO: 13714 - protein, 81 aa, Mustela putorius
MDLVIFEDVAVDFTLEEWALLDSMQRNLYRDVMLETFQNLVSVDYETLFKASGLVSQQDTLEKKKSIEQKMAKFTRNHSCA

SEQ ID NO: 13715 - protein, 81 aa, Tupaia chinensis
LPSHTCGMLQDSVAFKDVAVNFTKEEWALLEPSEKKLYRDVMLETIKNLDCIVSAFFFHTRGMLQDSVVFEDVVVNFTKEE

SEQ ID NO: 13716 - protein, 81 aa, Tupaia chinensis
FQDSVAFEDVVVNFTQDEWTLLDTSQKKLYGDVIWETIENLDFTGRNWEDEDIEEKYENAIKDLSAVSLSLPPPHTCGMLQ

SEQ ID NO: 13717 - protein, 81 aa, Tupaia chinensis
VSFEDVAVDFTWEEWQNLNDAQRTLYKDVMLETYSSLVFLGHCIAKPAVIFKLEQGGEPWTLEFPNQTFPGEKPYGCEQCK

SEQ ID NO: 13718 - protein, 81 aa, Tupaia chinensis
AAESVTFKDVAVDFTEEEWHHVDPAQRSLYRDVMLENYSHLVSLGYQVSKPEVIFKLEQGKEPWISEGEIQRPFCADWKTR

SEQ ID NO: 13719 - protein, 81 aa, Delphinapterus leucas
RMEAVTFGDVAVHFSREEWQCLDPGQRALYKEVMLENHSSVAGLGFLVFKPELISRLEQGQEPWVLDLQGAEGREAARTSQ

SEQ ID NO: 13720 - protein, 81 aa, Erinaceus europaeus
FQDFVTFGDVAVDFSQEEWEWLTPVQRNLYKKVMLENYRSLVSLAGVSVSKPDVISLLEQGKEPWMMKEEARGICHDWKYA

SEQ ID NO: 13721 - protein, 81 aa, Erinaceus europaeus
SQASVSFKDVTVEFTQDEWRLMSSAQRTLYREVMLENYSHLISMGYCSTKPELIFALEQKDFRESILERESLSTIPPEDFQ

SEQ ID NO: 13722 - protein, 81 aa, Ornithorhynchus anatinus
RPTPVTFEDVAVYLTREEWKLLGPSQRDLYRDTMLENYRHVVSLGYPAAKPAVIAQLERGMELCFRNLPSTKGRRHLRDAC

SEQ ID NO: 13723 - protein, 81 aa, Carlito syrichta
SQRPLTFRDVAIEFSQEEWTCLDPAQKALYRDVMLENYRNLVSLGISLSGMPVTSMLEQEREPWTVESEVRIAKNPDGWER

SEQ ID NO: 13724 - protein, 81 aa, Carlito syrichta
QKTNMAQGSVSFEDVTVELTREEWQQMGPWERSLYRDVTLENYGHLVAVGCCITKPKVILKLEQGEEPWSLEVKFLNRKYP

SEQ ID NO: 13725 - protein, 81 aa, Delphinapterus leucas
SLGTVTFKDVAVDLTQEEWQQMKPAQRDLYRDVMLENYSNLVTVGCQVTKPDVIFKLEQEEEPWVIEEEMLGRPCPVWEDD

SEQ ID NO: 13726 - protein, 81 aa, Delphinapterus leucas
GLLTFKDVAITFSQEEWECLDPAQRALYRDVMLETYRNLLSLGSLSAGFTIKELSPREGINKGELYHLVILDRNDNHGIKD

SEQ ID NO: 13727 - protein, 81 aa, Delphinapterus leucas
LLTFEDVALFFTEEEWQLLDPAQKILYNNVMQENYETVISLGLKLKNDTGNDQPMSLSTLEIQASGCKVLRKARMKVAQKT

SEQ ID NO: 13728 - protein, 81 aa, Carlito syrichta
MAFEDVAVYFSQEEWGLLDTTQRALYRRVMLENFALVSSLGLSTSRPRVVIQLERGEDPWVPHGMDTTPARNTHRRHNPGS

SEQ ID NO: 13729 - protein, 81 aa, Carlito syrichta
SQGELTFRDVAIEFSQEEWRCLDPGQRDLYKDVMLENYWNLVSLGISHFDMNIISMLEEGKEPWTVKSYVKIARKRNVWKY

SEQ ID NO: 13730 - protein, 81 aa, Delphinapterus leucas
FQDPVTFEDVAVVFTDEEWRCLVPTQRALYKEVMLENYKSIVSLGLPVPGPDVIFQLKRGDEPWIVELHGSEGKECAENVS

SEQ ID NO: 13731 - protein, 81 aa, Carlito syrichta
SWGSLSFMDVFVDFTWEEWQLLDPTQKHLYRSVMLENYSNLVSLGYQHTKPDVIFKLEQEELCVVQSKTPSQGHPVLEAEK

SEQ ID NO: 13732 - protein, 81 aa, Gulo gulo
SQDSLTFQDVAVNFTREEWNQLYPAQKILYRDVMLENYRNLVALGHQLYKPEVISQLEQEEQRGTERDSPADAHADGESRP

SEQ ID NO: 13733 - protein, 81 aa, Gulo gulo
VQVLVTFKDVAVTFTQEEWGHLDLDQRALYQEVMLETCGLLVSLGHPVPRAELAHLLEHGQELWTGKGGLSRSTCSGDSVR

SEQ ID NO: 13734 - protein, 81 aa, Delphinapterus leucas
LQGSVSFEDVAVDFTRQEWYRLDPAQRTMHKDVMLENYSNLASVGLCVAKPEMIFKLERGEELWILEEESSGHGYPGSLSL

SEQ ID NO: 13735 - protein, 81 aa, Delphinapterus leucas
NFWILRLPPGSKGEAPKEWGNLSEWQKELYKHVMRGNYETLVSLDYAISKPEVLSQIEQGKEPCSWRRAGPKVPDVPVDPS

SEQ ID NO: 13736 - protein, 81 aa, Delphinapterus leucas
ELVTFRDVVISFSQEEWEYLDSAQRDLYWDVMMENYSNLVSLDLESKCDKETLSTEKDIIEKNGSHWEVIESSKLVGLENS

SEQ ID NO: 13737 - protein, 81 aa, Delphinapterus leucas
MKFTWEEWQLLDPDQKDLYRDVMLENYSNLLSVGYQASKPDAVSRLERGEQLWPVEDDSHGRICPEIRKVDDPLQHHLPNH

SEQ ID NO: 13738 - protein, 81 aa, Carlito syrichta
VVFEDVAIYFSQEEWGHLDEAQRLLYRDVMLENLALLSSLGCCHGAEDEASSGQGVSLGVSQVMTSKPLLSTQKTHQPCET

SEQ ID NO: 13739 - protein, 81 aa, Delphinapterus leucas
MLENFRNLISMGCPVTKTVVIFKVEQGQEPWMVEGENPRWRSPEADCPLIDESDKHQESKDNFLNSVLFMFNKILTVKRLH

SEQ ID NO: 13740 - protein, 81 aa, Carlito syrichta
RPRALKFADVAVYFSSEEWGCLRPAQRALYRDVMRENYGHLGALGCAGPKPALISWLERNTDDWEPAALDPLEYPRGVTIQ

SEQ ID NO: 13741 - protein, 81 aa, Carlito syrichta
GMAHMAFTDVAVDFTQEEWRLLSPAQRTLYREVMLENYSNLVSLGIPFSKPKLITQLEQEKETWREERKCPLATCPAEPEP

SEQ ID NO: 13742 - protein, 81 aa, Delphinapterus leucas
WKGLLSFEDVALYFTREEWDTLDWAQKDLYRDVMLDNYRNVLSLGVQFPKPEVICQLEQWEEPWILDLPRAGTRKASGSAC

SEQ ID NO: 13743 - protein, 81 aa, Carlito syrichta
PQASVCFEDVAVTFTYEEWRQLDTAQRMLYRDVTLETCRHLVSLGLLLSKPDVISQLEQREDLWRVEQASPQDWKATLEKK

SEQ ID NO: 13744 - protein, 81 aa, Delphinapterus leucas
KEAFMAFGDVAVDFTQEEWRLLSPAQRTLHREVMLETYNHLVSLEIPFCKPKLISQLERGEEPWIEERQRPPSLCPAGSKL

SEQ ID NO: 13745 - protein, 81 aa, Carlito syrichta
QGHLTFRDVSIEFSQEEWKCLDPAQRALYRDVMLENYRNLISLGISPKYVIKELSLKWKSNTREVFYIVTLGRHESHDIED

SEQ ID NO: 13746 - protein, 81 aa, Gulo gulo
QGLLTFRDVAIEFSEEEWGHLTHTQRQLYRDVMLENCGHLLFLGLLLSKPDLMIYLEQEKQLWDVKRKETRGFHPALSSHE

SEQ ID NO: 13747 - protein, 81 aa, Gulo gulo
VTFRDVAIDFSQEEWEFLDSAQRDLYRDVMWENYSNFISLGKAIYPKLCWLSLLSISGLCFEKLDNFFLCSRGMVLASLGW

SEQ ID NO: 13748 - protein, 81 aa, Erinaceus europaeus
AISCEDVTVNFSQEEWALLNPSEKKLYKDVMWEIFHNLVLIGKLQEDSFIEQQQDHEGSKQRNIEDKISEKKEGSRYRENP

SEQ ID NO: 13749 - protein, 81 aa, Ornithorhynchus anatinus
AVSFEDVAVYFSPEEWARLGPAQRALARDVMWDNYRTGSLIHLRTHTGARPYRCPDCGKAFSRGSHLTISTLVTHQRTHTG

SEQ ID NO: 13750 - protein, 81 aa, Ornithorhynchus anatinus
WAQMPVMFEDVAMYLSREEWGQLNATQRGFYKDVLQKWNGLSWGFPLSKPAWIAQPEGRGEPSSAPRRGPEEKSTTCSAGG

SEQ ID NO: 13751 - protein, 81 aa, Carlito syrichta
YQELLTFKDISVDFTQEEWGQLAPAHRNLYREVMLENYGNLVSVGYQLPKPGVIFHLEKGEDPWLRDRDISGGPSSDLESK

SEQ ID NO: 13752 - protein, 81 aa, Carlito syrichta
EVGLLSFKDVAIEFSPEEWACLNSPQRILYRTVMLENHRNLVFLGLTVSKPDLITCLEQRQDPWNVKRHGTLAKLPAVTSH

SEQ ID NO: 13753 - protein, 81 aa, Carlito syrichta
MLENYRNLLSLGLPGSKPDVICRLERGEEPKMEEREGLRVTCPEKKPFTCVECGKAFIYHSDYILHQRIHTGEKPYKCNDC

SEQ ID NO: 13754 - protein, 81 aa, Carlito syrichta
EVGLLSFKDVAIEFSPDEWACLNSPQRILYRTVMLENHRNLVFLGLSVSKPDLITCLEQRKEPWNVKRHGTLAKFPAVTSH

SEQ ID NO: 13755 - protein, 81 aa, Delphinapterus leucas
QEQLTFKDVAIEFSQEEWECLDPAQRALYRDVMLETYKNLVSLDICHIYVMKKLQPKVNSDGGEVFQTVMLETRESREIRD

SEQ ID NO: 13756 - protein, 81 aa, Delphinapterus leucas
FRGSVMFRDVSINFSQEEWECLDLGQMNLYKEVMLENFSNLVSVGLSSSKPTVISLLEQGKEPWMVDRELTRGLCSDLESM

SEQ ID NO: 13757 - protein, 81 aa, Erinaceus europaeus
DKESEYEDVTVIFTQEEWALLNPAEKKLYRDVMWENFRNFLSLEKIQEHSIKEQHNFQGSKQSTLWTHERIHSGEKPYKCR

SEQ ID NO: 13758 - protein, 80 aa, Erinaceus europaeus
MSDLKRMLTFKDVAIEFTQEEWECLDQAQKDLYKDVMLENYGHLVSLDCMISKPDLITFLEQKKEPWAKKRKKLSIFKGT

SEQ ID NO: 13759 - protein, 81 aa, Mustela putorius
KVPVTFVDIAVYFSEDEWKNLDEWQKELYNNLVKENYKTLMSLDTEGTVPKPDAPSQVEPREEPCVWEQRDPEEREILMDP

SEQ ID NO: 13760 - protein, 81 aa, Mustela putorius
PQESVTFKDVAVDFTQEEWHHVDPAQRRLYRDVMLENYSHLVSLGYQVSKPEVIFKLEQGEEPWISEGEIQRPFCPDWKTR

SEQ ID NO: 13761 - protein, 81 aa, Mustela putorius
MLENYSNLVSLGYQDSKPDIIFKLEQEEPWMMPAQIPRPGHPEKVGEIDRMEWHQENQSKLESMAKGYECTTFGKLCLLST

SEQ ID NO: 13762 - protein, 81 aa, Mustela putorius
SHTLVTFRDILVNFTREEWKLLDSAQQIMYKDVMLENYKNLVSLGHQLPKPHVILQLEKGEEPWLVERGIHQETQADLETA

SEQ ID NO: 13763 - protein, 81 aa, Tupaia chinensis
ECGREGELNGEGKELGEEIAVSSRKLRALYRIVMLENYGNLTSLGYPVPKPALISLLEEGDLPLGLQAQDAETNIGNDSTQ

SEQ ID NO: 13764 - protein, 81 aa, Tupaia chinensis
MDVMLENYCHLISVGIEVQPITVKSYFRLSGCHMTKPDVILKLERGEEPWTSFVGHTYLEEKPYQCHQCGNAFRRKSYLID

SEQ ID NO: 13765 - protein, 81 aa, Carlito syrichta
MASPSPPPEPKEEWDYLDPAQRSLYKDVMMENYGNLVSLDVLNRDKDDEPTVKQEIEEIEEEVEPQGVIVTRIKSEIDQDP

SEQ ID NO: 13766 - protein, 81 aa, Delphinapterus leucas
SQELLTFKDISVDFTQEEWGQLAPAHRNLYREVMLENYGNLVSVGYQLSKPGVISQLEKGEEPWLMEREISGGPTPDLEDE

SEQ ID NO: 13767 - protein, 81 aa, Carlito syrichta
AEGSVSFEDVTMEFTWEEWRLMGPRERSLYRDVMLENYGHLVAVGCCITKPKVILKLEQGEEPWPLEVKFLNRKYPGYYKI

SEQ ID NO: 13768 - protein, 81 aa, Carlito syrichta
YQDSVSFEDVAVDFTQEEWTLLDSAQRDLYRDVMLETCENLASIGSDLLNHNVICCLEGEEELRTVQGRVLEEWRLKTRGS

SEQ ID NO: 13769 - protein, 81 aa, Delphinapterus leucas
LKGLVMFKDVAIDVSQEEWECLNPAQRNLYKDVMLENYSNLVSLGLSISKPAVISSLEQGKEPWMVMREVIGDQFPDLVSK

SEQ ID NO: 13770 - protein, 81 aa, Carlito syrichta
CQEAVTFEDVAVVFTDEEWKHLVPVQRDLYKEVMLENYESIASLGLPVPRPDVIFQLKMRDEPWIVDLCEPEERECPETVS

SEQ ID NO: 13771 - protein, 81 aa, Carlito syrichta
GILTFKDVTVDFSLEEWACLSPAQQNLYSDVMLENYRNLVFVDLTQHKRIHNGDKPCKCGECGKAFNQYSNFIQHKIIHTR

SEQ ID NO: 13772 - protein, 81 aa, Carlito syrichta
AQGSVSFEDVTMELTREEWQQMGPAERNLYRDVTLENYGHLVAVGCCITKPKVILKLEQGEEPWSLEVKFLNGKYPGYYKI

SEQ ID NO: 13773 - protein, 81 aa, Carlito syrichta
MVTFKDVAVVFSEEELRLLDSAQRKLYRDVMLENFRNLLSVAHQPFKPDLISQLEREEKLLMVETETQRNGCSGSKNQQMM

SEQ ID NO: 13774 - protein, 81 aa, Delphinapterus leucas
AQGKVNFEDVFVYFSQEEWGLLDEAQRLLYREVMLENFALMASLGCSHGMEEEEIHFEQSVSVKGVSQVTIPKTIPSSQKA

SEQ ID NO: 13775 - protein, 81 aa, Gulo gulo
QGLLTFRDVAIEFSEKEWGHLTHTQQQLYRDVMLENYGHLHFLETGLLLSMPHLIMVLEQEKQLWDVKTKERLETSIQAAA

SEQ ID NO: 13776 - protein, 81 aa, Gulo gulo
SQYLVTFEDVAVTFTQEEWTLLDQTQRDLYRNVMLENYQNLIILGYESCKPDLYSLMGGAEELRTGGRGILQELDLRLKTE

SEQ ID NO: 13777 - protein, 81 aa, Mustela putorius
PLTFRDVAVVFTEEELRLLDPAQRKLYRDVMLENFRNLLSVGDKNTKEMEYIPERELKGHYLREVSCWKIWEQVAGELIGS

SEQ ID NO: 13778 - protein, 81 aa, Mustela putorius
STEPVIFRDVAMYFTQKEWQLLKPAQKDLYKEVMLENYGNLASLGYRFFKPKLITRLEQGDEPCVKERDVPQEPQQSSAGV

SEQ ID NO: 13779 - protein, 81 aa, Mustela putorius
MLENYGHLCFLGLLLSKPDLIMFLEQEKVLWDVKRKETGGFHPAVSSHDTQSFLLKQSIEDSFQTVSVYRYKHSAVETLHL

SEQ ID NO: 13780 - protein, 81 aa, Mustela putorius
KEMVTFKDVAVVFTEEELGLLDPSQRKLYRDVMLENFGNLVSVGHQPFKRGGVHLVREEKFGMMKLATQRKGISGDKVQHE

SEQ ID NO: 13781 - protein, 81 aa, Tupaia chinensis
LQGTVTFKDVAIDFTQEEWKRLDPAQRNLYRNVMLENYNNLITVGYPFTKPEVIFKLEQEEEPWVVEEEVLRRHCPGDLWG

SEQ ID NO: 13782 - protein, 81 aa, Tupaia chinensis
MLENYSSLVSLGYEVMKPDIIFKLEQGEEPWIGDGEIPSPDIPEEVLQVDHCLTWHPDNHNKLKNGKKGHECDAFWKKFNL

SEQ ID NO: 13783 - protein, 81 aa, Vicugna pacos
AYMSLAFRDVAIDLSQEEWECLDPDQRTLYRDVMLENYSNLVSLGCSTPKPDVITLLEQEKEPWMVMREGTRSWYTDLESK

SEQ ID NO: 13784 - protein, 81 aa, Vicugna pacos
SQHLVTFEDVAVNFTQEEWTLLDQTQRDLYRDVMLENYQNLMALGSESCKPHVNSPLEGAEELRTRARRILQSEFMAESDL

SEQ ID NO: 13785 - protein, 81 aa, Odobenus rosmarus
SQGSISFEDVTVNFTQEEWGQLDPDQRTLYRDVMLENYSIFISLEELKVDGIIESKENQHRHYGKMITEKENVLRKTFNLY

SEQ ID NO: 13786 - protein, 81 aa, Odobenus rosmarus
MAFRDVAVAFTQKEWKLLSPAQRTLYRDVMLENYSHLVSLGIAFSKPKLITQLEQGDEPWREESECLLDLCPAEPGTEFQP

SEQ ID NO: 13787 - protein, 81 aa, Odobenus rosmarus
SQGPLTFRDVAIEFSQEEWGCLNHTQRELYRDVMLENYGHLLFLGLVVWKPDLVIFLEQEKQLWDVKRKETVAFHPAVSSD

SEQ ID NO: 13788 - protein, 81 aa, Odobenus rosmarus
PKVPVSFEDVSVYFTKTEWKLLDLRQRILYKRVMLENYRHLASLGFLSSKPHLVSWLEQGEGPRAADTCRTRAAAGMQKGD

SEQ ID NO: 13789 - protein, 81 aa, Odobenus rosmarus
CEVSVSFEDVTVDFSREEWQHLDPAQRRLYQDVMLENYSHLLSVGYEVPKPEVIFKLEQGEEPWILERKTPHQSCSDGRFR

SEQ ID NO: 13790 - protein, 81 aa, Odobenus rosmarus
SPVSCAPVTMRGPKEEWDYLDPAQRSLYKDVMMENYGNLVSLDVLNRDKDEEPTVKQEIEEIEEEVEPQGVIVTRIKSEID

SEQ ID NO: 13791 - protein, 81 aa, Odobenus rosmarus
SQELVTFEDVAVYFIRKEWKRLEPAQRDLYRDVMLENYGNVFSLDGETRTEHDQEISEDTGSHGVLLGRFQKDISQGLKFE

SEQ ID NO: 13792 - protein, 81 aa, Delphinapterus leucas
QGHVVFEDVAVSFSQEEWGLLNDAQRLLYCDVMLENLSLIASLGCWCAVGTEEAASEQCVSVELVTQDRNPNPDPSILKTL

SEQ ID NO: 13793 - protein, 81 aa, Carlito syrichta
KQEAVTFKDVAVVFTREELRLLDLAQRKLYQDVMVENFKNMVAVGHLLFKPDMVSQLEAEEKLWMMEAEAQRSGYSDENYV

SEQ ID NO: 13794 - protein, 81 aa, Vicugna pacos
CEESVTFKDVAVDFTQEEWGQLDSPQRALYRDVMLENYQNLLALGPPVCKPDVISHLERERGPRPEIGELSPQQLVIYKEE

SEQ ID NO: 13795 - protein, 81 aa, Vicugna pacos
FQEAVTFKDVAVTFTEEELGLLDPAQRKLHRDVMLENFRNVVSVGHQSSKPEMIAQLEREDKLWMTEIQTQGGVRSHSEME

SEQ ID NO: 13796 - protein, 81 aa, Vicugna pacos
PQKSVTFEDVAVYFTQTEWDGLSPAQRALYRDVMLENYGNVASLGFPLLKPAVISQLEGGGKLGGPSPLASGTGTGPQGLW

SEQ ID NO: 13797 - protein, 81 aa, Vicugna pacos
TQVSVTFEDVAVTFTQEEWGQLDPAQRTLYQEVMLENCRLLVSLGCPVPRPELICQLEHGQELWTGRKDCSQSPCPGDKGK

SEQ ID NO: 13798 - protein, 81 aa, Vicugna pacos
SQGSLSFSDVAVDFTREEWQLLDTVQKNLYRDVMLENYSNLLSLGYQVSKPEALVPLEEGREQGIVEREFPSQCRLEVMWQ

SEQ ID NO: 13799 - protein, 81 aa, Vicugna pacos
MLENYGALASLAAFPFPKPALIFQLEQGEAPWSSAPQGALDGEGPRGISSGYPFLKPAGVSHLEEVEEPLKRKLQGEGPSL

SEQ ID NO: 13800 - protein, 81 aa, Vicugna pacos
MAHGSVMFSDVSIVFSQEEWEYLDLKQRDLYRDVMLENYSNLVSLDVISLLEQGKEPWKVMRKGRGRYPDLETRYETKKLS

SEQ ID NO: 13801 - protein, 81 aa, Vicugna pacos
LQNSFAFEDLSVDFTQKEWQLLEPNQKDLYRDVMLENYSSLVSLGYKVTKPGVILKLERGEEPWVGDGGAPRADAVEQVLQ

SEQ ID NO: 13802 - protein, 81 aa, Vicugna pacos
MLETYRNLVSLGAGPAGPKPGVIAQLERGDEPWVLDLPGAEGSKQPRVRGSAHGTRTEYKELTSGEMLDGDLGQLRGTVLQ

SEQ ID NO: 13803 - protein, 81 aa, Vicugna pacos
DSWGPLSFMDVFVDFTWEEWRLLDPAQKHLYRSVMLENYNNLASLGHQHTKPSVVFQLEQEELWMMQIPSQGRAGIYLPVV

SEQ ID NO: 13804 - protein, 81 aa, Vicugna pacos
LQEPVTFADVAVLFTPEEWLFLDSAQRSLYRDVMLENYRNLASVGDQLCTPSTFSHLEPREELCITERGLFPGAHAEPQLQ

SEQ ID NO: 13805 - protein, 81 aa, Carlito syrichta
GLLTFEDVAVFFTQEEWDYLDPAQRSLYKDVMMENYGNLVSLDVLNRDKDDEPTVKQEIEEIEEEVEPQGVIVTRIKSEID

SEQ ID NO: 13806 - protein, 81 aa, Mustela putorius
MNKYQGPVTFKDVTVEFSREEWQLMNDAQRTLYREVMQENYGLLVSVGYRVNKSNSVFKLKQGKEPWILEVEFPHRNYPGE

SEQ ID NO: 13807 - protein, 81 aa, Mustela putorius
FKEAVTFKDVAVAFTEEELGLLDSAQRKLYQDVMLENFRNLVSVGHQPFKRDKWLTEREERRPWLTKTAPQIERNVGGNSQ

SEQ ID NO: 13808 - protein, 81 aa, Mustela putorius
QGQLAFRDVAVELSQEEWGRLTHTQRQLYRDVMLENYGHLCFLGLNVSKPGLITFLEQEKQLWDMKRKETKGFHPAVSSHD

SEQ ID NO: 13809 - protein, 81 aa, Mustela putorius
PQAKVTFEDVAVLLSQEEWDRLGPAQRGLYRHVMMETYGNVVSLGLPGSKPSVISQLERGEEPWVLDGHGAEETRGLGSGR

SEQ ID NO: 13810 - protein, 81 aa, Mustela putorius
HGSTAFSSVTVAFTQDGWRHLVPAPRGTPRFKEGLPENARNLVLLGLPVSQPSVNSELDQREDGPRAPQGGGLRSACPDWK

SEQ ID NO: 13811 - protein, 81 aa, Tupaia chinensis
MAPAQKTLYRDVMLENYSHLISVGYCITKPRVIFKLEQGEEPWSLEEKLLNQKYSGYLTVDVHIKGKQEKREKPLWQVILI

SEQ ID NO: 13812 - protein, 81 aa, Tupaia chinensis
SQELVTFEDVAVYFIRKEWKRLEPAQRDLYRDVMLENYGNVFSLDGETRTQNDREISEDSGSHGVLLGRFQKDISQGLKFE

SEQ ID NO: 13813 - protein, 81 aa, Tupaia chinensis
SLRSVSLKDVTVDFSHEEWQQLDLAQRILYWDVMLENYFNLISVGCHVPKLQVIFNLEQGQESCVLDGSILANQSCPGGDF

SEQ ID NO: 13814 - protein, 81 aa, Tupaia chinensis
SQDPVKDVHMMGGFSYKKNVHQIPAHRDFYQDIRKENIGNMISLGSTVSTSNKMVRLEQRKEPWAIGLHSSNKRNVLRSSY

SEQ ID NO: 13815 - protein, 81 aa, Vicugna pacos
FQGSVTFRDVAIAFSQQEWESLDSAQRDLYRDVMLENYSNVVSLGHSRSKPHVITLLEQCKEPWMVVKKDQRRQYTDFQPK

SEQ ID NO: 13816 - protein, 81 aa, Vicugna pacos
RPRAVKFADVAVYFSPEEWECLRPAQRALYRDVMQETYGHLGALGCAGPKPALISWLERNTNDWELAALDPQECPRQMTVQ

SEQ ID NO: 13817 - protein, 81 aa, Vicugna pacos
SQLTFEDVAIEFSQEEWECLDAAQRALYRDVMLETCRNLLSLDTSEVHVIKKLQLKASTERGELFQTAMLAGHERNKIKHF

SEQ ID NO: 13818 - protein, 81 aa, Vicugna pacos
CQGSFSFKDVAVGFTRKEWQQLNDSQKTLYREVMLENYSHLVSVGCQVTKPAVISRLERGQEPWMKEEEMLRWSSPVLQVD

SEQ ID NO: 13819 - protein, 81 aa, Vicugna pacos
LQEPVTFRDVAVDFTQEEWGQLGPAQRTLYRDVMLETFGHLLSVGPELPKPEVISQLEQGAELWVAERELAQGCCPGWEPG

SEQ ID NO: 13820 - protein, 81 aa, Vicugna pacos
AHGSVTFRDVAIDFSQEEWEFLDSAQRDLYRDVMWENYSNFISLGLESRYRTSILSSEKDIYEICSFQWELMERIKSCSLQ

SEQ ID NO: 13821 - protein, 81 aa, Vicugna pacos
SQHLVTFEDVAVNFTQEEWTLLDQTQRDLYRDVMLENYQNLMALGSESCKPHVNSPLEGAEELRTRARRILQKSDLQLKTK

SEQ ID NO: 13822 - protein, 81 aa, Odobenus rosmarus
ALLTFKDVVVTFTQEEWELLDLPQRTLYWKSSVLRVPGGGTLGLECLLRESRWGWECGPPWSRPAWGLARWEWTKLEGPGR

SEQ ID NO: 13823 - protein, 81 aa, Delphinapterus leucas
FEESVTFEDVAIYFSENEWTGLTPAQRALYRDVMLEDYGAVASLAAFPFPKPALIFQLERSTMELGSSGSSGWRGPEGHLL

SEQ ID NO: 13824 - protein, 81 aa, Delphinapterus leucas
MSLSFRDVAIDLSQEEWECLDPVQRALYRDVMLENYSNLVSLGCSSPKPDVITLLEQEKEPWTVMKEGTRSWYTDLESKYV

SEQ ID NO: 13825 - protein, 81 aa, Tupaia chinensis
EVTFEDVAVLLSWEEWAHLGPAQRGLYRDVMLENYRNLISVGAGPASPKPGVISQLERGDEPWVLDEQGTKGGEQLRVTSP

SEQ ID NO: 13826 - protein, 81 aa, Vicugna pacos
QGSLTFEDVAIEFSQEEWECLDPAQRILYRDVMLETCRNLLSLDIFHIHVMKKLQPKMNSDREVFQTVRLGRHESHEMKDF

SEQ ID NO: 13827 - protein, 81 aa, Vicugna pacos
SGLSNSKPAVISLLEQGKEPWMVDRELTRGLCSDLESMCETKLLSLKKRHFSQVIFTHEDIPTFIQPTFLIPHQKTIHEEK

SEQ ID NO: 13828 - protein, 81 aa, Vicugna pacos
LQNSITFEDVAMDFTQEEWTLLNSSQRKLYRDVMLENYRNLAWLGHQLSKPPLITQMEQEDDMEAAERRTHQDSCPGEMIL

SEQ ID NO: 13829 - protein, 81 aa, Vicugna pacos
FQEAVTFKDVAVVFTEEELGLLDSAQRELYQDVMLENFRNLVSVGHLPFKPDMVSQLEAEEELWMTERETQRNGCSGNRNQ

SEQ ID NO: 13830 - protein, 81 aa, Vicugna pacos
RDPPQCSVTLEDIAVHFSWDEWRLLDETQRRLYLDVMLENFALISSLGCCCGPGDAEAPFEWTVSLGGSQARTPKAALSSQ

SEQ ID NO: 13831 - protein, 81 aa, Odobenus rosmarus
KPGAVSFADVAVYFSPEEWGCLRPAQRALYRDVMRETYGHLGALGFPGPKPALISWMEQESEAWSPAAQDPEEGESLGGAL

SEQ ID NO: 13832 - protein, 81 aa, Odobenus rosmarus
FLLGLLTFRDVAIEFSQEEWGCLNHTQRELYRDVMLENYGHLLFLGLIVSKPDLVSFLEQKKEPWDVKRKKTVAIHRGRWE

SEQ ID NO: 13833 - protein, 81 aa, Odobenus rosmarus
FQGSVTFRDVAIDFSQEEWEWLQPAQRDLYRHVMLENYGHLVSLAGLDISKPYVVSLLEQGREPWLVKGDVRRDPFSESND

SEQ ID NO: 13834 - protein, 81 aa, Odobenus rosmarus
MAMYLTREEWRPLDPTQRDLYRDVMQENYGNVVSLDFEIRSENEVNPKQEISEDVEFGTASERPVENTEENPENEEAFESG

SEQ ID NO: 13835 - protein, 81 aa, Odobenus rosmarus
IEGSLTFGDVAVALTQFEWKHLDATQQALYRDVMLENYGNLVSVGLLSSKPKLITQLEQGVEPWMEVQQIPSDTCSVQEYW

SEQ ID NO: 13836 - protein, 81 aa, Delphinapterus leucas
RPRAVKFGDVAVYFSPEEWECLRPAQRALYRDVMQETYGHLGALGCAGPKPALISWLERNTDDWEPAALDPQECPRRVTVQ

SEQ ID NO: 13837 - protein, 81 aa, Delphinapterus leucas
QESVTFKDVAVDFTLEEWGQLGPGQRELYRDVMLENYQNLLSLGAGLPGSKPDVICRLERGEEPRMERREAWRVTCSDLET

SEQ ID NO: 13838 - protein, 81 aa, Delphinapterus leucas
KSQGSLSFKDVAVVFTWEEWQLLDRVQKNLYQDVMLENYINLVSVAYQVTKTDAFYRLEQETPWIIEEESQSQIHPEDTWQ

SEQ ID NO: 13839 - protein, 81 aa, Delphinapterus leucas
PHWLVTFRDVAINFSQEEWECLDPIQRDLYREVMVENYSHLISLAGCSIPKPDVFSLLERGKEPWMVVRAMTRWSSDLEYS

SEQ ID NO: 13840 - protein, 81 aa, Delphinapterus leucas
VKESVTFKDVAIDFTLEEWRLMDPTQRKLHKDVMLENYRNLVSLGLAVSKPDMISHLEDGKGPWVVVRETSKTPYSELETK

SEQ ID NO: 13841 - protein, 81 aa, Erinaceus europaeus
MSGCQELLTFRDVAIEFSQEEWESLHQTQQNLYWDVMLENYRNLVSLGLTIFKPDLVTFLEEKKEPWNVEKNDKVTIYPGR

SEQ ID NO: 13842 - protein, 81 aa, Ornithorhynchus anatinus
NFWILRLPPATNGEVPKELGNLDQGQKELYKNATKGNYETLVSLDYAISKPDLLTQMERGEEPCGRDQPGAVEAGIPPHPA

SEQ ID NO: 13843 - protein, 81 aa, Carlito syrichta
ASAFVSFEDVAVIFTEEEWEHLDLAQRTLYQEVMLDTCRLLVSLGHPVPNPELLCLLEHRQELWMVKRGLYQSTYAGEKAK

SEQ ID NO: 13844 - protein, 81 aa, Delphinapterus leucas
RVTFEDVAVYFSQEEWGLLDKTQRLLYRSVMLEIFSLMASLGCWCGAEAEDVAPEQGVYVEGVLRANLHQHQKLSSGEKPS

SEQ ID NO: 13845 - protein, 81 aa, Carlito syrichta
SRELVMFKDVAIEISQEEWECLNSAQRNLYKDVMLENYSNLVSLGLSISKPAVISSLEQGKEPWIVMREETGRWYPDLASR

SEQ ID NO: 13846 - protein, 81 aa, Delphinapterus leucas
SQESVTFKDVAVDFTQEEWALLDTSQRKLFRDVMLENISHLVSVGNQLYKSDVISHLEQGEQLSREELGFLQGQSPGREDD

SEQ ID NO: 13847 - protein, 81 aa, Carlito syrichta
MVLFQISFEDVAVDFTLEEWQLLNPLQKNLYRDVMLENYTNLVFLGHQITIPDAICKLEQEEPWIIDQKLLCQNFSELWLH

SEQ ID NO: 13848 - protein, 81 aa, Delphinapterus leucas
GQLTFEDLAIEFTQEEWECLDPAQRALYRDVMSETYRNLLSLDISHIHVIKKLQLKANTDRGEVFQTLMFQRHNWNEMKHF

SEQ ID NO: 13849 - protein, 81 aa, Carlito syrichta
RSQELLTFQDVAVDFTREEWAQLYPAQKNLYRDVMLENYRNLVALGHQLCKPEVITQLEQEEQWMIERDSPLDTHPDGENR

SEQ ID NO: 13850 - protein, 81 aa, Erinaceus europaeus
AQVSVTFEDVAVLFSREEWRKLGPSQRDLYQDVMLENYSNLVSLGLLFSKPKVISLLQQGEDPWKVEKGGPGSSCLGWKSS

SEQ ID NO: 13851 - protein, 81 aa, Erinaceus europaeus
VTYEDVAVIFTQEEWALLNPSEKKLYRDVMGENLRNFLSIEKIQELSTKKQHYLHRSQQRISYIHSNQKYERIHSGKKPYG

SEQ ID NO: 13852 - protein, 81 aa, Erinaceus europaeus
QPLESVTFEDVAIDFTQEEWALLNISQKSLFRDVMLENISHLVSMGYQHSKSDVLLHLEQEDLWSEVSRFLQGQSLGRENA

SEQ ID NO: 13853 - protein, 81 aa, Ornithorhynchus anatinus
PVTFADVAVRFSQEELERLSPEQRQLYGDVIWENYKNAVSLGEDLAFRGAAAAAGLETPQRRGRGGLRISTAPFHPSPATS

SEQ ID NO: 13854 - protein, 81 aa, Carlito syrichta
EMGLLSFKDVAIEFSAEEWACLNSPQRILYRTVMLENHRNLVFLGLAISKPDLIICLEQRKEPWDVKRHGTLAKFPAVTSH

SEQ ID NO: 13855 - protein, 81 aa, Carlito syrichta
QISFEDVAVDFTLEEWQLLNPLQKNLYRDVMLENYTNLVFLELWLHNNSKMQPQDYQDKLKSMERGYEYVFEKILNSSINF

SEQ ID NO: 13856 - protein, 81 aa, Ornithorhynchus anatinus
PKVPVTFDDVAVYFSEQEWGNLDRGQKELYKNVMKGNYETLVSLDYAVSKPDFLSRIEQGEEPCVQSLGAEEDGSAGDPNP

SEQ ID NO: 13857 - protein, 81 aa, Cervus elaphus
VFDAVTFTDVAVDFSQDEWERLTLAQRTLYKKVMLENYSNLASLGLCISKPDVISSLEQDKEPWTMKGELTRGPCADLEYV

SEQ ID NO: 13858 - protein, 81 aa, Cervus elaphus
MAHGPITFRDVVTQFFPHEWEFDPLQKKPYQDRMMENYSNLASQGHSIPQPDITVLLEQGKDPWMVVGEETRRWNTNLNSS

SEQ ID NO: 13859 - protein, 81 aa, Cervus elaphus
LQESLTFKDVAVNFTQEEWHHVDAAQRRLYRDVMLENYSHLVSLGYQVSKPEVIFKLEQGEEPWIAEGEIQRPVCPDWKTR

SEQ ID NO: 13860 - protein, 81 aa, Colobus angolensis
EMGPLTFRDVAIEFSLEEWQCLDTAQRNLYRKVMFENYRNLVFLGITVSKPHLITCLEQGKEPWNRKRQEMVAKPPVINSH

SEQ ID NO: 13861 - protein, 81 aa, Colobus angolensis
VASEDVAVNFTLEEWALLDPSQKKLYRDVMRETFRNLACVGKKWEDQSIEDWYKNQGRILSNHMEEGLSESKEYDQCGEAF

SEQ ID NO: 13862 - protein, 81 aa, Colobus angolensis
VQEPVTFKDVAVDFTQEEWGQLDLVQRTLYRDVMLETYGHLLSVGNQIAKPEVISLLEQGEEPWSVEQACPQHTCPEWMRN

SEQ ID NO: 13863 - protein, 81 aa, Colobus angolensis
AHGSVTFRDVAIDFSQEEWEFLDPAQRDLYRDVMWENYSNFISLGPSISKPDVITLLDEEGKEPGMVVREGTRRYCPDLES

SEQ ID NO: 13864 - protein, 81 aa, Colobus angolensis
KVPVTFVDIAVYFSEDEWKNLDEWQKELYNNLVKENYKTLMSLDAEGPVPKPDAPAQPEPREEPCVWEQRHPEEREISMDP

SEQ ID NO: 13865 - protein, 81 aa, Colobus angolensis
TGENVTFSDVAIDFSHEEWGWLDSAQRDLYKDVMVQNYENLVSVAGLSVTKPYVIMLLEDGKEPWMVEKKLSKGMIPDWES

SEQ ID NO: 13866 - protein, 81 aa, Colobus angolensis
AAVSLTFEDVAVLFTRDEWRKLAPSQRNLYRDVMLENYRNLVSLGLPFTKPKVISLLQQGEDPWKVEKDSSGDSSLGSKSS

SEQ ID NO: 13867 - protein, 81 aa, Colobus angolensis
PRLPLTFEDVAIYFSEQEWQDLEAWQKELYKHVMRSNYETLVSLDDGLPKPELISWIEHGGEPFRNWRESQKSGNIICSSG

SEQ ID NO: 13868 - protein, 81 aa, Colobus angolensis
SQASVSFQDVTVEFSQEEWQHLGPVERTLYRDVMLENYSHLISVGYCITKPKVISKLEQGEEPWSLEDEFLNQKYQGYFKV

SEQ ID NO: 13869 - protein, 81 aa, Colobus angolensis
MVEGEEEWQQLNPAQKTLHRDVMLETYSHLVSVGCSGIKPDVIFKLEHGKDPWIIESELSRWIYSDRVKGLESSQQIISGE

SEQ ID NO: 13870 - protein, 81 aa, Carlito syrichta
VQGSLSFEDVAVYFTREEWQFLDATQKVLYKEVMLENYGNLVSVGYQGTKPDSLFHLEQGEHPWRMEGAAHSRKCPGFVIL

SEQ ID NO: 13871 - protein, 81 aa, Ornithorhynchus anatinus
GRVEVTFKDVAIFLTQQEWESLADAQRELYTTVMLENYGHLQSLGKDTESLPHCIRQLEKGKDPVHTGERPFRCPECQKNF

SEQ ID NO: 13872 - protein, 81 aa, Desulfobacca acetoxidans
GVFVFLDEAFIDFVEEASLKTSLRRFPRLLILRSFTKFFAIPGLRLGYLLAAPELIARLAALQEPWSVNTLAQAVGRACLQ

SEQ ID NO: 13873 - protein, 81 aa, unidentified
  REGION 1..81: note = candidate division WOR-3 bacterium
MRVIIVENYDSMSRLAAKFVKEELVRKPDLVLGLATGSTPLGLYKELIRMHKEEGLDFSKVTTFNLDEYVGLPKNHPESYH

SEQ ID NO: 13874 - protein, 81 aa, Acidimicrobiaceae bacterium
RGLVGEILARFERRTLKIVAAELRTITPELAAKHYEEHVGKGFYDELVSFIGRSPSLVFVLEGPEDTWKVVRDMMGATNPR

SEQ ID NO: 13875 - protein, 81 aa, Armatimonadetes bacterium
CRVWIDETYVDFAPEGWCCEAIAARDRRVVVAKSMSKFYALSGLRVGYLVANPEWIASLEPMSPPWSVGLVAQVAAVEALR

SEQ ID NO: 13876 - protein, 81 aa, Cellulomonas gilvus
SGNHFIEVSVDETGGVWLFLHSGSRGVGNKIAQHHIKVATELCRRWWIALPDPDLAYLVEGTEEFWAYVRQLRWAQHFALL

SEQ ID NO: 13877 - protein, 81 aa, Chelonia mydas
MPVTFEDVAVYFSEGQGALLDPGQRALYRDVMQENYETVTSLGLSIPKPDLIARLEAGEELWVPDLQDPKESNIQRGSRTG

SEQ ID NO: 13878 - protein, 81 aa, Chelonia mydas
REPVTFEEVAVYFTQGQGPLLDPGPRALYRDVMQENYEMVTSLGGAGMVSQNEEENPQREGGEDMGLQGTVLGRSEGNFYQ

SEQ ID NO: 13879 - protein, 81 aa, Chelonia mydas
VTFEEVAVYFSEEEWALLDPGQRALYRDVMQENYETVTLLGTDSCLDSLSVPAGDGTVSETEEENPEQEGPERVEPQGTVL

SEQ ID NO: 13880 - protein, 81 aa, Platysternon megacephalum
FQALVAFEEVAVYFSREEWGLLDEGQRQLYRDVMQENYQTLISLGVPVPDPAAISWMERGEEPGVPDLQGSEEREIMRGTG

SEQ ID NO: 13881 - protein, 81 aa, Chelonia mydas
FQMLVTFEEVAMYFTEGQAALLDPSQRALYREVMQENYEMVTSLGFPIPKPDLIARLERGEEPWVPDLQADKERESPRDTH

SEQ ID NO: 13882 - protein, 81 aa, Platysternon megacephalum
FQMPVMFEEVAVYFSEDEWALLDEKQKELYRDVMQENYERLISLGFLIAKPDVLSQMERGEEPWFPDLQGSEEREIPRGTS

SEQ ID NO: 13883 - protein, 81 aa, Chelonia mydas
YSMSLTFEDVAMYFSPAEWALLGEEQRQLYKHVMWENYQTLVSLGIQTPKPVVISSIERGEELCVQGPTEDEDEDVLSGTR

SEQ ID NO: 13884 - protein, 81 aa, Chelonia mydas
QMPVTFEEVAVYFTEGQGALLDPAQRALYRDVMQENHETVTSLAGDRTVSENKEENQQQEGPEQVEPQERFLRKADGNFSQ

SEQ ID NO: 13885 - protein, 81 aa, Micrurus surinamensis
LVSFKEVAVYFSEHEWSQLDSDQKALHSEVMVENHRNVVSLGNNMQENQDSCELFQVINAKDGTEKFVIRMEFKSHERNLS

SEQ ID NO: 13886 - protein, 81 aa, Micrurus surinamensis
FDHVEEVALDFTEEEWRLLDSGQKALCWEVMREVFRNMAALDDGPANENDKSAKLTLQQLEKNEVEVMFGTQGDITRQERS

SEQ ID NO: 13887 - protein, 81 aa, Micrurus surinamensis
ATSQSLVSFEEVAVYFTEDEWELLDPSQKALYGEVMLENSRNVAALAYGQEHENNKKPSMVVFQMIKSEKDVLQNQEPSQR

SEQ ID NO: 13888 - protein, 81 aa, Chelonia mydas
AQMLVTFEEVAVYFTQGQGALLGPAQRALYRDVMQENYEMVTSLGFSLPKPELISRLERGEEPWVPDLQACEKRESLRGAR

SEQ ID NO: 13889 - protein, 81 aa, Chelonia mydas
LQVPVTFEDVAVYFSPEEWAALEEWQRELYRDVMMENYELVASLGSVGPKPKASARKAKREKAPYVWDHQYSRAKVLVLPA

SEQ ID NO: 13890 - protein, 81 aa, Chelonia mydas
PKVPLAFENDAVYFSEQEWQNLEEWQKELYKNVMKGNYESLISLDYALSKPDLLARIERGEAPCEGEEGDAEERGIPAEPS

SEQ ID NO: 13891 - protein, 81 aa, Ficedula albicollis
LQIPVLFEDVAVRFSQQEWASLDEGQKEMYRSVMEGNYEMLVSLYCALYKPELLLQLEREELSTPPESEPEAAEVSPELTV

SEQ ID NO: 13892 - protein, 81 aa, Chelonia mydas
MSVTFEDVAVYFTEEQGTLLDPSQRALYRDIMQENYEMVISMAGLLIPKPDLIARLERGEEPWVPDLQASEERKIPRGTHT

SEQ ID NO: 13893 - protein, 81 aa, Chelonia mydas
PAQGLVAFEEVAVYFTREEGALLDPAQRALYRDVMQENYENVTSLGERPYECSECGKQFSERSSLNKHQTSHTEERPYECC

SEQ ID NO: 13894 - protein, 81 aa, Chelonia mydas
PKVPVTFNNNSFNFSEQEWKSLDEWQKELYRHIMKGNYEAVISLDAAISKPDLLSRIERGEEPSVGDQSDSEERQIPADPG

SEQ ID NO: 13895 - protein, 81 aa, Pterocles gutturalis
VPKVPTSEGEATCFSAHKRENLEEWQRELYRNVLRAKNEPLISLDDAIAKPDLLSWLQRGESPGSGDKVASGEVPAEPTDC

SEQ ID NO: 13896 - protein, 81 aa, Chelonia mydas
AQGPLTFEEVAVYFTREEGSLLDPTQRALYRDVMQENYETVVLLGDGMVSENKDEKPQQKYAEQVEPHRKLSGRSKGKVSG

SEQ ID NO: 13897 - protein, 81 aa, Chelonia mydas
AAGLVTFEEVAVYFTQGEWALLDPTQRALYRDVMQENYETVVFLGFLVSKPDVISQLERGEELWVPDLQGSEKEVLPRAAC

SEQ ID NO: 13898 - protein, 81 aa, Chelonia mydas
PKVPVKFDEVSGCFSGQEWGVLEQRREELHKNTMRNNYETLISLGSPISTPSDSSWIKQEETPCAESQGGLVEREIPTDPI

SEQ ID NO: 13899 - protein, 81 aa, Chelonia mydas
MYFSPVEWVLLGEEQRQLYRHVMWENYQTLVSLGIQTPKPVVISNIERGEELCVQGPTEDDEDVLSGTCPGEEGVKVLSRE

SEQ ID NO: 13900 - protein, 81 aa, Chelonia mydas
PEVPVQFKDVAVTLAEAEWLLLDEEQRQLYGTVMQETYRSISSLGCPVRKPALISQLERGEEPCIPDPPAPEEQETQRDVP

SEQ ID NO: 13901 - protein, 81 aa, Chelonia mydas
MEPWVMLDPRQRALYRDVMQESYETLMSLAADGLVSDNEEEDAEEEEEEEEEEGSEELEPRTSQNPEWEKSPAGSDEQKKA

SEQ ID NO: 13902 - protein, 81 aa, Charadrius vociferus
PKAPAAFESDAADFSAQEWENLEDWQRELYKNVLRGKNESLISLDYAISKPDLLSRLQREVPCNGDKAASREIPAEPNYSV

SEQ ID NO: 13903 - protein, 81 aa, Chelonia mydas
PGIPATFEEVAVYFTKEEGALLDPTPRALYRDVMQENYETVVRQGDGMVSEEDAEQVEPHGMLSGISKGNVSGSCALPEKA

SEQ ID NO: 13904 - protein, 81 aa, Chelonia mydas
MLVTFKEVAVYFTQGQGALLDAGQRALYRDVMQEIYETVTSLAGSDRSSGNRSAVASGTPPQREAEVVSTGERRPSIPRHE

SEQ ID NO: 13905 - protein, 81 aa, Chelonia mydas
QEPVAFEEVVVYFAREEWALLDPAQRDLYWDIMQENYENVTSLGFPVSKPEVMSQLKQGEELWISDLQSSGEREILRGTCP

SEQ ID NO: 13906 - protein, 81 aa, Chelonia mydas
MGAFPIPKPEVISQLERGEEPRVTELWGYVERELFKNTCTGDGLVGENKEKNPGQEGPEQVELQGTLQGRCEVEVSQSPDK

SEQ ID NO: 13907 - protein, 81 aa, Chelonia mydas
MPVTFEEVAVYFTQGQGALLDPAQRALYRDVMQENYETVTSLGFPIPKPELIAQLERGEEPWVPDLQASEKKEVPRVTHTA

SEQ ID NO: 13908 - protein, 81 aa, Chelonia mydas
QGSVTFEEVAVYFTKEEWSLLDPAQRALYRDVMQENYENVTSLELGSWRVAAVGQVPSSEGSPLPAAAQKAEILDSSHCSP

SEQ ID NO: 13909 - protein, 81 aa, Chelonia mydas
GGLRVAFEDVALYFSREEWELLSRPEKQLYRDQMLRNYRALVSLGYSGSTPDLIHRIEVGEAELWIQDVEDSRENSGPESP

SEQ ID NO: 13910 - protein, 81 aa, Chelonia mydas
GEVPKVPVTFDDVSVYFNEKEWEKLDEWQKELYKNVMKGNYESLVSLDDGIVIKTEEEDDPDTLEPYAMFSGRAEQQIFQN

SEQ ID NO: 13911 - protein, 81 aa, unidentified
  REGION 1..81: note = Halomonas sp. BC04
VTVVVDEAFIDFVDEPGAALTSLLPRFDNLVLLRSLTKLYTLPGLRLGYLLADAETVRRLQAGQPPWSVNHLSAALVAPLL

SEQ ID NO: 13912 - protein, 81 aa, Thalassotalea sp. 42_200_T64
GSVKGQYKTAMIYLTNEEYKDLDKGVKYLKKAARSKNVDAAFLLGVIYYKPDFYERDLEEADKWLAKAYVWRHKKINAFIE

SEQ ID NO: 13913 - protein, 81 aa, Streptomyces sp. SID11726
VDEAFADITLDPGTRQGEPASIADRRADDMAVIRSVTKTFGLAGLRAGYLLAAPDVIARLTVGRRPWPLGTLALTALAECV

SEQ ID NO: 13914 - protein, 81 aa, Acidimicrobiaceae bacterium
RGLVGEIIGRFERKGLRIVAAELRTLDRDVLDRHYAEHVGKGFYDDLVAFMGRGPVVVAVVEGPEDTWSVVRQMMGATNPM

SEQ ID NO: 13915 - protein, 81 aa, Acidobacteria bacterium
CLALVIAIVFNYLAAFWIKLPTKHTAIYRRIGPETGPQVFCAGSSLLQFALSWPEVSEILDQGIESWGMAASTPSEWEVFQ

SEQ ID NO: 13916 - protein, 81 aa, Bacteroidetes bacterium GWA2 30 7
NVTFEQIALEFSPEIAKGVLALTKNESLEKELQLEDSVNRILLEPKEIWIVKMADRITNLQKPPDSWTFEKKESYKKEAIM

SEQ ID NO: 13917 - protein, 81 aa, Magnetospirillum kuznetsovii
RLPTGTLDRLVAFTAEELAALEAATRLFERDNREDEAAELATLGAKLRALLKPEVARRVEPDLEALLEAEGLAMRPGPRPR

SEQ ID NO: 13918 - protein, 81 aa, Actinobacteria bacterium
HTGPFRIIEYFTNRWNDEVTIYDMEKHFHMSSEELRDVSQSSLYRHLRLLKGKGIIRNNSPTWSLAPKYRDYFERYKENWS

SEQ ID NO: 13919 - protein, 81 aa, Leptotrombidium deliense
CPLEPLTLRDVTIDFSEEEWECLDPAQQTLYRDVMSEIYRNLIFLVQISAHNLEIEYTSVEVEWSVRKKNWKNNCLESSKI

SEQ ID NO: 13920 - protein, 81 aa, Loxodonta africana
QESVTFKDVAVDFTQEEWHHMDPTQRILYRDVMLETYSHLVSLGYQVSKPEVIFKLEQGEEPWISEEEIQRPFCPDWEIRP

SEQ ID NO: 13921 - protein, 81 aa, Loxodonta africana
LQGTVTFRDVAIDFTQEEWQQLDPAQRNLYRNVMLENYNNLITVGCPFTKPDVIFKLEQEEEPWVVEKEVLRRHCPGEVWG

SEQ ID NO: 13922 - protein, 81 aa, Capra hircus
EAVTFGDVAVHFSREEWQCLDPGQRALYKEVMLENHSSVAGLAGFLVFKPELISRLEQGQDPWVLDLQGAEGREAARTTRT

SEQ ID NO: 13923 - protein, 81 aa, Capra hircus
VTFEDVFVSFSQEEWGLLDETQRLLYREVMLENFALMASLGCWHGMEEDEIRFEQSISVNRVSKGMIPKMIPSSQKAHPCE

SEQ ID NO: 13924 - protein, 81 aa, Capra hircus
MASPSPPPQPKEEWDYLDPAQRSLYKDVMMENYGNLVSLDVLNRDKDEEPTVKQEIEEIEEEMEPQGIIVTRIKSEIDQDP

SEQ ID NO: 13925 - protein, 81 aa, Capra hircus
LQNSITFEDVAINFTQKEWALLNSSQRMLYKDVMLENYRNLASLGHQLCKPPLITHLEQEDEMKIVERRIHQDTCSYEIIL

SEQ ID NO: 13926 - protein, 81 aa, Capra hircus
MDPVAFEDVAVNFTLEEWALLGPSQKKLYRDVMRETLSNLALIRDKWEDHNTEDQYRIQERNLRCHMLQRLCESKEGSQCG

SEQ ID NO: 13927 - protein, 81 aa, Chlorocebus sabaeus
MGPLQFRDVAIEFSLEEWHCLDTAQRNLYRDVMLENYRNLVFLDLITCLEQGKKPLTMKRHEMIAKPPDVWSEQSIKDSFQ

SEQ ID NO: 13928 - protein, 81 aa, Chlorocebus sabaeus
SQHLVTFEDVAVDFTQEEWTLLDQTQRDLYRDVMLENYKNLIILAGSELCKPSLTSGLEQMEELRTGVTGVLQELDLRLKT

SEQ ID NO: 13929 - protein, 81 aa, Chlorocebus sabaeus
MKPDVIFKLEQGEEPWVGDGEIPSSDSPEVWNVNGNMMWHQDNQDKLKIIKRGHECDAFGKNFNLNMNFVPLRKSNNEGDL

SEQ ID NO: 13930 - protein, 81 aa, Chrysochloris asiatica
VIVEDVAVVFSQEEWALLDLVQRKLYRDVMIETFRNLASVVSHNINSGEKLPSEQVMVRFIKNSTWSSMLEVFKRHVNKDQ

SEQ ID NO: 13931 - protein, 81 aa, Chlorocebus sabaeus
GPLTFRDVAIEFSQEEWKSLDPVQKALYWDVMLENYRNLVFLGILPKCMTKELPPIGNSNTGEKFQTVMLERHECYDIENF

SEQ ID NO: 13932 - protein, 81 aa, Suricata suricatta
MDVAVEFSQEEWGCLNHSQWELYRDVMLETYGHLVFLGLVVSKPDLVIFLEQKRELWDVKRKETVASFPAVFPNETDSLLL

SEQ ID NO: 13933 - protein, 81 aa, Chrysochloris asiatica
QAQDSLTLEDVAVEFTGEEWQLLAPAQKALYRDVMLENYSHLVSVGYIACEQDTLVRLDRGELWTVGGEIHCRTSSEIGKV

SEQ ID NO: 13934 - protein, 81 aa, Suricata suricatta
LVMFKDVAIDVSQEEWECLNPTQRSLYRDVMLENYSNLVSLDLVSRCEAKKLSPKRDIFETESSQWAIVEEFKGHNPEKSI

SEQ ID NO: 13935 - protein, 81 aa, Suricata suricatta
PRSLLTFRDVAIEFSQEEWGCLNHSQWELYKNVMLENFGHLLFLGLVVLRPDLVIFLEQQREVSDMKRKETVASYPVFFFR

SEQ ID NO: 13936 - protein, 81 aa, Suricata suricatta
MDTSERTLYRDVMLENISHLVSVGMKNNHNKEEIIPMQDICTKDPPNCWTVKCHAGEDLCLYSGYDEIFTHAYTLTQHVLN

SEQ ID NO: 13937 - protein, 81 aa, Chrysochloris asiatica
QQEVVTFEDVAVYFTRTEWAGLSPVQRALYRNVMLENYGNLTSLGYLVPKSSLVSLPEAGDLSRNMKSQDDPPAEMTEDIY

SEQ ID NO: 13938 - protein, 81 aa, Suricata suricatta
TQDPVVFEDVAVDFTQEEWALLNLAQRNLYRDVMLENFQNLASLGYPLHIPYLISQWKQEEDLGTVERGTIQGEHQEGFET

SEQ ID NO: 13939 - protein, 81 aa, Chrysochloris asiatica
KRDSVIFEDVAVVFSQEEWALLDFSQRQLYRDVMMETFRNLESAFVDQSSFKHHIRSHTGYKSHHCTECGENCICPSYLKP

SEQ ID NO: 13940 - protein, 81 aa, Chrysochloris asiatica
GQEPVTFKDVAVDFSQEEWGWLDPIQRTLYRDVMLETFGHLLSVGNEITKPEVISLLEQGEEPWTVERDCPASSYPDECDV

SEQ ID NO: 13941 - protein, 81 aa, Chlorocebus sabaeus
ESVTLEDVAVEFIQEWALLNSARRSLCRYGMLDQCRTLTSRGTPPCKPSCVSQLGPRAEPRATERGILHATGVAWESQLKP

SEQ ID NO: 13942 - protein, 81 aa, Chrysochloris asiatica
MFTREEWQLLAPAQKALYRDVMLENYTNLASVATFPESQISSRTRSKKHQLFKHQKREKLHVGSECGEALVKKSFLTDHQI

SEQ ID NO: 13943 - protein, 81 aa, Mandrillus leucophaeus
WPESVTFEDVAVYFTQNQWASLDPAQRALYGEVMLENYANVASLVAFPFPKPALISHLERGEAPWGPDPWDTEIPRGISQG

SEQ ID NO: 13944 - protein, 81 aa, Mandrillus leucophaeus
EMGLLTFRDVAIEFSLEEWQHLDIAQQNLYRNVMLENYRNLAFLGIAVSKPDLITCLEQGKEPWNMTRHEMVDKSPGLYFL

SEQ ID NO: 13945 - protein, 81 aa, Mandrillus leucophaeus
SKGSLMFRDVSIDFSQEEWECLDSGQMNLYKEVMLENFSNLVSVGLSSSKPAVISLLEQGKEPWMVDRELTRGLCSDLESM

SEQ ID NO: 13946 - protein, 81 aa, Mandrillus leucophaeus
MIKTQEYLTLEDVAKDLYQDVMVENYNHLVSLGYQTSKQDALSRLAHGQEPWITDAKIQNKNCPGIRKVDSHLQDVQQCSG

SEQ ID NO: 13947 - protein, 81 aa, Sus scrofa
AQGLMAFEDVAVYFSREEWGLLDTAQRALYRRVTLENFALLASLGLSVSRPRVVTQLERGEEPWVLSGTDVTLARNAQSRP

SEQ ID NO: 13948 - protein, 81 aa, Mandrillus leucophaeus
ACESITFGDVAIDFSHQEWEYLNLVQKTLYQEVMMENYDNLVSLGHFISKPDLITLLEQGKEPWMIVGEETRGECTDLDSR

SEQ ID NO: 13949 - protein, 81 aa, Mandrillus leucophaeus
DSVTFDDVAVDFTQEEWTLLDPTQRSLYSDVMLENYKNLATVGWEMQLETQWSALQQDSLTGQTSIGMQLEGKHNGGELCD

SEQ ID NO: 13950 - protein, 81 aa, Mandrillus leucophaeus
EDSVTFDDVAMEFTPEEWALLDTTEKYLYRDVMLENYMNLASVGKSNITLLEWEIQPRIKGSSLQQGFLKNPIFNGIQMQT

SEQ ID NO: 13951 - protein, 81 aa, Mandrillus leucophaeus
MLENYRNLVFLGIAVSKPDLIIFLEQGKEPWNMKRHEMAEEPPVICSHFAQDLWPEQGIEDSLQKVTLRRYEKCGPQNLQL

SEQ ID NO: 13952 - protein, 81 aa, Mandrillus leucophaeus
EDVAVDFTLEEWALLDSAQRNLYRDVISVSRFEMWERTKTQFKANGSVSQQDMYGEEKSKEQTIPNFTRNNSCAYTLEKTC

SEQ ID NO: 13953 - protein, 81 aa, Mandrillus leucophaeus
GLVTFGDVAVDFSQEEWEWLNPNQRNLYRKVMLENYRNLASLGKGDCISVWTPDVISSLEQGKEPWTVKRKMTRAWCPDLK

SEQ ID NO: 13954 - protein, 81 aa, Sus scrofa
AQESVMFSDVSIDFSQEEWECLNDDQRALYRDVMLENYSNLVSMAGHSISKPDVISFLEQGKEPWLVDRELTRGQWPVLES

SEQ ID NO: 13955 - protein, 81 aa, Sus scrofa
EQGRVVFEDVAISFSQEEWGLLDEAQRRLYHAVMTEILALLTSPGCWHGAQDEEARSEQALSVAVSPARTPEPDPSTRTAR

SEQ ID NO: 13956 - protein, 81 aa, Sus scrofa
VSETSAFRDVFVDFTLEEWQQLDAAQKTLYRDVTLENYSHLLSVGYLVAQPEGIFSLGQAEGAGKADGEAPTRSGPEFWQA

SEQ ID NO: 13957 - protein, 81 aa, Sus scrofa
KVPVTFVDIAVYFSEDEWKNLDEWQKELYHNLVKENYKTLMSLDAEGPVPKPDAPSQAEPSDEPCVWEQRDPEGREILMDP

SEQ ID NO: 13958 - protein, 81 aa, Sus scrofa
RESGKAPVTFDDITVYLLQEEWMLLSQQQKEICGSDKLVAPLEPTLASSELFYKFEQGPEPWLANVQDQRNLLNCHPGKNK

SEQ ID NO: 13959 - protein, 81 aa, Sus scrofa
MMFRDVSINFSQEEWECLDSGQMNLYKEVMLENFSNLVSVGLSNSKPAVITLLEQGKQPWMVDRELTKGLCSDLESMCETQ

SEQ ID NO: 13960 - protein, 81 aa, Sus scrofa
PQEPAEYEFLSVDYTQKKWKGPALSQRALYRNIVPENCHSLASLGENGMECSDLPPKQESSKESEASDRTSGVLYEVIPGG

SEQ ID NO: 13961 - protein, 81 aa, Bos mutus
RSIVTFEDVFIHFTREEWDLLTESQKRLYHKTMVNNFSLVMSVGLESSRYRLISPPEPESAPEVPARIGIAAAVAEVSQES

SEQ ID NO: 13962 - protein, 81 aa, Neophocaena asiaeorientalis
AQEPVTFKDVAVDFTQEEWGQLDPVQRTLYRDVMLETYGHLLSVGNKIAKPEVISLLEQGEEPWSVEQAYPPQGTCPERHT

SEQ ID NO: 13963 - protein, 81 aa, Neophocaena asiaeorientalis
PQGCAISEDVFVYFSREEWVLLDEDQRLLYRDVMLENFALLASLGIASSRSHLVTQLEQGEEPWMPAQVDMTPATEKEAQK

SEQ ID NO: 13964 - protein, 81 aa, Nomascus leucogenys
FQGSVTFRDVAIDFSQEEWKWLQPAQRDLYRCVMLENYGHLVSLGLSISKPDVVSLLEQGKEPWLGKRDVKRDLFSVSESS

SEQ ID NO: 13965 - protein, 81 aa, Nomascus leucogenys
EKGPLTFRDVAIEFSLEEWQCLDTAQQGLYRKVMLENYRNLVFLAGIAVTKPDLITCLEQGKEPWNMKRHEMVAKPPVICS

SEQ ID NO: 13966 - protein, 81 aa, Nomascus leucogenys
PLTFKDVAIEFSQEEWKCLEPVQKALYKDVMLENYRNLVFLGISPKCVIKELPPTENSDTGERFQTVTLERHQSYDIENLY

SEQ ID NO: 13967 - protein, 81 aa, Nomascus leucogenys
WPESVTFEDVAVYFTQNQWASLDPAQRALYREVMLENYANVASLVAFPFPKPALISHLERGEAPWGPDPWDTEIPRGISQG

SEQ ID NO: 13968 - protein, 81 aa, Bos indicus
QAQETLTFDDVAVDFTWEEWQLLAPAQKALYRDVMLENYSNLVSAGFQASTPEVVSKLDQGEPWMMDDETHCQTRSEVWKF

SEQ ID NO: 13969 - protein, 81 aa, Bos indicus
LQGSVSFEDVAVDFTRQEWHTLDLAQRTMHRDVMLENYSNLASVGLCVAKPEMIFKLERGEELWILEEESSDNGYTGSFSL

SEQ ID NO: 13970 - protein, 81 aa, Bos indicus
FQGLVSFKDVAVGFTQEEWQHLDSTQRSLYRDVMLENYRNLVSVGFCITKPEVIFRLEQGEEPWILEEEFLAQSFSEVWKT

SEQ ID NO: 13971 - protein, 81 aa, Bos indicus
MLENYSSLVSLGYEVMKPGVILKLEQGEDPWTGDGEIPSSASIDQVFQVNGHMTWHKDNKKFKNMKQDHECAALGKKFNLS

SEQ ID NO: 13972 - protein, 81 aa, Bos indicus
MLETCSHLLSIGYQVPETKVFMLEQGKEPWALQGEGPYQSCPGEKLRDHNQCGKILNYKQVPSQHQKIHTGVKFYECPEFG

SEQ ID NO: 13973 - protein, 81 aa, Bos indicus
PRVPVTFDDVAVYFSEPEWGKLDEWQKELYKHVMRGNYEMLVSLDYAISKPDILTRMERGEEPCPEGPWGREEGNEREEVC

SEQ ID NO: 13974 - protein, 81 aa, Bos indicus
GKESVMFSDVSIDFSLEEWEFLNLEQRDLYRDVMLENYSNLVSLGCFISKPDVISLLEQGKEPWKVVRKGRRQYPDLETNY

SEQ ID NO: 13975 - protein, 81 aa, Bos indicus
QVSIAFQDLAVRFSEDEWRLLGEGQRALYLDVMRENYDTLASLGTAEPLPLSAFLSPSEPGGAVGARSRAGDRQEPPQGGG

SEQ ID NO: 13976 - protein, 81 aa, Bos indicus
MSQESLTFQDVAVDFTREEWDQLYPAQKNLYRDVMLENYRNLVALGHQLYKPEVITQLEQEEQWMMGRVSPPDTHPDGENR

SEQ ID NO: 13977 - protein, 81 aa, Bos indicus
ASQGWMTFQDVAIDFTQEEWECLDLSQRELYRDVMLENYGNLASLGLVSNLDLVTFLEPLKDPRNIRRMGTTVIYPGVSPQ

SEQ ID NO: 13978 - protein, 81 aa, Bos indicus
QERLTSEDVAIEFTQEEWEFLDPAQRALYRDVMLETYRNLLSVDISPTHVIKHLQLKANSEKLETFQTSMLGRPESCEIKH

SEQ ID NO: 13979 - protein, 81 aa, Canis lupus
ARELVTYEDVAVDFTQEEWQHLDPAQKTLHRDVMLEIYSHLVSVGCSGIKPGIIFKLEHEEDPWIKKSELSRWIHSDREES

SEQ ID NO: 13980 - protein, 81 aa, Bos indicus
MGMAGLISEGFVQRCHVGELQELGLSISKPNMISLLEQGKEPWMVEREMSDGQHADWESWYEIKALSPKWYTDEEEISQGV

SEQ ID NO: 13981 - protein, 81 aa, Capra hircus
MFQVTFSDVAIDFSHEEWRWLNSTQRDLYKDVMVQNYENLVSLGLSIPKPYVIALLEDGREPWMVEEKLSKDMFSDCKSRW

SEQ ID NO: 13982 - protein, 81 aa, Capra hircus
SQESVTFQDVAVDFTEKEWPLLDSTQRKLYKDVMLENYSNLASVGCQMGKPSLISHLEQEEELRTEDRELHRGPCPDWATP

SEQ ID NO: 13983 - protein, 81 aa, Capra hircus
RPRAVKFGDVALYFSREEWGCLRPAQRALYRDVMQETYGHLGALGCAGPKPALISWLERNTDDWETAALDPQECPKGVAVQ

SEQ ID NO: 13984 - protein, 81 aa, Chlorocebus sabaeus
WSQMPVTFEDVALYLSREEWGRLDHTQQNFYRDVLQKRNGLSLGFPFSKPFWAPQAQGKGEASGSSRQTGDEKEEWRGAYS

SEQ ID NO: 13985 - protein, 81 aa, Chrysochloris asiatica
SLEQVSFKDVCVDFTQEEWYLLDPAQKILYRDVILENYSNIVSVGHCGTKPEVIFKIEQGEEPWVLGEGFSSLQHPERNWK

SEQ ID NO: 13986 - protein, 81 aa, Chlorocebus sabaeus
KSLVTFEDVAVYFSQEEWELLDAAQRHLYHSVMLENLELVTSLGCWHGVEGEEAHPKQNISVEEVLLVRIPNADSSTKKAN

SEQ ID NO: 13987 - protein, 81 aa, Chrysochloris asiatica
LLLTFEDIAVYFSEQEWQNLEAWQRDLYKHVMRANYEILASLGGQQAVEAGDSEGHFPPDPGRTPGRPHGHPAARYSREAL

SEQ ID NO: 13988 - protein, 81 aa, Chlorocebus sabaeus
GMEPLQFRDVAIEFSLEEWHCLDTAQQNLYRDVMLENYRNLVFLGIVVSKPDLITRLEQGEKPLTVKRHKMTANPSVMCSH

SEQ ID NO: 13989 - protein, 81 aa, Chlorocebus sabaeus
MGPLQFRDVAIEFSLEEWHCLDTAQRNLYRDVMLENYRNLVFLGIVVSKPDLVTCLEQGKKPMERHEMIAKPPVVSSHFAQ

SEQ ID NO: 13990 - protein, 81 aa, Suricata suricatta
FQESVMFSDVSIDFSQEEWECLNDDQKDLYRDVMLENYSHLVSMAGHSVSKPDVISFLERGKEPWLVGRELTRDQWPVLES

SEQ ID NO: 13991 - protein, 81 aa, Chrysochloris asiatica
LFTFKDVAVEFSQEEWDCLAPAQRALYRDVMLENYRNLVSLDFFSKSLMKELPPKEIVSKGELFQRMMLERHESHDTEGVY

SEQ ID NO: 13992 - protein, 81 aa, Chrysochloris asiatica
RPTGLLTLRDVIIEFSQEEWDCLNLPQKALYRDVMLENYRNLVSLGVSSRCMLKELLPDENITKGELFQTMIISPDVNFNI

SEQ ID NO: 13993 - protein, 81 aa, Chlorocebus sabaeus
QESLTLEDVAVEFSWEEWQLLDTAQKNLYRDVMVENYNHLVSLGTGYQTSKPDVLSKWAHGQEPWITVAKIQNKNCPGIGK

SEQ ID NO: 13994 - protein, 81 aa, Chrysochloris asiatica
TQDSLTLEDVAVEFTGEEWELLAPAQKALYRDVMLENYSHLVSVGYQVPQPDALSRLARGELPCSMPDSSHSQDYSEFQNV

SEQ ID NO: 13995 - protein, 81 aa, Suricata suricatta
LQGPLSFEDVAVTFTQEEWQQLDLAQRTLYRDVMLENFSHVVSLGHPVSTPDVISKLEQGEEPWIIKRDVSERETRLDNPQ

SEQ ID NO: 13996 - protein, 81 aa, Chlorocebus sabaeus
HRGPLTFMDVAIEFSLKEWQCLDTAQQNLYRDVMLENYRNLVFLGIASSKPDLITYLEQGKEPWNMKRHETVAKPLVMCSY

SEQ ID NO: 13997 - protein, 81 aa, Suricata suricatta
GNQESLTLEDVAVDFSREEWQLLAPAQKDLYRDVMLENYRNLVSLGYHASKPDALSKLEQGELWTIEDAINSRIRPEIRKV

SEQ ID NO: 13998 - protein, 81 aa, Suricata suricatta
MSKDLVTFGDVAIDFSKEEWEWLNPAQRNLYKKVMLENYRNLVSLGVSVSKPDVISLLEHGKEPWMVKEGTRGTYPDWEYA

SEQ ID NO: 13999 - protein, 81 aa, Suricata suricatta
PQEPVTFEDVAVYFTRNQWAILDLAQRALYREVMLENYTNVASLVAFPFPKPPLVSRLERGDAAWGPDPWQAEVLRGLRPG

SEQ ID NO: 14000 - protein, 81 aa, Chlorocebus sabaeus
FQEQVTFEDVVVDFSQEEWGQLKPAQRTLYRDVMLDTFRLLVSVVGHWLPKPNVISLLEQEAEPRAVDSGVPPGVYPDLET

SEQ ID NO: 14001 - protein, 81 aa, Suricata suricatta
MYFTNFSNVLKPNFSLSGCHMTKPDVILKLERGEEPWTSFTGHTCLEENWKDEDFLVKFKENQDKFCRSVVFINHKKLIKE

SEQ ID NO: 14002 - protein, 81 aa, Chrysochloris asiatica
EGPVVFEDVAVDFSLEEWALLGPAQRKLYRDVMLETFRNLASVDDETPLKASGPVSQQDAHQEQISQEDNVQKSTRNASWS

SEQ ID NO: 14003 - protein, 81 aa, Chlorocebus sabaeus
MYKQEMKTNYQTLDSLGYAFSKPDLITWMEQGRMLFISEQGCLDKTRRTTSPPTDEQLDMKDTGKLPCFDHEGTLRTKEED

SEQ ID NO: 14004 - protein, 81 aa, Sus scrofa
AQGSLTLEDVAVDFTWEEWQLLTPDQKDLYQDVMLENYGNLVAVGHQVSKLGVLSKLEQREPPPTLEDAVHSHPHPETEKV

SEQ ID NO: 14005 - protein, 81 aa, Mandrillus leucophaeus
TNGPLTFRDVAIEFSLEEWQCLDTAQQGLYRKVMLENYRNLVFLAGIAVTKPDLITCLEQGKEPWNIKRHEMVAKPSVICS

SEQ ID NO: 14006 - protein, 81 aa, Sus scrofa
LQGLVTFEDVAVYFSLEEWERLDSEQRELYKEVMQENYGILVSLGYPIPKPDLISRLEQGEEPWVPDSPRPEDGDIVTGVY

SEQ ID NO: 14007 - protein, 81 aa, Sus scrofa
GSVSFTDVTVDFTQEEWEQLDPSQRILYMDVMLENYSNLLSVEVWKADDQMEKDHRNPDEQARPFIIFKNQTPIEERDHHL

SEQ ID NO: 14008 - protein, 81 aa, Sus scrofa
LRFASDVTVDFSREEWQHLDPAQRRLYRDVTLENYSHLRSVGYHVPKPEVICKLEQGEGPWTLEEETPHQSYSGERNIGQT

SEQ ID NO: 14009 - protein, 81 aa, Mandrillus leucophaeus
VASEDVAVNFTLEEWALLDPSQKKLYRDVMRETFRNLACVGKKWEDQSIEDWYKNQGRILSNHTEEGLSESKEYDQCGEAF

SEQ ID NO: 14010 - protein, 81 aa, Sus scrofa
TPEPVKFADVAVYFSPEEWAYLRPAQKALYRDVMRETYGLLGALGFRGTKPALISWVEQEAELWGLEARDPEVGECLTEAD

SEQ ID NO: 14011 - protein, 81 aa, Mandrillus leucophaeus
KEASVAFRDVAVDFTQEEWRLLSPAQRTLHREVMLETYNHLVSLEIPSSKPKLIAQLERGEEPWREERKCSLDLCPESKPE

SEQ ID NO: 14012 - protein, 81 aa, Sus scrofa
TMTFEDVAVNFSWEEWGLLDEAQRRLYHDVMLENLALITSLGCWCGAEDEEGLSERSISVQGGSQIRTVKAALSTQKANPY

SEQ ID NO: 14013 - protein, 81 aa, Sus scrofa
AQSLLTFEEVAIYFSQEEWELLDPTQKALYNDVMHENYETVISVALFVFPKPNVIACLEQGEEPWVQRSLEFKDSSEELPA

SEQ ID NO: 14014 - protein, 81 aa, Sus scrofa
AGSSVTFRDVAVDFTQEEWEHLDPCQRHLYREVMLENYGNLISLGHLLSKPEMTFHFEQGDVWMEGKIPRNSYSGEKPYRC

SEQ ID NO: 14015 - protein, 81 aa, Sus scrofa
PQVSVTFDDVAVTFTQEEWAQLDPAQRTLYQEVMLENFRLLVSLGDRGKPKTREPSPWEPAVSEGASLREPTQGGLGDPQS

SEQ ID NO: 14016 - protein, 81 aa, Sus scrofa
PLTLEDVAIKFSPEEWACLDPAQRALYRDVMLETCRNLLSLAVSHMQAIKKLKPKANVDMGEALQTVMLGRHESHEIGDFY

SEQ ID NO: 14017 - protein, 81 aa, Sus scrofa
SQGLVSFKDVAVDFTQEEWQQLDSAQRTLYRDVMLENYSHLVSMGHPVSKPDVISKLEQGEDPWIIKRSISNWIYSDENRA

SEQ ID NO: 14018 - protein, 81 aa, Sus scrofa
FYGSLSFEDVTVGFTQEEWQQLDPVQRTLYRDVMLENYSHLISVGYCIPKPELIFRLEQGEQPWILEEESPSQSYPGVCRV

SEQ ID NO: 14019 - protein, 81 aa, Sus scrofa
CEVSVSFEDVTVDFSREEWQHLDPAQRRLYQDVMLENYSHLLSLGYEIPKPEVILKLEQGEEPWMLERDTPHRRCSGIPLG

SEQ ID NO: 14020 - protein, 81 aa, Sus scrofa
SSVTFGDVAVDFSQDEWAWLDATQRSLYRSVMLENYRNLVSLDLETRPEMKEPDPKEEISGDKPSVEVVAEGHAGSAGWGS

SEQ ID NO: 14021 - protein, 81 aa, Sus scrofa
SQSPVSFKDVAVTFTWEEWGQLDPAQRTLYREVTLETCSHLVSLGLLLTKPDVISHLEQGEDPWKAEWGPPRDQKSALERK

SEQ ID NO: 14022 - protein, 81 aa, Sus scrofa
TQEELLTLEDVAVEFSWEEWQLLAPDQKDLYWDVMLENYNNLLSLGYQPTKLDTLSKFECGEPWIIEDKIQNRTCPGEALS

SEQ ID NO: 14023 - protein, 81 aa, Sus scrofa
WSQMPVTFEDVALYLSREEWGRLDHTQQSFYRDVLQQRNGLSLAGCPFSRPVWASPAQGKGEAPSSSRLMGEEEKRGAAQL

SEQ ID NO: 14024 - protein, 81 aa, Sus scrofa
QAEVTFEDVAVLLSREEWGRLGPAQKGLYRDVMLETYRNLVSLGAGHAGPKPGVIAQLERGDEPWVLDMQGREQSTIDGSA

SEQ ID NO: 14025 - protein, 81 aa, Sus scrofa
PLTLEDVAIEFSQEEWACLDPAQRALYRDVMLETCRNLLSLGEHRFPPGVGSHPPGLRINLAPREDMKKRELGHLVILERN

SEQ ID NO: 14026 - protein, 81 aa, Sus scrofa
QVTFSDVAIDFSHEEWGWLDSAQRDLYKDVMVQNYENLVSLDWESRHGNKELSVKEDIYDEDSPQMVIMEKTIKQRHEFSN

SEQ ID NO: 14027 - protein, 81 aa, Bos mutus
FQGSVVFSDVSIDFSQEEWEFLNPAQRDLYRDVMLENYSNLVSMGLYIPKPQVISLLEQGMDDWQRADKRPMLRIHLPMPV

SEQ ID NO: 14028 - protein, 81 aa, Bos mutus
RAPGGTARAHGRVGSEQEWQNLEAWQKELYKQVMRANYEILLSLDNGLPKPELISWIEQGRELFKKWGESQESRNIICSAA

SEQ ID NO: 14029 - protein, 81 aa, Neophocaena asiaeorientalis
QEAAVFKFLSVDYTQQKWKGLALSQRALYWNIVLENCCSLASLAGENRMESSELPPKQELSKVLKSSDRTSVVLCGMIPGG

SEQ ID NO: 14030 - protein, 81 aa, Neophocaena asiaeorientalis
PLESVTLEDVAINFTQEEWALLDTSQKTLFRNVMLENITHLVSVGYQISKSDVISQLEQGKELRKSNVSKQHGKSLSQGSF

SEQ ID NO: 14031 - protein, 81 aa, Bos mutus
SVSFKDISVDFSREEWQQLDLAQKSLYRDVMLENYFNLISVGFQVPKAEVIFSLEWGEEPYMWNGKISSQGCLDQDIGFET

SEQ ID NO: 14032 - protein, 81 aa, Neophocaena asiaeorientalis
LQRPVTFKDVAVDFTQEEWQYLDPPQRDLYRDVMLENYINLISVGCKTTKPALIYKLEQGEEPWMVEREISSWRYPEKVWQ

SEQ ID NO: 14033 - protein, 81 aa, Bos mutus
QVTFEDVAVYFSWEEWGLLDEAQRLLYCGVMLETFSLMASLGCWCGAEADEAPSEQSGCVEADRANLHQHQDPNSGEKPST

SEQ ID NO: 14034 - protein, 81 aa, Bos mutus
QAQLTFKDMFIDFTPEEWECLNPAQRTLYQDAMVETLRNLLSVDSETHITENSFPLTEKLKRFWTINDYVWCHPETLSIGK

SEQ ID NO: 14035 - protein, 81 aa, Bos mutus
LQELLSFTDISMEFSWEEWQLLDSVQKHLYRDVTLENYSNLVSVGYHGTKPDLIFKLEQGEEPWIINFEVSHQSCPDPKQS

SEQ ID NO: 14036 - protein, 81 aa, Neophocaena asiaeorientalis
APLPLTFEDVAVYFSEQEWRDLEPWQKELYKQVMRTNYEILVSLHDGLPKPELISWLEQGRELFRIWGESQKSGNIICTSA

SEQ ID NO: 14037 - protein, 81 aa, Neophocaena asiaeorientalis
TFQEAVTFKDVAVAFTEEELGLLDSAQRKLYQDVMVENFRNLVSVEENNQSELRAVQDRGSREELSCRQIWQQIANDLTRC

SEQ ID NO: 14038 - protein, 81 aa, Bos mutus
VTFEDVAVVFTDEEWRRLVPTQRDLYKEVMLENYKSIVSLGLPVPGPDVIFQLKRGDEPWLVEFHGFEGKEGAENVSLEEE

SEQ ID NO: 14039 - protein, 81 aa, Nomascus leucogenys
MDSVVFEEVAVNFTPEEWALLDHAQRSLYRDVMLETCRNLASLDCCIYVRTSGSSSQRDVFGNGISDDEEIVKFTRSDSWS

SEQ ID NO: 14040 - protein, 81 aa, Nomascus leucogenys
QAEVTFEDVAVFLSREEWGRLGPAQRGLYRDVMLETYGNLVSLGVGPAGPKPGVISQLEQGDEPWVLDVQGTSGKEHLRVN

SEQ ID NO: 14041 - protein, 81 aa, Nomascus leucogenys
KSLESVSFKDITVDFSRDEWQQLDLAQKSLYREVMLENYFNLISVGCQVPKPEVIFSLEQEEPCMLDGEIPSQSRLDGDIG

SEQ ID NO: 14042 - protein, 81 aa, Nomascus leucogenys
QGLLTFRDVAIEFSQEEWKCLDPAQRTLYRDVMLENYRNLVSLDISSKCTMKEVLSTAQGNREVFHAGPLQRHESHHIGDF

SEQ ID NO: 14043 - protein, 81 aa, Nomascus leucogenys
FQEAVTFKDVAVAFTEEELGMLDSAQKKLYRDVMLENFRNLVSVGHQSFKPDMISQLEREEKLWMKELQTQRGKHSGEYCA

SEQ ID NO: 14044 - protein, 81 aa, Nomascus leucogenys
MGLLTFRDVAIEFSLEEWQCLDTAQKNLYRNVMLENYRNLAFLGIAVSKPDLIICLEKEKEPWNMKRHEMVDEPPDICPHF

SEQ ID NO: 14045 - protein, 81 aa, Nomascus leucogenys
RYVPVTFVDIAVYFSEDEWKNLDEWQKELYNNLVKENYKTLMSLGKDSPSQMLQPRLSPGKSLVVWEQRHPEDREVPMDPD

SEQ ID NO: 14046 - protein, 81 aa, Bos indicus
TLESVTFQDVAVDFTQEEWALLDTSQRTLFREVMLENISHLVSVGNQLYKSDVISHLEQGEQLSREGLGFLQGQSPVISDR

SEQ ID NO: 14047 - protein, 81 aa, Bos indicus
WKEWVKKPVTFEDVAVNFTQEEWKCLDVSQRVLYQDVISETVRNLMSVDLIAKLEQEEKQWEADLCSPNGEGFHSGGKKEE

SEQ ID NO: 14048 - protein, 81 aa, Bos indicus
GLLTFEDVAVFFTQEEWDYLDPAQRSLYKDVMMENYGNLVSLDVLNRDKDEEPTVKQEIEEIEEEMEPQGIIVTRIKSEID

SEQ ID NO: 14049 - protein, 81 aa, Bos indicus
LRDPPQGMKFEDVAIDFSQEEAGLLDEAQRLLYYSVMLENFALVASLDFHWQHRDDSGEKPWERDVERVSFVRSCHLFVSG

SEQ ID NO: 14050 - protein, 81 aa, Bos indicus
PQAKVTFEDVAVFLSQDEWDRLGPAQRGLYRHVMMETYGNVVSVGIPGSKPEVISQLERGEEPWVLDKQGNEQLRGWGISR

SEQ ID NO: 14051 - protein, 81 aa, Bos indicus
SQDSVTFADVAVNFTQEEWTLLNRFQRKLYRDVMLENYKNLTTAGYQVFKPTLISWLEEEELSTVERGVLQEWGMQLKAKD

SEQ ID NO: 14052 - protein, 81 aa, Bos indicus
PLGLTTPRGVRGFRRLFNPVLLAGPTAAAARMDRAQGGVTFADVFVYFSREEWELLEEAQRLLYRDVMLENFAHVAALDPM

SEQ ID NO: 14053 - protein, 81 aa, Capra hircus
SLETVTFKDVAVDLTQEEWQQMKPAQRNLYRDVMLENYSNLVTVGCQVTKPDVIFKLEQEEEPWVVEEEMLGRHCPEVWKV

SEQ ID NO: 14054 - protein, 81 aa, Capra hircus
LQGSVSFKDVTVDFTREEWQQLDPAQKALYRDVMLENYCHLISVGFHMTKPDMICKLEQGKELWTTEKIFQSQSYLEEDWK

SEQ ID NO: 14055 - protein, 81 aa, Capra hircus
SQGLVTIKDVSLCFSQEEWRSLDPSQTDFYGEYVMQENCGIVVSLRFPIPKLDMLSQLEGGEEQWVPDPPDLEERDILKVT

SEQ ID NO: 14056 - protein, 81 aa, Chlorocebus sabaeus
QEPLSFKDVAVVFTEEELGLLDSTQRQLYRDVMLENFRNVLSVGERNPPGDKNGRDMEYIQDEELRLFSHEELSSCKIWEE

SEQ ID NO: 14057 - protein, 81 aa, Chrysochloris asiatica
AHGSLSFRDVAINFSQEEWECLDRVQRDLYSDVMLENYNHLISLGSSFSSKPDVITFLEQRREPWMVVREESSGRYSDLEA

SEQ ID NO: 14058 - protein, 81 aa, Chrysochloris asiatica
MFSDVSVDFSQEEWECLDPAQKDLYRDVMLETYSNMVSMGTYIPKPQVISLLEQGKEPWMVGRELTKGLCSDLQSMCETKL

SEQ ID NO: 14059 - protein, 81 aa, Chrysochloris asiatica
MAFTQKEWEQLDPVQGNLYKDAMLENYSNLASMAGYETPQPNMISKLEKGKEPWLRRRKRPSQGCLSEVMRHKQIVANGEE

SEQ ID NO: 14060 - protein, 81 aa, Chrysochloris asiatica
WSQMPVTFEDMALYLSREEWGRMGHEQQRVYREALQKKNGLNMGVSGSRPFWASHVQGKGEASSSSLQRGDEEEKTVVCTD

SEQ ID NO: 14061 - protein, 81 aa, Chrysochloris asiatica
MGLAQRTLYRDVMLENYSHLVSVGYCIFKPEVIFKLEQGREPWFLEEGFSNKSCPEDYKIKRNKKIKDKHLQQIIFISNET

SEQ ID NO: 14062 - protein, 81 aa, Chrysochloris asiatica
GSVSFTDVTVDFTQEEWEQLDPSQRILYMDVMLENYSNLLSVEVWKADDQMERDLRNPDKQARQFRILRNQTPVEERGNLF

SEQ ID NO: 14063 - protein, 81 aa, Chrysochloris asiatica
HQRSVSFKDVAVGFTQEEWHRLNPAQRALYRDVMLETYSNLVSVGYEGTKPDVILKLEEEEAPWISEAARPGCYCQEDFWE

SEQ ID NO: 14064 - protein, 81 aa, Chrysochloris asiatica
MATPSPPPEPKEEWDYLDPAQRSLYKDVMMENYGNLVSLDVLSKDNDEEPIVKQEIEEIEEVEPQSVIVTRIKSEIDQDPM

SEQ ID NO: 14065 - protein, 81 aa, Chlorocebus sabaeus
FVTLKDVGMDFTLEDWEHLGLEQGDMFWDTALDNCQDLFLLDPPRPNLTSHPDGGEDLEPLPGGSPEATGRDATETKNSPL

SEQ ID NO: 14066 - protein, 81 aa, Suricata suricatta
DEALMAFRDVAVAFTQKEWKLLSPAQRTLYRDVMLENYSHLVSLGIAVSKPKLITQLEQGDEPWREESECLLDLCPAEPGT

SEQ ID NO: 14067 - protein, 81 aa, Chrysochloris asiatica
IPSQEGVNFKVLTVDYTQEEQDTLNSAMKTLDRDVMLENHRDLVSWGIPDGKDQLEKQQENQERLLKELAFTRRKATVYEK

SEQ ID NO: 14068 - protein, 81 aa, Suricata suricatta
EAGEGSGHVNFEDVARLLYRDVMLENLTLMASLGYESSTSRTDASLELGTQPWVSDWAYLTPARTREAQGCWHGAEGEEIA

SEQ ID NO: 14069 - protein, 81 aa, Chlorocebus sabaeus
QGLLTFRDVAIEFSLAEWQCLDRAQQNLYRDVMLENYRNLVSLGIAVSKPDLITHLEQNKEPRNIKKNEMLAKHPVMCSHC

SEQ ID NO: 14070 - protein, 81 aa, Suricata suricatta
IWGPLSFVDVCVDFTWEEWRLLDPAQKRLYRRVMLENYSHLVSLGYQDTKPDIIFRLEQGEELWMLQAHVPSQGHPEKVRE

SEQ ID NO: 14071 - protein, 81 aa, Suricata suricatta
EEPPVVFEDVAVYFTREEWGTLVTRQKELYRDVMRLNYELLASLEPAAAKPDLISKLERRAAPWIRDPSGPKWGKGRPPGK

SEQ ID NO: 14072 - protein, 81 aa, Chrysochloris asiatica
MLAPVTFEDVTVVFTEAEWVTLSTEQKNLYKEVTLETYRNLLSLAEPTPETYPGPSCLLPFSCQQFLSQHVLQIFPGVCAE

SEQ ID NO: 14073 - protein, 81 aa, Suricata suricatta
LQELMTLEDVALDFSREEWQLLAPAQKGLYWDVMLENYRNLVSPGCQAREPDPLSELKQGEPLWILEDEVQSQTHAQIEKA

SEQ ID NO: 14074 - protein, 81 aa, Suricata suricatta
QESVTFEDVAVIFTEEEWTHLVPIQRDLYKEVMLENYKSIVSLDWETKPETPGASEEESGGTVRERLGRQGPLCPKSEAHA

SEQ ID NO: 14075 - protein, 81 aa, Suricata suricatta
MIQSQISFEDVAVDFSLEEWQLLNPTQKNLYRDVMLENYSNLVFLGYQIIKPDATFRLKREQPWRTDEVLSQNFSEEVWLD

SEQ ID NO: 14076 - protein, 81 aa, Mandrillus leucophaeus
FQGSISFKDVTVGFSQEEWQHLNPSQRALYRDVMLENYSNLVSVGYCVHKPEVISRLEQGEEPWRLEEEFPSQSFSEVWTA

SEQ ID NO: 14077 - protein, 81 aa, Mandrillus leucophaeus
DSVTFEDVAVDFTQEEWTLLDQTQRNLYRDVMLENYKNLVAVDWESHINTKWSAPQQNFLQGKTSNVVEMERNHFGEELFD

SEQ ID NO: 14078 - protein, 81 aa, Mandrillus leucophaeus
TMFKEAVTFKDVAVFFTEEELGLLDPAQRKLYQDVMLENFTNLLSVGHQPFHPFHFLREEKFWMMETATQREGSSGGKTVV

SEQ ID NO: 14079 - protein, 81 aa, Sus scrofa
PQGGVTFADVAVRFSCGEWRLLDEAQRRLYLDVMLDNYTLISSLGCCCGAGAVESRLEKTVPAGVSQAWSPKTAPFSQKIH

SEQ ID NO: 14080 - protein, 81 aa, Sus scrofa
YQELVTFRDVAVDFSQEEWDCLNSSQRHLYSNVMLENYRILVSLGLCFSKPSVILLLEQGKEPWKVKRELTRGSYSDWESM

SEQ ID NO: 14081 - protein, 81 aa, Mandrillus leucophaeus
PVTFRDVAVIFTEAEWKRLSPEQRNLYKEVMLENYRNLLSLAEPKPEIYPCSSCLLAFSCQQFLSQHVLQIFLGLCAENHF

SEQ ID NO: 14082 - protein, 81 aa, Mandrillus leucophaeus
HREPVTFEDVAVDFTKEEWQQLNPAQKTLHRDVMLETYSHLVSVGCSGIKPGVIFKLEHGKDPWIIESELSRWIYSDRVKG

SEQ ID NO: 14083 - protein, 81 aa, Sus scrofa
PKVPVTFDDISIYFSTPEWEKLEEWQKELYKNIMKGNYESLISMDYAMNQPDVLSQIQPEGGQTEDQAGPEESEIPTDPSE

SEQ ID NO: 14084 - protein, 81 aa, Sus scrofa
PQEPVSFKDVAVDFTQEEWLQLDADEKTTYRDVMLENYSHLVSVGYDSTKPNVIIRLEQGEEPWVADSELPQQCHPEEVWK

SEQ ID NO: 14085 - protein, 81 aa, Mandrillus leucophaeus
RRGHLTFRDVAIEFSQEEWKCLDPAQRTLYRDVMLENYRNLVFLGICLPDLSIISMLEQRRDPRNLQSEVKIANNPDGREC

SEQ ID NO: 14086 - protein, 81 aa, Sus scrofa
FQGLLTVEDVAIDFSPEEWECLDLGQRHLYRDVMLEICRHLVSLEYVISKPDLVRLLEQKKDPWDVKGMETVAIQPALSSH

SEQ ID NO: 14087 - protein, 81 aa, Sus scrofa
SQDSVTFEEVTVDFSQEEWALLDPAQKILYRDVMLENFRNLASLAGYQLCKHSLITEMEQEEQKPEGRGILQGAGTDWETQ

SEQ ID NO: 14088 - protein, 81 aa, Mandrillus leucophaeus
LVMFQDLFIDFSQEEWECLDAAQKDLYRDVMMENYSSLVSLDSEFRCKTKDSCLPKEIYEVTSSQWVRMEKCHSLVGSSVR

SEQ ID NO: 14089 - protein, 81 aa, Sus scrofa
TDGSVTFKDVAINFSAEEWEFLDSAQRDLYVNVMLENYSNLVSLDWESTYETQNTSSKKNIFEINFSQWEIVESSETLDLE

SEQ ID NO: 14090 - protein, 81 aa, Mandrillus leucophaeus
SQEQVSFKDVCVDFTQEEWYLLDPAQKILYRDVILENYSNLVSVGYCITKPEVIFKIEQGEEPWILEKGFPSQCHAERKWK

SEQ ID NO: 14091 - protein, 81 aa, Sus scrofa
MAFEDVAVYFSREEWGLLDTAQRALYRRVTLENFALLASLGCSPPAADRDVSGKAALPGPLQEGRPPAAPRALPTTGACQR

SEQ ID NO: 14092 - protein, 81 aa, Sus scrofa
MAFRDVAVAFSQKEWKLLSPAQRTLYRDVMLENYSLLVSLGIAFPKPKLITQLEQGDEPWREESECFLDLYSEPRTEFQPC

SEQ ID NO: 14093 - protein, 81 aa, Sus scrofa
CEGSLSFEDVTMDFSREEWLQLDSAQRRLYQDVMLEIYSHLFSVGYHIPNPEVIFSTEKGEEPWMGAAECRHQRYQDGELG

SEQ ID NO: 14094 - protein, 81 aa, Sus scrofa
FQGPVTFKDVAVEFTQEEWVMLDSAQRSMYRDVMLENYINLSSVEYHLCKPVISLLGQDLRTVKKIPQGTCPDQEIQLKTK

SEQ ID NO: 14095 - protein, 81 aa, Sus scrofa
SQGLLTFEDVAIDFSPEEWECLDLGQRDLYRDVMIEICRHLVSLEYVISKPDLVRLLEQKTDPWDVKGMETVAIQPALSSH

SEQ ID NO: 14096 - protein, 81 aa, Sus scrofa
AHGLVTFSDVAIDFSQEEWACLDSTQRDLYWDVMLENYSNLVSLELESPYETKTLPRQKGIYEMNFSKRNSGGKSKSLGLN

SEQ ID NO: 14097 - protein, 81 aa, Sus scrofa
FQGLLTFQDVAIDFSQEEWECLDLGHRKLYRDVMLETYGNLVSLGLVDSKPDVVIFLEQMKDPWSVTRVEARAMHPEHNQR

SEQ ID NO: 14098 - protein, 81 aa, Mandrillus leucophaeus
TLVTFKDVFVDFTREEWKLLDTAQQIVYRNVMLENYKNLVSLDSETAFEIKSSVSSRSIFKDKQSCDIKMEGMARNDLWYL

SEQ ID NO: 14099 - protein, 81 aa, Sus scrofa
VKELVTFKDVAIDFTLEEWRLMDPTQRNLHKDVMLENYRNLVSLGLAVSKPDMISHLEDGKGPWVVVREISRTSNPELGTK

SEQ ID NO: 14100 - protein, 81 aa, Sus scrofa
MLETYSNLVSVGYKGTKPYVILRLEQQEAPWICEAACSGCHCRENIWQVNVQRKRRQDTLLRQGTFISKKTLPKERSHEYN

SEQ ID NO: 14101 - protein, 81 aa, Sus scrofa
MAVSQGQMALNDVAIEFSREEWACLDPAQRALYRDVMLETYWNLLSVSEINFLPKVQICCLFMIAVCLLGSSASFSHSKPW

SEQ ID NO: 14102 - protein, 81 aa, Neophocaena asiaeorientalis
AQEPVTFEDVTLGFTPDEWGMLDLEQKSLYREVLLENYRNLVSVEHQLSKPDVVSQLEEEEELWSVERGIPRDTFSECPEA

SEQ ID NO: 14103 - protein, 81 aa, Neophocaena asiaeorientalis
FEESVTFEDVAIYFSENEWTGLTPAQRALYRDVMLEDYGAVASLAAFPFPKPALIFQLEAEAPWSLAPQGALDGEGPRGIA

SEQ ID NO: 14104 - protein, 81 aa, Neophocaena asiaeorientalis
PKVPVTFDDVAVHFSEQEWGNLSEWQKELYKNVMRGNYESLVSMDYAISKPDLMSQMERGERPAMQEREDSEEGEAPADPS

SEQ ID NO: 14105 - protein, 81 aa, Bos mutus
QGCVTFEDVTIYFSPEEWGLLDEAQRLLYCDVMLENFALIASLGLASFRSHIVAQLEMGAEPWVPDQVDMTSAMARGVYRG

SEQ ID NO: 14106 - protein, 81 aa, Neophocaena asiaeorientalis
EEVPVVFEDVAVYFTREEWGTLDKRQKELYRDVMRMNYELLASLGPAAAKPDLISKLERRAAPWIKDPNGPKWGKGRPPGK

SEQ ID NO: 14107 - protein, 81 aa, Bos mutus
TRSLGPALRTETTFPRRHCGACPTATQPRQCFVRLRHLPAPEATGLAISKPDVISFLEQGKEPWTVEEVVTEGLCPVLKSR

SEQ ID NO: 14108 - protein, 81 aa, Bos mutus
REGTASPRLPLISIGSGLSELCRSLTEILKRTDQCLQFKTMAHEWCPSMSKPDVITLLDEGKEPWMVVREGTGKHHPDLES

SEQ ID NO: 14109 - protein, 81 aa, Neophocaena asiaeorientalis
PHSLVSFKDVAIDFSQEEWECLDLQQKDLYRDVMLENYSNLVSLGFSISKPDVLSLLEQGKDPWKVVRDVTRGLSPDWESR

SEQ ID NO: 14110 - protein, 81 aa, Neophocaena asiaeorientalis
SQEMLTIRDVFVDFTLEEWQQLDATQKNLCRDVMLENYSHLVSVGFLVAQPGRISRLGQGGEEARMAAGESTTRRCPDLHP

SEQ ID NO: 14111 - protein, 81 aa, Neophocaena asiaeorientalis
MFRDVAVDFSQEEWECLDSTQRDLYRDVMMENYSNLVLLALSIPKLDVIFLLEEGKEPWMVSRNMVGGWCPDLEFRCKTKE

SEQ ID NO: 14112 - protein, 81 aa, Neophocaena asiaeorientalis
AQVLVTFKDVAVTFTREEWGQLDLDQRTLYQEVMLEICGLLVSLGHPVPKPELIHLLERGQEPWMGRRDLPRSMCPDDRAK

SEQ ID NO: 14113 - protein, 81 aa, Neophocaena asiaeorientalis
AQGSVSFEDVTVEFTQDEWQYVGPALRTLYKDVMLENYSHLVSLGYCIIKPQVIFKLEHGEEPWPSEEEFLNQKYPGCYRV

SEQ ID NO: 14114 - protein, 81 aa, Neophocaena asiaeorientalis
VMESVTLEDVAVGLIQEWTLLDDARRNLCRYVLLDNCRTLAPRAGTPSCKACLVSQVGPREELMTAEQGILCATGVDWESQ

SEQ ID NO: 14115 - protein, 81 aa, Nomascus leucogenys
QEMPLTFQDVAVYFSQAEGQQLGPQQRALYRDVMLENYGNVASLGFPVPKPELISQLEQGKELWVLNLLGAEEPDILKSCQ

SEQ ID NO: 14116 - protein, 81 aa, Nomascus leucogenys
RQAFLAFGDVTVDFTQKEWRLLSPAQRALYREVTLENYSHLVSLGILHSKPELIRRLEQGEAPWGEERRRRPGPCAGIYAE

SEQ ID NO: 14117 - protein, 81 aa, Nomascus leucogenys
RRGHLTFRDVAIEFSQEEGKCLDPAQRTLYRDVMLENYRNLVFLGICLPDLSVISMLEQRRDPQNLQSEVKIANNQGGREC

SEQ ID NO: 14118 - protein, 81 aa, Nomascus leucogenys
SVAFEDVAVNFTQEEWALLSPSQKNLYRDVMLETFRNLASVGIQWKDQNIENLYQNLGIKLRSLVERLCGPQEGSEHRETF

SEQ ID NO: 14119 - protein, 81 aa, Nomascus leucogenys
LPAKDSAWSWKEKPRYLGPVTFEDVAVLFTEAEWKRLSLEQRNLYKEVMLENLRNLVLLVLELGSPRSGLLPLDLNLDLWL

SEQ ID NO: 14120 - protein, 81 aa, Bos indicus
AHGSVTFRDVAIDFSQEEWEFLDSAQRDLYRDVMWEAYSNFISLGPSMSKPDVITLLDEGKEPWMVVREGTGKHHPDWKSR

SEQ ID NO: 14121 - protein, 81 aa, Bos indicus
GSVSFTDVTVDFTQEEWEQLDPSQRILYMDVMLENYSNLLSVEVWKADDQMETDPRNPDEQARPFVIFKDQTPTEERDNNL

SEQ ID NO: 14122 - protein, 81 aa, Bos indicus
FQMPLTFSDVSIDFSQEEWECLNSDQKNLYRDVMLETYTNLVSLDFDFTTENNKLSSEKSSFEVNSYHWEIMKSKTFNLMG

SEQ ID NO: 14123 - protein, 81 aa, Bos indicus
YQELVTFRDVAVDFSQEEWDYLNPSQRHLYSNVMLENYRILVSLGLCFSKPSVILLLEQGKEPWMAKREMTKDLCSDWESM

SEQ ID NO: 14124 - protein, 81 aa, Bos indicus
MDSVVFEDVAVNFTLEEWELLDPAQRKLYRDVMLETCRNLATVGSCPQVKVSVSSPQWDILETGLCIEREVVRFTRNDSRS

SEQ ID NO: 14125 - protein, 81 aa, Bos indicus
SEDLVTFRDVAVNFSQEEWEWLNPAQRSLYRTVMLDNYRSLVSLGVSVSKPDVISLLEQGKEPWMVKEEGPRGACPGWEYT

SEQ ID NO: 14126 - protein, 81 aa, Equus caballus
VQEPVTFKDVAVDFTQEEWGQLDPVQRTLYRDVMLETYGHLLSVGNQIPKPEVISLLEQGEEPWSVEQAYPQSTCPEWMRI

SEQ ID NO: 14127 - protein, 81 aa, Equus caballus
CEGSVSFEDVTMDFSREEWQQLDPAQRRLYQDVMLEIYSHLFSVGYHIPIPEIIFRMEKGKEPWIGKAKLLPHQRCQEGDL

SEQ ID NO: 14128 - protein, 81 aa, Equus caballus
WSQDSVTFEEVAVDFSQEEWALLDPAQKILYRDVMLENFRNLASVGYHLCKHNLITEVEQEELRPEERGILQGACTDWDTQ

SEQ ID NO: 14129 - protein, 81 aa, Equus caballus
DLYTFPNGGLYFAEGQLDCFFLDLLKLTIFSSFSAVNPSSSDFHLIGHPVSKPDVISKLEQGEDPWIIKRDISNWIYPDEN

SEQ ID NO: 14130 - protein, 81 aa, Equus caballus
TRVSVTFDDVAVTFTQEEWGQLDLAQRTLYQEVMLENCGLLVSLGCPVPRPELICQLEHGQELWTVKKDLSQSPCPGDKGQ

SEQ ID NO: 14131 - protein, 81 aa, Equus caballus
SEASVTFRDVAVLFSRDEWLHLDSAQRTLYREVMLENYSTLVSLGIPFSTPKVICQLQQGEDPCMMEREIPQDTCRGFKTW

SEQ ID NO: 14132 - protein, 81 aa, Equus caballus
FQPPVSFKDVAVTFTREEWGQLDPAQRMLYRDVTLETCSHLFSLGLLLSKPDMISWLEQGEDPWRARQGPPQDWKTTLEKK

SEQ ID NO: 14133 - protein, 81 aa, Loxodonta africana
FQGSVTFKDVIVDFTQEEWKWLDPVQRDLFRDVTLENYTHLVSIGLQVSKPDVISQLEQGTEPWTVEPGVPVVPLQNWETR

SEQ ID NO: 14134 - protein, 81 aa, Capra hircus
DPEAVTFKDVAVIFTEEEMGLLDLAQRKLYQEVMLENFQNLLSVGHQSFTPDVPSQLEREEKLQMIKTAAQSCCSSGNQNL

SEQ ID NO: 14135 - protein, 81 aa, Capra hircus
WKGLLSFEDVALYFTREEWDTLDWAQKALYRDVMLDNYRHVVSLGFQFPKPEVICQLEQWEEPWILDLQRAGTRKASGSAC

SEQ ID NO: 14136 - protein, 81 aa, Capra hircus
AQELLTLEDVAVEFNREEWQLLDSSQRDLYWDVMLENYNNLVSLGYQGTKPDLLSKLEHGKEPCIIENEMQNRICPGIGKG

SEQ ID NO: 14137 - protein, 81 aa, Capra hircus
RLTSEDVAIEFTQEEWEFLDPAQRALYRDVMLETYRNLLSLDISPTHVMKHLQPKANSDKRETFQTLMLGSPESCEIKHFH

SEQ ID NO: 14138 - protein, 81 aa, Capra hircus
AQELVTFEDVAVYFIRKEGKRLEPAQRDLYRDVMLENYGNVFSLDGETRTEPDSEISEDGGSHGVLLGRFQKDISQGLKFE

SEQ ID NO: 14139 - protein, 81 aa, Capra hircus
IKSPLTFGDVAVEFSGEEWAWLDSAQRSLHRSVMLENYRNLASLGLCLSKPEMISSLEQRKEPWAVKRKSTSGKCPDLQTL

SEQ ID NO: 14140 - protein, 81 aa, Capra hircus
IQRPVSFKDVVVGFTQEEWHGLNPAQRALYRDVMLETYSNLVSVGYEGTKPYVILQLEQEEAPWICEAACSGCHCQENIWQ

SEQ ID NO: 14141 - protein, 81 aa, Capra hircus
SQVSVTFEDVAVLFTRDEWRKLAPSQRNLYQDVMLENYSNLVSLGLPFSKPEVISLLQQGEDPWKVEKESPGGSSLGEWSS

SEQ ID NO: 14142 - protein, 81 aa, Capra hircus
PSESVTFKDVIVDFTQEEWKQLDPVQRGLFRDVTLENYTHLVSIGLQVSKPDVISQLEQGTEPWIVEPSIPVGTLGDWVTR

SEQ ID NO: 14143 - protein, 81 aa, Capra hircus
KQEPVTFEDVAVYFTQNQWASLDSAQRALYREVMLENYANVASLVSPFPRPDLISQLERGEAPWDPDPWETEDLRGICPGG

SEQ ID NO: 14144 - protein, 81 aa, Chlorocebus sabaeus
SQAPVTFEDMAMYLTREEWRPLDPAQRDLYRDVMQENYGNVVSLDFEIRSENEVNPKQEISEDVQFGTSERPAENAEENPE

SEQ ID NO: 14145 - protein, 81 aa, Chrysochloris asiatica
ETESVTFKDVAVVFTEEELELLDPAQKRLYRDVMVENFRNLVSVGDENPRPMETVPQAAAQEELSSTYIWQQITNDFTRGP

SEQ ID NO: 14146 - protein, 81 aa, Suricata suricatta
ELHGLLISSYSSRTMTDGLVTFRDVAIDFSQEEWECLDPAQRDLYVDVMLENYSNLVSLGKVICLKYFRIFSLHHWLSLWD

SEQ ID NO: 14147 - protein, 81 aa, Chlorocebus sabaeus
FQGLLTFEDVAVFFTQEEWDYLDPAQRSLYKDVMMENYGNLVSLDYFSLQPYQLLILSIHMIFWLIEPNKCPYVNTIWTRS

SEQ ID NO: 14148 - protein, 81 aa, Suricata suricatta
GSPLACGLSCLPSRQGCVTFEDVFVYFSREEWELLEEAQRLLYRDVMLENFALVSSLGLAVSRSHVVSQMEPEGSPGCLRR

SEQ ID NO: 14149 - protein, 81 aa, Suricata suricatta
GTLYRDVMLETYGHLLSVGNQIAKPEVICLLEQGEDPWSVEQAHPQSTCPEWMRNLESKALIPTQSIFEEEQSHSMKLERY

SEQ ID NO: 14150 - protein, 81 aa, Suricata suricatta
AQGSVVFSDVSVDFSQEEWECLDPGQRDLYRNVMLENYSSLLSVGLYIPKPQVISLLEQGKEPWMVGRELTRGLCSDLESM

SEQ ID NO: 14151 - protein, 81 aa, Chlorocebus sabaeus
FQGLLTFRDVAIEFSQEEWKCLDPAQRTLYRDVMLENYRNLVSLDISSKCMMKTLSSTGQGNTEVIHKGTLQRQASHHIGE

SEQ ID NO: 14152 - protein, 81 aa, Suricata suricatta
AGSQDLLTFGDVAIEFSQECLNHSQQELRRDVMLDNYGHLLFLGLVSEPDLVIFLEQKKDSWDVRRKETEASYPRMIMNVI

SEQ ID NO: 14153 - protein, 81 aa, Suricata suricatta
MQGSVTFRDVAIDFSQEEWEFLDSAQRDLYRDVMWENYSNFISLAEPSISKPDVIEGKEPWMVVREGTRRHCPDLESRYRT

SEQ ID NO: 14154 - protein, 81 aa, Chlorocebus sabaeus
QGSLTFRDVAIEFSLEEWQCLDTAQQNLYRNVMLENYRNLVFLGIAAFKPDLIIFLEQGKEPWNVKRYEMVEEPPVICSHF

SEQ ID NO: 14155 - protein, 81 aa, Suricata suricatta
CEGSVSFEDVTVNFSREEWQHLDPVQRRLYRDVTLENYSHLRAVGYQVPKPEVIFKLEQGEGPWTLEGETSHQSCSDEDIG

SEQ ID NO: 14156 - protein, 81 aa, Chlorocebus sabaeus
MLENCINLVFVGIVASKPDLITCLEKEKEPWNMKRHEIVDEPPVMCSHFVEELWPEQNIKDSFQKMILRRYNKCGHKNLQL

SEQ ID NO: 14157 - protein, 81 aa, Suricata suricatta
HQELVTFEDVAVYFTQTEWAGLCSGQKALYRSVMLENYGNLTSLGYSVPRPALISLLEAGSLPWGLEAQVNLSAERTKDIY

SEQ ID NO: 14158 - protein, 81 aa, Chrysochloris asiatica
MGTMVIEGVSVVFTQEEWTLLNPAQRKLYRDMMMETFRNLASVVAGNLNDGDKLPSVWIIDRSVESDTFILVVYSPSLNAG

SEQ ID NO: 14159 - protein, 81 aa, Chlorocebus sabaeus
VTFEDVAVNFTQEEWNLLSEAQRCLYRDVMLENLALISSLGLRCPYSPAPFLEQPQHLLIQRETQVRIPMAGVSPKKVHPC

SEQ ID NO: 14160 - protein, 81 aa, Chlorocebus sabaeus
QESVTLEDVAVDFTWEEWQLLGPAQKDLYRDVMLENYSNLVAVGTGYQASKPDVFFKLEQGEPPWTIEDGIHSGACSEIWK

SEQ ID NO: 14161 - protein, 81 aa, Suricata suricatta
CKGSVSFEDVTVDFSREEWQQLDSTQRRLYQDVMLENYSHLLSLGYQVPKPEVIFKLEQGEEPWILERKTPHQSCSDGRFE

SEQ ID NO: 14162 - protein, 81 aa, Mandrillus leucophaeus
MDVMLENYCHLISVGCHMTKPDVILKLERGEEPWTSFSGHTCLEENWKAEDFLVKFKEHQEKYSRSVVSINHKKLVKEKSK

SEQ ID NO: 14163 - protein, 81 aa, Sus scrofa
LQVSVTFDDVAVTFTQEEWGQLDPAQRTLYQEVMLENRGLLVSLGCPVPRPELICQLEHGRELWMVQKDLSQSTCPGEQGK

SEQ ID NO: 14164 - protein, 81 aa, Mandrillus leucophaeus
SPPESVSFKDVTVDFSRDEWQQLDLAQKSLYREVMLENYFNLISVGCQVPKPEVIFSLEQEEPCMLDGELSGQSHPDGDFG

SEQ ID NO: 14165 - protein, 81 aa, Mandrillus leucophaeus
VTLRDVVINFSQEEWEYLDSAQRNLYWDVMMENYSNLLSLDLESRSETKHLSVGKDIIKNTGSQWEVMESSKLRGLESSIC

SEQ ID NO: 14166 - protein, 81 aa, Mandrillus leucophaeus
KEPGEAPVTFDDITVYLLQEEWVLLSQQQKELCSSDKLVAPLGPTVANPELFCKFGPGPEPWLGSVQGQRSHLEHHQGKKQ

SEQ ID NO: 14167 - protein, 81 aa, Mandrillus leucophaeus
MDTVVFEDVVVGFTLEEWALLNPAQRNLYREVMLETFKHLASVRNPRVERPCKSGKGNKRGGTFRKTRNCNRHLRKNHRTG

SEQ ID NO: 14168 - protein, 81 aa, Mandrillus leucophaeus
AATLRLSAQGTVTFEDVAVKFTQEEWNLLSEAQRCLYRDVMLENLALISSLDPALDGSADNTQTGNLGQSVLPSHPEQKTA

SEQ ID NO: 14169 - protein, 81 aa, Mandrillus leucophaeus
EEALMAFRDVAVAFTQKEWKLLSSAQRTLYREVMLENYSHLVSLGIAFSKPKLIEQLEQGNEPWREENEHLLDLCPESCSV

SEQ ID NO: 14170 - protein, 81 aa, Sus scrofa
DLGVTFEDVVVYFSWEEWGLLDETQRCLYHDVMLENFALLTSLGCWYGMEDEEAFSVQSVSVEQMSLGKTPNLDPSIQKTH

SEQ ID NO: 14171 - protein, 81 aa, Sus scrofa
VMFQVTFSDVAIDFSHEEWGWLDSAQRDLYKDVMVQNYENLVSLGLSIPKPYVIALLEDGREPWMVEEKLSKSLFPDWESR

SEQ ID NO: 14172 - protein, 81 aa, Mandrillus leucophaeus
TQESLTLEDVAVEFSSEEWQLLDTAQKNLYRDVMVENYNHLVSLGYQTSKPDVLSKLAHGQEPWITVAKIQNKNCPGIGKV

SEQ ID NO: 14173 - protein, 81 aa, Mandrillus leucophaeus
QEGVNFKIVTVDFTQEEQGTWNPAQRTLDRDVILENHRDLVSWDLTTAVGKKDPTSKQSIFDEEPANGVKIERLTRDDPWL

SEQ ID NO: 14174 - protein, 81 aa, Mandrillus leucophaeus
ASVALGDVAVNFTREEWALLGPCQKNLYKDVMQETIRNLDCVGMKWKDQFLFKDQIEDQYKYPRKNLRCRMLERFGESKDG

SEQ ID NO: 14175 - protein, 81 aa, Sus scrofa
FPEPVTFEDVTLGFTPEEWGMLDLEQKSLYREVLLENYRNLVSVEHQLSKPDVVSQLEEEEELWSVERGIPQDTFSECPEA

SEQ ID NO: 14176 - protein, 81 aa, Sus scrofa
ARELVTFKDVAVDFTQEEWGQLDPVQRTLYRDVMLETYGHLLSVGHQMAKPEVISLLEQGEEPWSTEQPYSPPGTCPEWMR

SEQ ID NO: 14177 - protein, 81 aa, Mandrillus leucophaeus
MHESVTLEDVAVEFIQEWALLDSARRSLCRYGMLDQCRTLTSRGTPPCKPSRVSQLGPRAEPRATERGILHATGVEQLQCY

SEQ ID NO: 14178 - protein, 81 aa, Sus scrofa
EEVPVVFEDVAVYFTRDEWGTLDKRQKELYRDVMQMNYELLASLGPAAAKPDLISKLEQRAAPWIKDPHGPTWGKGRPPGK

SEQ ID NO: 14179 - protein, 81 aa, Sus scrofa
SQSSVTFGDVAVDFSQDEWAWLDATQRSLYRSVMLENYRNLVSLGLCSSKPDMISSLEQRKEPWTVKRKLPGGGCPDPQAV

SEQ ID NO: 14180 - protein, 81 aa, Sus scrofa
MLENYAAVASLAAFPFPKPALIFLLERGEAPWSSAPEGPLDGEGPRGISSGPFLKWAGISHLEQVEEPLKQKLQEEGPSLL

SEQ ID NO: 14181 - protein, 81 aa, Sus scrofa
VMESVTLKDVAMGLIQEWALLDDAWRNLCRYMLLDNCRTLAPRAGAPPCKASLVSQVGPRKELRAAEGGILQATCADWESQ

SEQ ID NO: 14182 - protein, 81 aa, Sus scrofa
LQDLVTFEDVTVEFTREEWALLDPSQRTLYRDVTLENCRNLASLGYHIDKPSLISQLEQEDKVMTEERGVLPGSCPDLETV

SEQ ID NO: 14183 - protein, 81 aa, Sus scrofa
GRGCVISEGVFVYFSLEEWKLLDEAQRRLYRDVMLENLALLASLGIASSRSHLVMQLQQGGGPWIPTQVAVTPAAEKEAQQ

SEQ ID NO: 14184 - protein, 81 aa, Nomascus leucogenys
PQASVCFEDVAMAFTQEEWEQLDLAQRTLYREVTLETWEHIGLCPWKEVLPPGLKAVPSSEGCSRMGWKILEAGPRGCPSF

SEQ ID NO: 14185 - protein, 81 aa, Nomascus leucogenys
MAKPREWRHLDLSQRNLYRDVMLETYSHLLSVGYQVPEAEVVMLEQGKEPWALQGERPRHSCPGEKLWDHNQCRKILSYKQ

SEQ ID NO: 14186 - protein, 81 aa, Nomascus leucogenys
PQGLLTFRDVAIEFSQEEWKCLDPAQRTLYRDVMLENYRNLVSLDISSKCMLKTLSSTGQGNTEVFHTRTLHRQASHHIGD

SEQ ID NO: 14187 - protein, 81 aa, Nomascus leucogenys
VTFEDVAVNFTQEEWNLLSEAQRCLYRDVTLENLALMSSLGCWCGVEDEAAPSKQNIYIQRETQVRTPMAGVSPKKAPHCE

SEQ ID NO: 14188 - protein, 81 aa, Nomascus leucogenys
SLDSMTFEDIVVDFTQEEWALLDTSQRKLFQDVMLENISHLVSIGKQLCKSTVLSHLEQVEKFSTQRISLLQGREVDIKHQ

SEQ ID NO: 14189 - protein, 81 aa, Canis lupus
LLTFRDVAIEFSQEEWGCLNHTQRELYRDVMLENYGNLLFLAISSRDTQSLLSKPSIKASFQRVSMGRLKNNALENLHFMT

SEQ ID NO: 14190 - protein, 81 aa, Canis lupus
SQGPLSFVDVFVDFTWEEWRLLDPAQKHLYRSVMLENYSHLVSLGYQDAKPDIIFKLEQGEELWMMQTQIPSQGQPGKAWE

SEQ ID NO: 14191 - protein, 81 aa, Chlorocebus sabaeus
TQGHLTFRDVAIEFSQEEWKCLDPVQKALYRDVMLENYRNLVSLGICLPDLSIISMMKQRTEPWTVENEMKVAKTPVRWEG

SEQ ID NO: 14192 - protein, 81 aa, Chlorocebus sabaeus
MLENYRNLVSLAGISLSEMSIISMLGQGKEPWTVESEVRITKTSNGWERIKGVNTDVSPTHMIKKSPPKQNNSTEKVFQAV

SEQ ID NO: 14193 - protein, 81 aa, Chrysochloris asiatica
QGCVTFEDVFVYFSREEWGLLDEPQRLLYRDVMLDNFALAASLGCWREAEKEETPCKQDVCVGGGVSQVMALSNQKAKLCE

SEQ ID NO: 14194 - protein, 81 aa, Chrysochloris asiatica
GQKLLSFEDVALFFTREEWENLNWAQKYLYRDVMLENYRSMIFLGFQFPKPEVISQLEDWDEPWILDLPRTWTRMTSGTAS

SEQ ID NO: 14195 - protein, 81 aa, Suricata suricatta
KPGVLTFADVAVYFSSEEWGCLRPAQRALYRDVMRETYGHLGALGFRGTKPALICWVEEEADLWGPEARDPEVGACLTEAD

SEQ ID NO: 14196 - protein, 81 aa, Suricata suricatta
KPGAVSFADVAVYFSPEEWGCLRPAQRALYRDVMRETYGHLGALGFPGPKPALISWMEQESEESEAWSPAAKDPEEGESLG

SEQ ID NO: 14197 - protein, 81 aa, Suricata suricatta
GWLTFRDVIVEFSPEEWECLGPAQRALYRDVMLENYRNLVSLGRNLFPCVMEPGLDHPAEEPRGTWRSWKGGALFHTGGLK

SEQ ID NO: 14198 - protein, 81 aa, Chlorocebus sabaeus
LKALMAFRDVAVAFTQKEWKLLSSAQRTLYREVMLENYSHLVSLVGIAFSKPKLIEQLEQGNEPWREENEHLLDLCPAEPR

SEQ ID NO: 14199 - protein, 81 aa, Chrysochloris asiatica
FGSVVIEDVAVVFSQEEWALLDVAQRRLYREVMMETFRNLASVALNQPGTALRDEMCHECGKDFYSFSSFWTSVRGYGECK

SEQ ID NO: 14200 - protein, 81 aa, Chrysochloris asiatica
MLENCGLLVSLGYPVPEPEAIYELELRQEVKAVKRALSQWTCPADKTRLETTEPTSPEPVLYEKASVQGRLKQRPSWDSQV

SEQ ID NO: 14201 - protein, 81 aa, Chrysochloris asiatica
LLASVSFRDVTVEFTQEEWKCMSPVQRTLYRDVMLENYSLLISVGYCFTKPEVIFKLEQAKYSCLLEEGFLNRSYPEDCQL

SEQ ID NO: 14202 - protein, 81 aa, Suricata suricatta
GSVSFTDVTVDFTQEEWEQLDPSQRILYMDVMLENYSNLLSVEVWKADAQLEQDHSGPDEQARPFIIFKNQTPIEERDNLF

SEQ ID NO: 14203 - protein, 81 aa, Suricata suricatta
THGLVMFKDVAIDVSQEEWECLNPTQRSLYRDVMLENYSNLVSLGLSLSKPAVISSLEQGMEPWMVVREVTGKQCPDLVSR

SEQ ID NO: 14204 - protein, 81 aa, Chlorocebus sabaeus
EMGLLTFRDIAIEFSLAEWQCLDRAQRNLYRDVMLENYRNLVSLGIAVSKPDLITCLEQNKEPQNIKRNEMVSKHPVTCSH

SEQ ID NO: 14205 - protein, 81 aa, Suricata suricatta
SKLPVTFGDLAIYFSQEEWEWLSPIQKDLYEDVMLENYQNLVSLGLSFRRPNVITLLEKGKAPWMVEPVRKRRGLDSKSKC

SEQ ID NO: 14206 - protein, 81 aa, Suricata suricatta
AQESVTFRDVAVVFSRDEWLRLDSAQRSLYREVMLENYGTLVSLGIPSSTPKVICRLQLGEDPCVLERETPQDACLGFKTG

SEQ ID NO: 14207 - protein, 81 aa, Suricata suricatta
VSVTFDDVAVTFTQEEWGQLDPAQRTLYQEVMLENCGLLVSLGDKDKPKTTDPTACEPALPGGASFQELRQGDAGSCQRGH

SEQ ID NO: 14208 - protein, 81 aa, Suricata suricatta
CQRAVSFKDVVVGFTQEEWHRLNPAQRALYRDVMLETYSNLVSVGYEGTKPYVILKLEQEEAPWICEAACSGCHCRENICQ

SEQ ID NO: 14209 - protein, 81 aa, Sus scrofa
PKVPVTFDDVAVYFSEQEWGKLDEWQKELYKHVMRGNYETLVSLDYAISKPDILSRMERGEEPCPEGTWGREEGRQSEEAR

SEQ ID NO: 14210 - protein, 81 aa, Mandrillus leucophaeus
SQAPVTFEDMAMYLTREEWRPLDPAQRDLYRDVMQENYGNVVSLDFEIRSENEVNPKQEISEDVQFGTSERPAENTEENPE

SEQ ID NO: 14211 - protein, 81 aa, Suricata suricatta
VPSSVAHILFDFPSTGYHGTKPDLIFKLEQGQEPWIINARVSRQSYPENWEDWYQINQDELENVERSYTCSTFGKLHLSRT

SEQ ID NO: 14212 - protein, 81 aa, Mandrillus leucophaeus
MNSVAFEDVAVNFTQEEWALLDPSQKNLYRDVMQETFRNLASIGNKGKDQSIEDQYKNSSRNLSSFQMHQRNHTGEKPYEC

SEQ ID NO: 14213 - protein, 81 aa, Mandrillus leucophaeus
TSKEAVTFKDVVVVFTEEELGLLDLAQRKLYRDVMLENFRNLLSVGHQPFHRDTFHFLREEKFWMMDIATQREGNSGGKIQ

SEQ ID NO: 14214 - protein, 81 aa, Sus scrofa
SQDPMTFEDVAVEFTQWEWEQLDTAQKDLYREVMLENFKNLASLGFPVSKPYVICQLEEGEEPCTVEREISTGAHSDWERR

SEQ ID NO: 14215 - protein, 81 aa, Mandrillus leucophaeus
LQDLVTFKDVAIDFSQEEWQWMNPAQKHLYRSMMLENYQSLVSLGLCISKPCVISLLEQGREPWEMTSEMTRSPFSDWESI

SEQ ID NO: 14216 - protein, 81 aa, Sus scrofa
MDFTLEDWEQLRLDQSNLFWDTALDNYQSLFLLNPPRPNVTSRPDGGKELEALAKGSPESTAPDTAETKTSPLPQDLLAEG

SEQ ID NO: 14217 - protein, 81 aa, Mandrillus leucophaeus
AQESLTLRDVAVDFTWEEWQLLGPAQKHLYRDVMLENYSNLVSVGFQAGKPDALTKLEQGEPLWALEDEIHSPTHPEIEKA

SEQ ID NO: 14218 - protein, 81 aa, Sus scrofa
VKKSLTFKDVAVTFSKDEWKQLVPTQRALYREVMLENYQDFISLGLLLPKADVIFQLKRGDEPWKLEFWEAEERDVPRGLY

SEQ ID NO: 14219 - protein, 81 aa, Sus scrofa
PQGSTPFSSVTVAFTQEGWRQLVPAPRDRFKEGIPEKSRNLVLLGLPVSEPGVNAQLEQRESSWMLEREGLRAACPDWKIV

SEQ ID NO: 14220 - protein, 81 aa, Mandrillus leucophaeus
PLVMAETDPTQGRVVFEDVAIYFSQEEWGHLDEAQRLLYRDVMLENLALLSSLGKALTLAQCPGLGCVVPFYPKAALRFPQ

SEQ ID NO: 14221 - protein, 81 aa, Mandrillus leucophaeus
MAFEDVAVYFSQEEWGLLDTAQRALYRRVMLDNFALVASLGLSTSRPRVVIQLERGEEPWVPSRTDTILSRNTYRRRNPGS

SEQ ID NO: 14222 - protein, 81 aa, Sus scrofa
FKGLVTFRDVALNFSQEEWEWLDSSQKDLYRDVMLENYRNLVWLGLSISKPNMISLLEQGKEPCMVEREMSDGQYADWESW

SEQ ID NO: 14223 - protein, 81 aa, Mandrillus leucophaeus
MDSVVFEDVAVDFTLEEWALLDSAQRNLYRDVMLETFRNLASVDKTQFKANGSVSQQDMYGEEKSKEQTIPNFTRNNSCAY

SEQ ID NO: 14224 - protein, 81 aa, Sus scrofa
QLTFQDVAIEFSEEEWACLDPAQRAFYVDVMLETYRNLLSLDTSHIHGMGKLQPTVNNDRGDVFQTGTLESQESHHMKHFY

SEQ ID NO: 14225 - protein, 81 aa, Sus scrofa
SLERVTFKDVAVDLTQEEWQQMKPAQRNLYRDVMLENYSNLVTVGCQVTKPEVIFKLEQEEEPWVVEEEMLGRHCPGPHSQ

SEQ ID NO: 14226 - protein, 81 aa, Sus scrofa
ALGSVTFRDVAVFFSQDEWLHLDSAQKTLYQEVMLENYSTLVSLGIPFSMPKVICQLQQGEDPCMVEGEALRDPCLDFKTW

SEQ ID NO: 14227 - protein, 81 aa, Sus scrofa
YSLVFEDVAVNFTLEEWVLLDPSQRKLYRDVMRENFRNLVLVESQQEDHVIDDQYKNQGKELRSAMVERLSESKDSNSCGE

SEQ ID NO: 14228 - protein, 81 aa, Sus scrofa
VTFEDVALYFSRDEWRLLDEAQRRLYHDVMLQNFSLISSLGCCCGAEDAESPFQPSMFRDVSQARTLKAASLSQKNHPCEK

SEQ ID NO: 14229 - protein, 81 aa, Sus scrofa
MHENYETVISVALFVFPKPNVIACLEQGEEPWVQRSLEFKDSSEELPAAGLKLKKDTENHQPVCLSDLEIQASVAIASRKA

SEQ ID NO: 14230 - protein, 81 aa, Sus scrofa
GSGRLTFEDLTIEFSQEEWDCLDPAQRALYWDVMLETFRNLLSLGEHRFLRKSGSKRPDEGNDKGMPANHKGSLSEGREPQ

SEQ ID NO: 14231 - protein, 81 aa, Sus scrofa
PQAKVTFEDVAVFLSQEEWDHLGPAQRGLYRHVMMETYGNVVSVGIPGSKPEVISQLERGEEPWVLDRKGAEERRGLGSGC

SEQ ID NO: 14232 - protein, 81 aa, Sus scrofa
MSLNSLGHQRTPSKTIFTENYFPTAVYGLLSINLPGGCSISKPDVITLLEQGKEPWMVVRDEKRRWSLDLESRYDTKKLFQ

SEQ ID NO: 14233 - protein, 81 aa, Neophocaena asiaeorientalis
AQESVMFSDVSIDFSQEEWEYLNDDQRDLYREVMLENYSNLVSMGHSISKPDVISFLEQGKEPWLVDRELTTDQWPVLESR

SEQ ID NO: 14234 - protein, 81 aa, Neophocaena asiaeorientalis
AQETLSFKDVAVDFTWEEWQLLAPPQKDLYRDVMLENYSNLLSVGYRVSKPDAMSKLERGEEPWTIEDEIHSQTCPETGNV

SEQ ID NO: 14235 - protein, 81 aa, Nomascus leucogenys
GKELLSFEDVAMYFTREEWGHLNLGQKDLYRDVMLENYRNMVLLGFQFPKPEVICQLENWDEQWILDLPRAGNRKASGSAC

SEQ ID NO: 14236 - protein, 81 aa, Nomascus leucogenys
MGPLQFRDVAIEFSLEEWHCLDTAQRNLYRNVMLENYRNLVFLGIVVSKPDLITRLEQGKKPSTMKRCEMVANPSGPVLHS

SEQ ID NO: 14237 - protein, 81 aa, Nomascus leucogenys
EAVTFKDVAVVFTEEELGLLDLAQRKLYRDVMLENFRNLLSVGHQPFHQDTFHFLREEKFWMMDIAPQRERNSGGKIQPEM

SEQ ID NO: 14238 - protein, 81 aa, Nomascus leucogenys
SARGMTFEDVAIYFSQEEWELLDESQRFLYCDVMLENFAHVTSLGYCHGAENEAIASEQSVSIQVRTSKGNTPTQKTHLSE

SEQ ID NO: 14239 - protein, 81 aa, Nomascus leucogenys
MLETYSSLVSLGHHITKPEMIFKLEQGAEPWIVEETPNLRLSAVQIIDDLIERSHESHDRFFWQIVITNSNTSTQERVELG

SEQ ID NO: 14240 - protein, 81 aa, Nomascus leucogenys
SYEGSVSFRDVAINFSREEWQHLDLSQRNLYRDVMLETYSHLLSVGYQVPKPEVVMLEQGKESWALQGERPRHSCPGEKLW

SEQ ID NO: 14241 - protein, 81 aa, Nomascus leucogenys
SQASVSFKDVTIEFTQEEWQQMAPVQKNLYRDVMLENYSNLISVGYCHFKPEVIFKLEHGEEPWFSEEEFSNQSHPKDYRG

SEQ ID NO: 14242 - protein, 81 aa, Canis lupus
VQESLTLEDVAVDFTWEEWQLLGPAQKNLYRDVMLENYRNLVSVGCQATKPDALSKLEHRDEPWITEDEIQSRTHTGFGKL

SEQ ID NO: 14243 - protein, 81 aa, Canis lupus
LQEPVTFRDVAVDFTQEEWGQLGPAQRTLYRDVMLETFGHLLSLGPELPKPEVISQLEQGAELWAAEREIAQGYCPGREPG

SEQ ID NO: 14244 - protein, 81 aa, Canis lupus
WKELLSFDDVAMYFTREEWNRLDWAQKDLYRDVMLENYRNMILLGFQFPKPEVIYLLEQWEEPWILDLPRAGTRKATSSAC

SEQ ID NO: 14245 - protein, 81 aa, Capra hircus
PKVPVSFEDVAMYFTKTEWKLLDHRQRKLYKQVMLENYHHLVSLGFSFAKPQLVIQLEQGQKPWVADVHRMRITTGMQAGD

SEQ ID NO: 14246 - protein, 81 aa, Capra hircus
ARESVMFSDVSIDFSLEEWEFLNLEQRDLYRDVMLENYSNLVSLGCFISKPDVISLLEQGKEPWNVVRKGRRQYPDLETNY

SEQ ID NO: 14247 - protein, 81 aa, Capra hircus
VVFEDVAVDFTQEEWALLNLAQRNLYRDVMLENFRNLASLGFEIQLKIDESVAPQDTYGKISNEQDVVGFKRSDSSLSILH

SEQ ID NO: 14248 - protein, 81 aa, Capra hircus
NVGSLTFSDVAIGFSQQEWECLDPVQKTLYRDVMMENYGNLVSLAGHSISKPNVITLLEQGKEPWIVVREETRSWCTDLDS

SEQ ID NO: 14249 - protein, 81 aa, Capra hircus
RSEGQLTFQDVAIDFTQEEWECLDLGQRELYRDVMLQNYGNLASLGLVSKLDLVAFLEQLKDPRNIKRMETTAIYPAMSPQ

SEQ ID NO: 14250 - protein, 81 aa, Capra hircus
PLQVSVSFRDVAVDFSREEWQQLDLDQKNLYRDVMLETCSHLLSIGYQVPEIEVFMLEQGKEPWALQGEGPYQSCPGEKLQ

SEQ ID NO: 14251 - protein, 81 aa, Chrysochloris asiatica
SKAPVTFGDLAIYFSQEEWEQLSPMQRDLYEEVMLENYRNLVSLGLSIRRPNVITLLEKGKAPWLVEPARRRRGPDSGSAF

SEQ ID NO: 14252 - protein, 81 aa, Chlorocebus sabaeus
VTFKDVAVDLTQEEWEQMKPAQRNLYRDVMLENYSNLVTVGCQVTKPDVIFKLEQEEEPWVMELSLSSLDEGISCCTHCLQ

SEQ ID NO: 14253 - protein, 81 aa, Chrysochloris asiatica
PKGLLTFEDVAVFFTQEEWDYLDPAQRSLYKDVMMENYGNLVSLDVLSKDNDEEPIVKQEIEEIEEVEPQSVIVTRIKSEI

SEQ ID NO: 14254 - protein, 81 aa, Chlorocebus sabaeus
GCFISKPDVISLLEQGKEPWKVVRKGRRQYPDLETKYETKKLSLENDIYEINLSPWKIMERIKNHGLKGLILKHDWESTGK

SEQ ID NO: 14255 - protein, 81 aa, Suricata suricatta
RLHKSGTSEDVAVYFTRQEWASLVPAHRALYRDLMLENGGNAFLASPTSKPAISQLEQGRELCFTQPQGALSRRSKRAGPK

SEQ ID NO: 14256 - protein, 81 aa, Suricata suricatta
SQGLVSFKDVAVDFTQEEWQQLGPAQRTLYRDVMLENFSHVVSVGYPVSKPDVISKLEQGEDPWIIKRDVSNWIYTDENRA

SEQ ID NO: 14257 - protein, 81 aa, Chrysochloris asiatica
VDSVVFDDVAVVFSPEEWALLNLAQRKLYRDVMKETLSNLDSCESIDRVCRYQTLRECCEFGKAFKHPATSHVGFNICQCV

SEQ ID NO: 14258 - protein, 81 aa, Suricata suricatta
LQEPVTFRDVAVDFTQEEWGQLGPAQRTLYRDVMLETFGHLLSVGPELPKPEVISQLEQGAELWAAERGIAQGHCPGWEPG

SEQ ID NO: 14259 - protein, 81 aa, Suricata suricatta
PQAKVTFEDVAVLLSQEEWDRLGPAQRGLYRHVMMETYGNVVSLGLPGSKPNVICQLERGEEPWVLDGQGAEETRGLGSGH

SEQ ID NO: 14260 - protein, 81 aa, Chlorocebus sabaeus
QELVKFRDVAVVFSPDEWDHLNPEQRNLYRDVMLDNCKYLASLGNWTYKAHVMSSLKQGKEPWMMEREVTGVPCPGAYTTG

SEQ ID NO: 14261 - protein, 81 aa, Chrysochloris asiatica
EMDSVVVEDVAVVFSQEEWALLDVAQRKLYRDVMMETFRNLALEETRKVCDDKDQNKIQGSDSRNRILENLCESNEGSQSE

SEQ ID NO: 14262 - protein, 81 aa, Chlorocebus sabaeus
FQEPLKFRDVAVEFSLEEWQCLDTIQQNLYRNVMLENYRNLVFLGIAVSKPDLITCLEQEKEPWTRKRHRMVAKPVTCSHF

SEQ ID NO: 14263 - protein, 81 aa, Chrysochloris asiatica
VEDSLTLEDVTVKFTREEWQLLAPAQKALYRDVMLENYSHLVSLGYQLSKPDALSTLERGEPPWTIEDGLHRPACTDDMLL

SEQ ID NO: 14264 - protein, 81 aa, Chrysochloris asiatica
TQDHKSKGLSPEDTDRSQEEERKSPILEPVTFEDVTVVFTEEEWNMLNSEQKSLYREVMLETYRNLLSLGEGVLSFPPLIQ

SEQ ID NO: 14265 - protein, 81 aa, Chrysochloris asiatica
LQKASWKLLSFEDVALFLTREEWENLDWAQKYLYRDVMMENYRSMIFLGFQFPKPEVISQLEDWDEPWILDLPRAWNRTTS

SEQ ID NO: 14266 - protein, 81 aa, Suricata suricatta
FHESVTFKDVIVDFTQEEWKQLDPGQRDLFRDVTLENYTHLVSIGLQVSKPDVISHLEQGTEPWVVEPGVPGAARGDRDTR

SEQ ID NO: 14267 - protein, 81 aa, Suricata suricatta
PHTPVTFKDVLVNFSREEWKLLDTAQQVMYRDVMLENYKNLTSLGHQLPKPDVILHLEKGEEPWLVGRGIQQEARPDVDTA

SEQ ID NO: 14268 - protein, 81 aa, Chlorocebus sabaeus
MFENYRNLVFLGIAVSKPHLITCLEQGKEPWNRKRQEMVAKPPVIYSHFTEDLWPEHSIKDSFQKVILRGYGKCGHENLQL

SEQ ID NO: 14269 - protein, 81 aa, Chrysochloris asiatica
SQELLTFRDVAVEFSQEEWDCLDPAQRALYWDVMLENYSNLVALEVSLSEMNIVSILKKGTEPWTVENEMKIVKNPGKSDC

SEQ ID NO: 14270 - protein, 81 aa, Sus scrofa
AHGSVMFSDVSIDFSQEEWEYLNLEQRDLYRNVMLENYSNLVSLGCFISKPDVISLLEQGKEPWKVVRKGRRPYSGLETKK

SEQ ID NO: 14271 - protein, 81 aa, Mandrillus leucophaeus
QAEVTFEDVAVFLSREEWGRLGPAQRGLYRDVMLETYGNLVSLGVGPAGPKPGVISQLERGDEPWVLDVQGTSGREHLKVN

SEQ ID NO: 14272 - protein, 81 aa, Mandrillus leucophaeus
KSQESLTLEDVAVEFTWEEWQLLGPAQKDLYRDVMLENYSNLVSVGYQASKPDALSKLEQGEPWTVENEIHSQICPEIKKV

SEQ ID NO: 14273 - protein, 81 aa, Sus scrofa
AQGQVTFEDVAVCFSQEEWGLLDETQRLLYRSVMLETFSLMASLGLTSSRTHDISQLERWGEPFLSASGAMRATRPTGCWH

SEQ ID NO: 14274 - protein, 81 aa, Mandrillus leucophaeus
AQGCVTFEDVTIYFSQEEWGLLDEAQRLLYCDVMLENFALIASLGLISFRSHIVSQLEMGKKPWVPDSVDMTSAMARGAYG

SEQ ID NO: 14275 - protein, 81 aa, Sus scrofa
LQGSVSFEDVAVDFTRQEWHRLDPAQRTMHKDVMLENYSNLASVGLCVAKPEMIFKLERGEELWILEEESCGHGYPGSLSL

SEQ ID NO: 14276 - protein, 81 aa, Sus scrofa
SQGSLSFEDVTVEFTQDEWRFVGPAQRSLYRAVMLENYSHLVSLGCCITKPQVIFKLEQGEEPWSSEEEFLNQSIPGYYKV

SEQ ID NO: 14277 - protein, 81 aa, Sus scrofa
MLENYGNVASLGFPLLKPAVIAQLEGGVELGGPSPLASGTGSGPEDLWTDIEIQTDNNLTEDMYEEKHNTSFELQRDFSQE

SEQ ID NO: 14278 - protein, 81 aa, Mandrillus leucophaeus
KVPVTFVDIAVYFSEDEWKNLDEWQKELYNNLVKENYKTLMSLDAEGPVPKPDAPTQPEPREEPCVWEQRHPEEREISMDP

SEQ ID NO: 14279 - protein, 81 aa, Sus scrofa
FQESVTFKDVIVDFTQEEWKQLDPVQRDLFRDVTLENYTHLVSIAGLQVSKPDVISQLEQGTEPWIVEPSIPVGTFGDWET

SEQ ID NO: 14280 - protein, 81 aa, Mandrillus leucophaeus
AQTLLTFRDVAIEFSLEEWKCLDPAQQNLYRDVMLENYRNLFSIGLTVSKPGLITCLEQRKEPWNVKRQEAVDGHPAMSSH

SEQ ID NO: 14281 - protein, 81 aa, Mandrillus leucophaeus
FQASVSFKDVTVEFTQEEWQHMGPVERTLYRDVMLENYSHLVSVGYCFTKPELIFTLEQGEDPWLLEKEKGFLSRNSPEDS

SEQ ID NO: 14282 - protein, 81 aa, Sus scrofa
AQELVTFEDVAVYFIRKEWKRLEPAQRDLYRDVMLENYGNVFSLDGETRTEHDPEISEDSGPHGVLLGRFQKDISQGLKFE

SEQ ID NO: 14283 - protein, 81 aa, Mandrillus leucophaeus
EMGPLTFRDVAIEFSLEEWQCLDTSQQNLYRNVMLDNYRNLVFLGIAVSKPDLIICLEQGKEPCNMKRHAMVAKPPVVCSH

SEQ ID NO: 14284 - protein, 81 aa, Sus scrofa
LLVTVTFKDVAIDFTQEEWQQLDPAQRNLYRNVMLENYNNLITVGCPFTKPDVIFKLEREEEPWVVEEEVFKRHCPGEIWG

SEQ ID NO: 14285 - protein, 81 aa, Mandrillus leucophaeus
DSVTFEDVAVDFTQEEWTLLDQTQRNLYRDVMLENYKNLVAVDWESHINTKWSAPQQNFLQGKTSNVVEMSHTLSPRQECS

SEQ ID NO: 14286 - protein, 81 aa, Sus scrofa
ALALVSFEDVAITFTGEEWRHLDLAQRTLYQEVMLETCGLLVSLGHPVPKPELIHLLEHGQELWTVKRGHSKSTCADEETE

SEQ ID NO: 14287 - protein, 81 aa, Sus scrofa
MLENYKSIVSLGLPVPGPDVIFQLKRGDEPWIEELHGSEGKECAENVYLDWKTKPEIQGASEEEKSEGTLRGKLERKDPVS

SEQ ID NO: 14288 - protein, 81 aa, Bos mutus
SLAFEDVAVNFTLDEWVLLDSSQRKLYRDVMRENFRNVVSVEAKQEDQDIDDQDKNQERKLRNPKAERHSEKKDINSSEES

SEQ ID NO: 14289 - protein, 81 aa, Bos mutus
FQGRMTFQDVAIDFTQEKWECLDLDQRELYRDVMLEKYGNLASLELPLLKIHSLGRRPWKQQDKHKRCYFHQSVRGKKRLD

SEQ ID NO: 14290 - protein, 81 aa, Neophocaena asiaeorientalis
TKGCVTFEDVAIYFSQEEWGLLVEAQRCLYHKVMLENFLLTASMVCLHGTEKKETPSEQNVSLEVLSQVRTPKVGPISQKA

SEQ ID NO: 14291 - protein, 81 aa, Neophocaena asiaeorientalis
PQDSVTFKDVAIDFSQEEWEWLNPAQRSLYRSMMLENYQSLVSVGLCISKPYVISLLEQGKEPWEMKSEMRRTPFPDWESV

SEQ ID NO: 14292 - protein, 81 aa, Bos mutus
WQESVTFKDVAVDFTLEEWGRLGPGQRELYRDVMLENYQNLLSLGFPGAKPDVISHLERGEEPRMERRETQQVTCPGGLCV

SEQ ID NO: 14293 - protein, 81 aa, Bos mutus
RLVVEFEVICPQNSPVMPSVDSNQGYRNRDRLEFEVYPNSSDFYLIGHPVSKPDVISKLEQGEDPWIIKRDIPNWICPYEG

SEQ ID NO: 14294 - protein, 81 aa, Nomascus leucogenys
CYQDSVTFDDVAVDFTQEEWTLLDSTQRSLYSDVMLENYKNLATVGGHIIKPSLISWLEQEESRTVNGGVLQGWEMQLEAQ

SEQ ID NO: 14295 - protein, 81 aa, Nomascus leucogenys
MVQESVTFKDVAVLFTQEEWGQLSPAQRALYRDVMLENYSNLVSLGLLGPKPDMFSQLEKREVWMPEDTPGGFCLDWMTMP

SEQ ID NO: 14296 - protein, 81 aa, Nomascus leucogenys
PRGSTFFSSVTVAFAQKGWRCLVSTPRDKFKEGIPGKCRNLVLLGLPVSQPGMNSQLEQREGTWMLEGEDLRSPSPGWKII

SEQ ID NO: 14297 - protein, 81 aa, Nomascus leucogenys
MLETYSHLLSVGYQVPEAEVVMLEQGKEPWALQGERPRHSCPGEKLWDHNQCRKILSYKQVSSQRQKMYPGEKAYECTEFE

SEQ ID NO: 14298 - protein, 81 aa, Nomascus leucogenys
LQGLVTFEDVAVEFTQEEWALLDPAQRTLYRDVMLENCRNLASLGCRVNKPSLISQLEQDKKVMTEERGILPSTCPDLETL

SEQ ID NO: 14299 - protein, 81 aa, Capra hircus
RLTSEDVAIKFTQEEWEFLDPAQRALYRDVMLETYRNLLSVDISPTHVIKHLQPKVNSDKRETFRTLMLGSPENCEIKHFH

SEQ ID NO: 14300 - protein, 81 aa, Capra hircus
SQGRLRFQDVAIDFTLEEWECLDLGQRELYRDVMLENYGNLASLGLIVCKPDLVTFLEKMRDPQDVRGIETTAIHPDLASF

SEQ ID NO: 14301 - protein, 81 aa, Capra hircus
VVTFEDVAVYFTRTEWAGLSPAQRALYRSVMLEIYGNLTSLGYPVPKPALVSLLERGDLPVGLETQDNPPAQGTRDIYKNA

SEQ ID NO: 14302 - protein, 81 aa, Capra hircus
SVTFPDVAVYFSWEEWRLLDEAQRRLYLDVMLENYALISSLGCCCGTENPEAPSQQITSLGVSQARTPKAALSTQKMNPCE

SEQ ID NO: 14303 - protein, 81 aa, Capra hircus
APLPLTFEDVAVYFSEQEWQNLEAWQKELYKQVMRANYEILLSLDNGLPKPELISWIEQGRELFKKWGESQESRNIICSGA

SEQ ID NO: 14304 - protein, 81 aa, Chrysochloris asiatica
PQGSVSFKDVTVNFTQEEWQQLDPAQKALYKDVMLENYCHLISVGSHMTKPDMIRKLEQGEELWTTERVYPSQTYLEEDGK

SEQ ID NO: 14305 - protein, 81 aa, Suricata suricatta
MDTSQRTLYRDVTLENISHLVSVGMKNNHNKEEIIPMQDICTKDPPNCWTVKCHAGEDLCLYSGYDEIFTHAYTLTQHVLN

SEQ ID NO: 14306 - protein, 81 aa, Chlorocebus sabaeus
GEEPVTFEDVAVDFTKEEWQQLNPAQKTLHRDVMLETYSHLVSVGCSGIKPDVIFKLEHGKDPWIIESELSRWIYSDRVKG

SEQ ID NO: 14307 - protein, 81 aa, Suricata suricatta
RPRAVKFADVAVYFSTEEWGCLRPAQRALYRDVMRETYGHLGALGCAGPKPALISWLERNTDDWEPAALDPQECPKRVTVQ

SEQ ID NO: 14308 - protein, 81 aa, Chlorocebus sabaeus
MVTFKDVAVVFTREELGLLDLAQRKLYQDVMLENFRNLLSVGYHPFKLDVILQLGREDKLWLMETEIQGDGCSGHRNQKEI

SEQ ID NO: 14309 - protein, 81 aa, Chlorocebus sabaeus
MLETYGNLVSLGVGPAGPKPGVISQLERGDEPWVLDVQGTSGREHLKVNSPALGTRTEYKELTSRETFGKEELGQLRGIFP

SEQ ID NO: 14310 - protein, 81 aa, Suricata suricatta
AEGCVTFEDVTIYFSQEEWGLLDEAQRLLYCDVMLENFALIASLGLTSFRSHIVAQLEMGAEPWVPDRVDMTSAMARGVYS

SEQ ID NO: 14311 - protein, 81 aa, Suricata suricatta
GGCLCLPQREVYGDVMLEIYGHLLFLGLVVSKPDLVIFLEQKRELWDVKRKETVASYPGSALEDGHLMRDRNKDGDSEGRQ

SEQ ID NO: 14312 - protein, 81 aa, Suricata suricatta
SQELVTFEDVAVYFIRKEWKRLEPAQRDLYRDVMLENYGNVFSLDGETRTEHDQGISEDTGSHGVLLGRFQKDISQGLKFE

SEQ ID NO: 14313 - protein, 81 aa, Suricata suricatta
PVTFEDVALYLSREEWGRLDHAQQNFYRDVLQKRNGLSLVSPVSFWPGFPFSRPFWAQGQGKGEASSSWRQMGVEEKTGAV

SEQ ID NO: 14314 - protein, 81 aa, Suricata suricatta
QGSVTFEDVALYFSWEEWDLLDEAQRCLYHDVMLETFALTSSLGCGHGVEDEDAPSEESISVGVSQIRTLKAYSSPQKAQP

SEQ ID NO: 14315 - protein, 81 aa, Suricata suricatta
DQESLTLEDVAVDFSREEWQLLAPAQKDLYRDVMLENYRNLVSLGYQASTPDALCMLERGEGPWATGEAVRGGARPETRKV

SEQ ID NO: 14316 - protein, 81 aa, Suricata suricatta
LQEAFSFEDFSVDFTQKEWQLLDHSQKDLYKDVMLENYSSLVSLGYEIMKPDVIFKLEQGEEPWVGDGEVPSVDCSEHVWQ

SEQ ID NO: 14317 - protein, 81 aa, Suricata suricatta
KPGVLTFADVAVYFSSEEWGCLRPAQRALYRDVMRETYGHLGALGCAGPKPALISWLERNTDDWEPAALDPQECPKRVTVQ

SEQ ID NO: 14318 - protein, 81 aa, Chlorocebus sabaeus
LKAFVAFRDVAVDFTQEEWRLLSPAQRTLHREVMLETYNHLVSLEIPFSKPKLIAQLERGEEPWREERRCLLDLCPESKPE

SEQ ID NO: 14319 - protein, 81 aa, Suricata suricatta
ARIPVTFDDVAVTFTEEEWGQLDPAQRTLYREVLVETCRLLVSLGSPLPKPELIYSLEQSPELRTLQRGLFPSNPGDNAKP

SEQ ID NO: 14320 - protein, 81 aa, Chlorocebus sabaeus
QGLLTFRDVAIEFSQEEWKCLDPAQRTLYRDVMLENYRNLVSLDISSKCMMKDFLSTAQGNTEVIHTRTLERHHIGDFCFQ

SEQ ID NO: 14321 - protein, 81 aa, Mandrillus leucophaeus
SQGSVTFTDVAIDFSQDEWEWLNLAQRSLYKKVMLENYRNLVSVGLCLSKPDVISLLEQEKDPWVIKGEMTRSLCPDLECV

SEQ ID NO: 14322 - protein, 81 aa, Sus scrofa
GLLTFEDVAVFFTQEEWDYLDPAQRSLYKDVMMENYGNLVSLDVLNRDKDEAPTVKQEIEEIEEEVEPQSVIVTRIKSEID

SEQ ID NO: 14323 - protein, 81 aa, Chlorocebus sabaeus
QGPLTFMDVVIKFSPEEWQFLHTAQQNLYRDVMLENYRNLVFLGIGVPKPDLITCLEQGKEPWNMKRHKMVAKPPVVYSHF

SEQ ID NO: 14324 - protein, 81 aa, Mandrillus leucophaeus
DSVTFDDVAVDFTQEEWTLLDPSQRDLYRDVMLENYENLASVGHDLFKPGVICWLEEEEKLRAEQRGVLQEWRLKTKGPAL

SEQ ID NO: 14325 - protein, 81 aa, Mandrillus leucophaeus
AQESVTLEDVAVDFTWEEWQLLGPAQKDLYRDVMLENYSNLVAVGYQASKPDVFFKLEQGEPPWTIEDGIHSGACSKGFIQ

SEQ ID NO: 14326 - protein, 81 aa, Mandrillus leucophaeus
VQESVTFRDVAVFFSQDEWLHLGSAQRALYREVMLENYSSLVSLGILFSKPKVISQLEQGEDPWMVESGVPQGAHLGWESL

SEQ ID NO: 14327 - protein, 81 aa, Sus scrofa
VREPLTFEDVAVNFTQEEWQQLDPAQKTLHRDVMLEIYSHLVSVGCSGIKPDIISKLEHGEDPWIRESELPRWTYSDREKS

SEQ ID NO: 14328 - protein, 81 aa, Mandrillus leucophaeus
MYFSQEEWELLDPTQKALYNDVMQENYETVISLALFVLPKPKVISCLEQGEEPWVQVSREFKDSAGKSPTGLKLKNDTENH

SEQ ID NO: 14329 - protein, 81 aa, Sus scrofa
AHGSVTFRDVAIDFSQEEWEFLDAAQRDLYRDVMWENYSNFISLDLESRYRTNTLSPEKDIYEIYSFQWEIMERIKSYSLQ

SEQ ID NO: 14330 - protein, 81 aa, Mandrillus leucophaeus
MGPLQFRDVAIEFSLEEWHCLDTAQRNLYRDVMLENYRNLVFLGIVVSKPDLITCLEQGKKPLTMKRHEMIAKPPGQAWWL

SEQ ID NO: 14331 - protein, 81 aa, Sus scrofa
FHSSVSFEDVTVDFSREEWQHLDPAQRRLYRDVTLENYSHLRSVGYHVPKPEVICKLEQGEGPWTLEEETPHQSYSGERNI

SEQ ID NO: 14332 - protein, 81 aa, Mandrillus leucophaeus
GDEPVTFRDVAIYFSREEWACLEPSQRALYRDVMLDNFSSMAALGFCSPRPDLVSRLEQWEEPWVEDRERPELQAVQRGHW

SEQ ID NO: 14333 - protein, 81 aa, Mandrillus leucophaeus
VTFEDIAIYFSQEEWGLLDEAQRRLYLEVMLENFALVASLGCGHGTEDEETLSEQNVSVRVSQSKAGSSTQKTQSCEMCVP

SEQ ID NO: 14334 - protein, 81 aa, Mandrillus leucophaeus
MVEGEEEWQQLNPAQKTLHRDVMLETYSHLVSVGCSGIKPGVIFKLEHGKDPWIIESELSRWIYSDRVKGLESSQQIISGE

SEQ ID NO: 14335 - protein, 81 aa, Sus scrofa
NFWILRLPPGSKGEAPKEWGKLDEWQKELYKHVMRGNYETLVSLDYAISKPEVLSQIEQGKDPCSWRRAGPKVPDVPVDPS

SEQ ID NO: 14336 - protein, 81 aa, Mandrillus leucophaeus
IWGPLSFMDVFVDFTWEEWQLLDPAQKCLYRNVMLENYSNLVSLGYQHTKPDIIFKLEQGEELCVVQAQIPNQSCPILKAG

SEQ ID NO: 14337 - protein, 81 aa, Sus scrofa
WQGCVISEGVFVYFSLEEWKLLDEAQRRLYRDVMLENLALLASLGCWCGVEGEVISSEHNDSLERVSQCHRTPMAHLKTYS

SEQ ID NO: 14338 - protein, 81 aa, Sus scrofa
SLGSVSFKDVIVDFSREEWQQLDRVQKSLYRNVMLENYFNLISVGCQVPKPEVIFNLEWGEEPCMLGGEVSSLSCVDQVIG

SEQ ID NO: 14339 - protein, 81 aa, Mandrillus leucophaeus
MGPLQFRDVAIEFSLEEWHCLDTAQRNLYKNVMLENYSNLVFLGIVVSKPDLITRLEQGKKPLTMKRHEMVAKPPGPGMIV

SEQ ID NO: 14340 - protein, 81 aa, Mandrillus leucophaeus
CEASLSFEDVTVDFSREEWQQLDPAQRRLYQDVTLELYSHLFSVGYHIPNLDVIFRMLKEKEPCVEEAELSHQRYQGLAQL

SEQ ID NO: 14341 - protein, 81 aa, Sus scrofa
LKREGSTLANLKAMPQEEWQQLDPAQKALYRDVMLENYCHLISVGFHMTKPDMIRKLEQGKELWTTEKIFPSQSYPEEDGT

SEQ ID NO: 14342 - protein, 81 aa, Sus scrofa
FQGSLSFKDVAVGFTRKEWQQLDSAQRTLYREVMLENYSHLVSVGCQVTKPAVISRLEQGQEPWMKEEEILRWSLPFLPSF

SEQ ID NO: 14343 - protein, 81 aa, Sus scrofa
LQEPVTFRDVAVDFTQEEWGRLGPAQRILYRDVMLETFGHLLSVGPELPKPDVISQLEQGAELWVAERGIAQGCCPGWEPG

SEQ ID NO: 14344 - protein, 81 aa, Bos mutus
RESGKAPVMFDDITVYLLQEEWVLLSQQQKDICGSDKLVAPLGSTIASPELFYKFEQGPEPWLASVQGQRSHLSPNPGKTK

SEQ ID NO: 14345 - protein, 81 aa, Neophocaena asiaeorientalis
TQEPVVFEDVAVDFTQEEWALLDPAQRNLYRDVMLENFWNLASLGYPLHTPYLISQWKQEEDLEIAERGPTQGEHQEGFET

SEQ ID NO: 14346 - protein, 81 aa, Bos mutus
MSYVSHQYTPLSSRYCFTKPELIFMLEQGEDPWLLEKEFINRSSPEEFQPDELLEESLENQGKRLRQVLFINKSLTMEQEI

SEQ ID NO: 14347 - protein, 81 aa, Neophocaena asiaeorientalis
PQVLVSFEEVAVLLSQEEWGHLGPDQKRLYRDVMLETYGNLVSLGLQGSKPDVISKLEQGEEPWAPHSPRIEGSWIWRRRR

SEQ ID NO: 14348 - protein, 81 aa, Bos mutus
GLMTFEDVAVDFTQEEWQYLNPPQRTLYRDVMLETYSNLVSVGHRVTKPDLILKLEVEEKCLPEGKIPIWSFPDLEEELPV

SEQ ID NO: 14349 - protein, 81 aa, Bos mutus
PEFLCLKMLLAYVELNMPDSDLEQRARHLLEQLVTLEPTEAEGHGFCITKPEVIFRLEQGEEPWILEEEFLSQSFSEVWKT

SEQ ID NO: 14350 - protein, 81 aa, Neophocaena asiaeorientalis
AQESLTYDDVAMKFTWEEWQLLDPDQKDLYRDVMLENYSNLLSVGYQASKPAVLSRLERGEQLWPVEDDSHGRICPEIRKV

SEQ ID NO: 14351 - protein, 81 aa, Bos mutus
QGGVTFPDIAVRFSQREWRLLDETQRLLYLDVMLENYTLISSLVTQCRSTSPSRNHTSGNCEKAFGSEHTLVQDWSVYTER

SEQ ID NO: 14352 - protein, 81 aa, Neophocaena asiaeorientalis
AQGLVTFEDVAVHFSKEEWGLLDAAQRQLYHSVMLENLELMTSLGCWHGVEDEEVCSKQDASVDVVSQVRIFSAHPSTQKA

SEQ ID NO: 14353 - protein, 81 aa, Nomascus leucogenys
SQGIVTFKDVAIDFTQEEWKRLDPAQRNLYRNVMLENYNNLITVGYPFTKPDVIFKLEQEEEPWVMEEEILRRHWQGEIWG

SEQ ID NO: 14354 - protein, 81 aa, Nomascus leucogenys
KPGAVSFADVAVYFSREEWGCLRPAQRALYRDVMRETYGHLGALGVGGSKPALISWVEEKAELWGPAAQDPKVAKCPTEAD

SEQ ID NO: 14355 - protein, 81 aa, Nomascus leucogenys
TARSQETVTFKDVAMDFTPEEWGKLDPAQRDVMLENYRNLVSLWLPVSKPENHNLEHGKEPLKLERKAPKSSYSAVAVITL

SEQ ID NO: 14356 - protein, 81 aa, Nomascus leucogenys
LLTFRDVAIEFSQEEWKCLDPAQRTLYRDVMLENYRNLLSLDIFSKCEIKELPPKKKSNTGEVFQTAMLERHESHDIQDFC

SEQ ID NO: 14357 - protein, 81 aa, Nomascus leucogenys
STEPVTFRDVAIYFSREEWACLEPSQRALYRDVMLDNFSSVAALGFCSPRPDLVSRLEQWEEPWVEDRERPELQAVQRGPR

SEQ ID NO: 14358 - protein, 81 aa, Nomascus leucogenys
DVAIDFSHEEWACLDSAQRDLYKDVMVQNYENLVSVAGLSITKPYVITLLEVGKEPWRVEKKLSKVSFFSHTVSSIMSILP

SEQ ID NO: 14359 - protein, 81 aa, Nomascus leucogenys
QEVVTFGDVAVHFSREEWQCLDPGQRALYREVMLENHSSVAGLGEAEFLVFKHELISRLEQGEEPWVLDLQGAEGTEAPRT

SEQ ID NO: 14360 - protein, 81 aa, Nomascus leucogenys
YQEMVTFEDVAVHFTKTEWTGLSPAQRALYRSVMLENFGNLTALGYPVPKPALISLLEGGDMDWGLEAQDDPPAERTKNVC

SEQ ID NO: 14361 - protein, 81 aa, Nomascus leucogenys
AQESVTFEDVAVNFTNREWQCLTYAQRHLYKDVMLENYRNMASLGFPFPKPPLISHLEREVDPCVQDPQDRESLSCFYPVS

SEQ ID NO: 14362 - protein, 81 aa, Nomascus leucogenys
LQELLTLEDVTVEFTWEEWQLLDPFQKDLYRDVMLEIYSNLVSIGYQVSKPDALSKLERGEEPWTVEDERHSQICPVDDHL

SEQ ID NO: 14363 - protein, 81 aa, Nomascus leucogenys
TQGPLKFMDVAIEFSQEEWKCLDPAQRTLYRDVMLENYRNLVSLGICLPDLSVISMLEQKKDPWTLQSEEKIANNPDSREC

SEQ ID NO: 14364 - protein, 81 aa, Nomascus leucogenys
MLENYGAVASLAAFPFPKPALISQLERGEAPWCSLPQGALDGEAPRGISSGEILKLPGATIWSLRIKPIPKKTVTKQRETW

SEQ ID NO: 14365 - protein, 81 aa, Bos indicus
SVTFEDVVVYFSWEEWGLLDENQRCLYHDVMLENFALVTSLGCWYGMEEAVAFSVESVPVEQTSRGKTVVPYPSMEKTQPC

SEQ ID NO: 14366 - protein, 81 aa, Bos indicus
AHGSLTFSDVAIGFSQQEWECLDPVQKTLYRDVMMENYGNLVSLGHSISKPNVITLLEQGKEPWLVVREETRSWCTDLDSR

SEQ ID NO: 14367 - protein, 81 aa, Bos indicus
YQRPVSFKDVVVGFTQEEWHGLNPAQRALYRDVMLETYSNLVSVGYEGTKPYVILRLEQEEAPWICEAACLGCHCWENIWQ

SEQ ID NO: 14368 - protein, 81 aa, Bos indicus
AQGSVVFSDVSIDFSQEEWEFLNPAQRDLYRDVMLENYSNLVSMGLYIPKPQVISLLEQGKEPWMIGRELTRGLCSALESM

SEQ ID NO: 14369 - protein, 81 aa, Zalophus californianus
MLAFPFPKPDLVSQLERGEAPWSPDPWEAEVLKGTCPGGEFWIKEEEPAVKQETSEEAELPRMPGGGLLRNVSQHFDFKSK

SEQ ID NO: 14370 - protein, 81 aa, Zalophus californianus
MAHLMMFRDVAIDFSQEEWECLGLEQRHLYRDVMLENYSNMISLGLCIYQPDVFSLLEKGKEPWMVLQDETRGPCPDMQSR

SEQ ID NO: 14371 - protein, 81 aa, Zalophus californianus
SQGPVSFKDVAVDFTQEEWQYLDLPQRNLYRDVMLENYINLISVGYQTTKPSVIHKLEQGEEPWMVEREIPNWNYAEVWQL

SEQ ID NO: 14372 - protein, 81 aa, Zalophus californianus
MLENFSHLVSMGYPVSKPDVISKLEQGEDPWIIKRDIPNWIFPNENQDDGRQDRKSNLDNPKACILGSVSFRNNILKGVTK

SEQ ID NO: 14373 - protein, 81 aa, Equus caballus
GGSMMFRDVSINFSQEEWECLDSGQMNLYKEVMLENFSNLVSVVIFTYEDMPTFIHPTFLIPHQKTINEKKPYECKICGKA

SEQ ID NO: 14374 - protein, 81 aa, Equus caballus
SLVFEDVAVNFTPEEWALLDGAQRKLYRDVMLETCRNLASVGEDGFTVPPILNRSHLLESLHGCNGGDGCGETLKQITDLP

SEQ ID NO: 14375 - protein, 81 aa, Equus caballus
WKELLSFEDVALFFTREEWNQLDWAQKDLYRDVMLENYRNLILLGFQFPKPEVICQLEQWEEPWILDLPRAGTRKASGSAC

SEQ ID NO: 14376 - protein, 81 aa, Equus caballus
KAEPLTFQDVAVYFSRAEGRQLGPDQRALYRDVMLENYGHVASLGLPVPKPELILQLEQGKELWVLDLLGAEEPVALSSCR

SEQ ID NO: 14377 - protein, 81 aa, Chrysochloris asiatica
LAPVTFEDVTVVFTEAEWVTLSMEQKNLYKEVTLETYRNLLSLAEPMPETYPGPSCLLPFSCQQFLSQHVLQIFPGVCAEH

SEQ ID NO: 14378 - protein, 81 aa, Chlorocebus sabaeus
FQDLVTFGDVAVNFSQEEWEWLNPAQRNLYRKVMLENYRSLVSLAGVSVSKPDVISLLEQGKEPWMVKKEGTRGTCPDWEY

SEQ ID NO: 14379 - protein, 81 aa, Suricata suricatta
VQGHVTFEDVAVYFSQEEWGLLEEAQRLLYRDVMLETLTLMASLGYESSTSRTDASLELGIKPWESDWADLTPARTREAQG

SEQ ID NO: 14380 - protein, 81 aa, Suricata suricatta
AQAPLSFEDVAVGFSPEEWQLLAPAQKDLYRDVMLENYRNLVSLGYQASKPDSLFQLEHGGPPWAVGGAAPRPPCAEEIWE

SEQ ID NO: 14381 - protein, 81 aa, Mandrillus leucophaeus
KPVTFEDVAVNFTQEEWDCLDASQRVLYQDVMSEIFKNLASVEGKKKELREQHPSLRDEGTSDDKVFFACRGAGQCPLSAP

SEQ ID NO: 14382 - protein, 81 aa, Sus scrofa
MTFEDIAVYFSWEEWRLLDETQRRLYLDVMLDNYALISSLGCCCGAEDAESPFQPSMFRDVSQARTLKAASLSQKNHPCEK

SEQ ID NO: 14383 - protein, 81 aa, Mandrillus leucophaeus
MGLLTFRDVAVEFSLEEWEHLEPAQKNLYQDVMLENYRNLVSLGLLVSKPDLITFLEQRKEPWNVKREETVAVQPDVFSHY

SEQ ID NO: 14384 - protein, 81 aa, Mandrillus leucophaeus
PQGHLTFMDVAIEFSQEEWKCLDPGQRALYRDVMLENYRNLVSLGICLPDLSIISMLKQRREPLTLQSEVKIVKNPDGREC

SEQ ID NO: 14385 - protein, 81 aa, Sus scrofa
SVTFQDVAVDFTGEEWQLLGCAQRKLYWDVMLENFRNILSVGKDSFPVCPVPKTKVIFRMKQGHDPWMVDGENPHWTETLY

SEQ ID NO: 14386 - protein, 81 aa, Mandrillus leucophaeus
SKESVSFKDVAVDFTQEEWGQLDSPQRALYRDVMLENYQNLLALGPPLHKPDVISHLERGEEPWSMQREVPGGPRPEWQLK

SEQ ID NO: 14387 - protein, 81 aa, Mandrillus leucophaeus
EKETLTFRDVAIEFSLEEWECLNPAQQNLYMNVMLENYKNLVFLGIAVSKQDPVTCLEQEKEPWNMKRHEMVDEPPGKTDH

SEQ ID NO: 14388 - protein, 81 aa, Mandrillus leucophaeus
PRGSTFFSSVTVAFAQEGWRCLVSTPRERYKEGIPEKSRNLVLLGLPVSQPGMNSQLEQREGTWMLEGEDVRSPSPGWKIV

SEQ ID NO: 14389 - protein, 81 aa, Sus scrofa
LQESFSFEDLSVDFTQKEWQLLDPYQKDLYKDVMLENYSSLVSLEQVLQVNGHMTWHKDNQEKLQNMKQDHECDAPGKNFN

SEQ ID NO: 14390 - protein, 81 aa, Mandrillus leucophaeus
QGLLTFRDVAIEFSQEEWKCLDPSQRTLYRDVMLENYRNLVSLDISSKCMLKTLSSTGQGNTEVILIGTLQRQASHHTGEF

SEQ ID NO: 14391 - protein, 81 aa, Sus scrofa
VTVTFKDVAIDFTQEEWQQLDPAQRNLYRNVMLENYNNLITVGKDSFLYNANSGIKVPFFSSVSNVWKLSFFVFLPFLGPH

SEQ ID NO: 14392 - protein, 81 aa, Sus scrofa
MPVTYEDVATTFTQEEWGQLDPTQRTLHQEVMLDTYPQPTDLGQGWNPKPHGSYHTHASRSHLRQHQRSHTGEKPYVCSKC

SEQ ID NO: 14393 - protein, 81 aa, Sus scrofa
VLLPLTFEDVAIYFSEQEWRNLEAWQKELYKQVMRTNYEILVSLGEGLPKPELISWIEQGREPFRNWGESQKSGNTSYSST

SEQ ID NO: 14394 - protein, 81 aa, Sus scrofa
LTLEDVAIEFSPEEWACLDPAQRALYRDVMLETCRNLLSLREHHVFPVRVIKQLQPKVNNDTGEVLQTVMWGRPDVYEVKL

SEQ ID NO: 14395 - protein, 81 aa, Sus scrofa
NLLLQRPLSFEDVAVGFTLEEWRLLDPFQKDLYREVTLEICHSLVSVGYEAPKPDALFRLEQGEPPWRREGAAQSPTCPGE

SEQ ID NO: 14396 - protein, 81 aa, Neophocaena asiaeorientalis
FHESLLFEDVAVEFTREEWRLLDPAQKDLYQNVMLENYSNLLSVGYQSPKPIQIFRLKQRDKPWLEKENIHGQNFPAGEIG

SEQ ID NO: 14397 - protein, 81 aa, Neophocaena asiaeorientalis
KVPVTFVDIAVYFSEDEWKNLDEWQKELYNNLVKENYKTLMSLDSEGPVSKPDAPPQAEPREEPCVWEQRDPEEREILMDP

SEQ ID NO: 14398 - protein, 81 aa, Neophocaena asiaeorientalis
PLESVTFEDVAISFTQEEWALLDTSQRKLFRDVMLENISHLVSVGYQHCKSDVIFQLDQGEELWIEGRGFFQSHSPGRESA

SEQ ID NO: 14399 - protein, 81 aa, Neophocaena asiaeorientalis
LSQTSVSFKDVTVEFTLEEWQCMSSAQRTLYRDVMLENYSHLVSLGYYFTKPDVIIKLEQDDPLLLEEEFLNKSHADSKLD

SEQ ID NO: 14400 - protein, 81 aa, Bos mutus
SQSPLTFGDVAVEFSGEEWAWLDSAQRSLHRSVMLENYRNLASLGLCLSKPEMISSLEQRKEPWAVKRKSTRGMRPDSQTL

SEQ ID NO: 14401 - protein, 81 aa, Bos mutus
LQALISFEDVAITFTGEEWRHLDLAQRTLYQEVMLETCGLLVSLGHPVPKAELIHLLEYGPELWTVKRGLSRNTCTGEKAN

SEQ ID NO: 14402 - protein, 81 aa, Neophocaena asiaeorientalis
MAITFEDVTVNFTWEEWKFLDSSQKKLYREVMWENYTNVMSVGDWKESYRLQEERFRCFEHEHLSCWQGWRNASTQIYDNQ

SEQ ID NO: 14403 - protein, 81 aa, Neophocaena asiaeorientalis
PLTFKDVAIEFSREEWACLDPDQKAFYVDVMLETYSNLISLDISHIHVIKKLQPRANSDRGEVFQTVMLERQKSHEMKHFY

SEQ ID NO: 14404 - protein, 81 aa, Neophocaena asiaeorientalis
SEDLVTFGDVAVDFSQEEWEWLNPAQRNLYRKVMLQNYRSLVSLAGVSVSKPDVISLLEQGKEPWMVKKEGTRGACPDWEY

SEQ ID NO: 14405 - protein, 81 aa, Neophocaena asiaeorientalis
MAFRDVAVDFTQEEWMLLSPAQRSLYREVMLENYSNLVSLGIPFSKPRLITQLEQGKETWREERKCPPATGPAEPKPELHL

SEQ ID NO: 14406 - protein, 81 aa, Neophocaena asiaeorientalis
AQGSVMFSDVSVDFSQEEWEFLDPAQRDLYRDVMLENYSNLVSVGLYIPKPQVISLLEQGKEPWMIGRELTRGLCSDLESM

SEQ ID NO: 14407 - protein, 81 aa, Nomascus leucogenys
LYVFQGVLTFRDVAIEFSLEEWQCLDITQQNLYRHVMLENYRNLVFLGIAASKPDLITCLEQGKEPWNVKRHEMVAEPPGR

SEQ ID NO: 14408 - protein, 81 aa, Nomascus leucogenys
TQESLSLEDVAVEFSWEEWQLLDTAQKNLYRDVMVENYNHLVSLGYQTSKPDVLSKLAHGQEPWITDAKIQNKNCPGIRKV

SEQ ID NO: 14409 - protein, 81 aa, Nomascus leucogenys
PRPPTAAPQVSNAFLTSWASHPSIHPISQGSLYRDVMLENYTGYQVSKPEVIFKLEQGEEPWISEGEIQRPFYPGFVCLLP

SEQ ID NO: 14410 - protein, 81 aa, Nomascus leucogenys
LQEPVTFRDVAVDFTQEEWGQLDPTQRILYRDVMLETFGHLLSVGPELPKPEVISQLEQGTELWVAERGTTQGCHPGWEPR

SEQ ID NO: 14411 - protein, 81 aa, Nomascus leucogenys
YQDSVTFEDTAVDFTQEEWTLLDPVQRNLYRDVMLENYENVAKVGFQLLKPSVISWLEEEELRTFQQGVLQDWAIKHQTSV

SEQ ID NO: 14412 - protein, 81 aa, Bos indicus
MGWLTFQDVAIDFTQEEWECLDLGQRELYRDVMLENYGNLASLGLVSKLDLVTFLEQLDDPRNIRRMGTTAIYPAVSPQDT

SEQ ID NO: 14413 - protein, 81 aa, Bos indicus
LQGSVSFKDVTVDFTQEEWQQLDPAQKALYRDVMLENYCHLISVGFHMTKPDMIRKLEQGKELWTTEKFFQSQSYLEEDWK

SEQ ID NO: 14414 - protein, 81 aa, Pteropus vampyrus
MLENYRNLNSLRKEHLFSKPDEVPKLECKKKRWITEQEIPRTIVFDRQTISENQDSVLKQRISGEESSHGVIMTRLTQSGP

SEQ ID NO: 14415 - protein, 81 aa, Pteropus vampyrus
KQETVTFKDVAVDLTQEEWQQMKPAQKNLYRDVMLENYSNLVTVGYQVTKPDVIFKLEQREEPWVIEEEMFGRHCPEVWEV

SEQ ID NO: 14416 - protein, 81 aa, Trichechus manatus
IHESVTFEDVAVNFTDREWQCLTHAQRHLYKDVMLENYGNMVSLGFPFPKPPLISHLERETEPWVQDLQDRESLSSFYPVS

SEQ ID NO: 14417 - protein, 81 aa, Trichechus manatus
DSVTFEDVFVYFSREEWGLLDEAQRLLYRNVMLENFALVASLGCWHEAEEETPEQNVSVEGVSQVRTTQKAHPCERCDPIL

SEQ ID NO: 14418 - protein, 81 aa, Trichechus manatus
PQASVSFKDVAVELTQEEWQHMGPAQRTLYRDVMLENYSHLVSVGYCFTKPEVIFKLEQGRDPCLSDEEFLHRSYIDCQLD

SEQ ID NO: 14419 - protein, 81 aa, Trichechus manatus
AHELVMFRDVAIDFSKEEWECLDLEQRDLYRDVMLENYSNMVLLGLCIHQPDMFSLLEKGKEPWKVLRYQTRGPCPDMQSR

SEQ ID NO: 14420 - protein, 81 aa, Trichechus manatus
VKKPVTFDDVTVNFTQEEWKCLDATQRSLHQDVMLETFKNLASVARIFLPKSDLITKAEQAEEEWKADYHPSNGDYPPLGK

SEQ ID NO: 14421 - protein, 81 aa, Trichechus manatus
SVFVEDVAVVFSQEEWTLLDLAQRKLYRDVMMENFRNLASVVSRNLIEGEKLSSEHIMVRFMKNNTWFSMLGEISESHGSK

SEQ ID NO: 14422 - protein, 81 aa, Trichechus manatus
CWGLLSFKDISMEFTWEEWQLLDSAQKYLYQDVILENYYNLVSVGYPGSKPDLIFKLEQGEEPWTINAKLSSQSCPEGWEE

SEQ ID NO: 14423 - protein, 81 aa, Trichechus manatus
SVVIEDVAVVFSQEEWALLDLPQKKLYRDVMMETFRNLASVVSQNLNNGEKSSSEHIIVRFMKKNTWSSMLGEISELHGNK

SEQ ID NO: 14424 - protein, 81 aa, Trichechus manatus
IWGSLSFKDVAVGFTWEEWQLLDPSQKDLYKEVMLENYNNLVSVGYPATKPDSVFMLEQGVPPWIVEGVIHSGTSPEEIWA

SEQ ID NO: 14425 - protein, 81 aa, Zalophus californianus
LQGSVTFPDVAVDFTPEEWQLLDCEQRTLYWDVMLEDFRNLISVGGPVTKTKAIFKAEQGQEPWMGEGANPRWRHPEAICL

SEQ ID NO: 14426 - protein, 81 aa, Zalophus californianus
EQESVTFKDVAIDLTQEEWTLMDRSQRKMYIDVMLENITHLVSVGCQFFQSDVISQWEQGGVLWREDRRLAQGWSPGLENS

SEQ ID NO: 14427 - protein, 81 aa, Zalophus californianus
SQVSVTFQDVAVLFTRDEWRELGPSQRNVYQEVMLENYSNLVSLGLLFSKPKVISLLQQGEDPWRVEKESPGGPSLGCKSS

SEQ ID NO: 14428 - protein, 81 aa, Zalophus californianus
RESGKAPVTFDDITVYLLQEEWMLLSQQQREICGSDKLVAPLGPTIANPELFYKFEQGPEPWLGNVQGQRNVLSHHPGKNK

SEQ ID NO: 14429 - protein, 81 aa, Zalophus californianus
VQGQVNFEDVAVYFSQEEWGLLDEAQRLLYRDVMLENLALMASLGRWHGMEDEEIAFEQNISVGVSQVRTPKAGPSTQKAH

SEQ ID NO: 14430 - protein, 81 aa, Equus caballus
FQKLVTFEDVAVNFTREEWECLDASQRVLYQDVMSKTFENLMSVARFFLSNPNLTTKLEQEEKQWRFSASSTGPPFSCHIC

SEQ ID NO: 14431 - protein, 81 aa, Loxodonta africana
RPRAVRFADVALYFSPEEWGCLRPMQRALYRDVMQETYGHLGALGCAGPKPALISWLERNTDDWEPAALDPQECRRGITVQ

SEQ ID NO: 14432 - protein, 81 aa, Chlorocebus sabaeus
VVFEDVAVDFTLEEWALLDSAQRDLYRDVMLETFQNLASVDDETQFKASGSVSQQDIYGKKIPKESKIAAFTRNVSWASVL

SEQ ID NO: 14433 - protein, 81 aa, Suricata suricatta
NLGLLTFRDVATEFSQEEWRCLNHSHRGLYKDVILENYGHLLFLGLVVSQLDLVIFLEQKQVLWNVKRKETVASYPAVSSD

SEQ ID NO: 14434 - protein, 81 aa, Sus scrofa
VTFQDVAVDFTEKEWPLLDSSQRKLYKDVMLENYSNLASVDWETPSKTKWSILMEDIFGRGPSNGVTVERTQHGEKSTEYA

SEQ ID NO: 14435 - protein, 81 aa, Sus scrofa
MQENYHHLISVGYCVNKPNAVFKLKQGKEPWILEVEFPRRNNPEDLWNIHDQGAKHKKSQAENSRNGELTKPQETLTREKT

SEQ ID NO: 14436 - protein, 81 aa, Mandrillus leucophaeus
AQSSVTFEDVAVNFSLEEWSLLNEAQRCLYHDVMLETLTLISSLGCWHGGEDEAAPSKQSTCIHIYKDQGGHSGERPYECG

SEQ ID NO: 14437 - protein, 81 aa, Sus scrofa
LQGSVSFKDVTVGFTQEEWQHLDPIQRSLYRDVMLENYSNLVSVGYCITKPEMIFRLEQGEEPWILEDEFPSQSSPEVWKN

SEQ ID NO: 14438 - protein, 81 aa, Mandrillus leucophaeus
CWGLLSFKDISMEFTWDEWQLLDSTQKYLYRDVILENYHNLLSVGYHGTKPDLIFKLEQGEDPWIINAKISRQSCPDGWDE

SEQ ID NO: 14439 - protein, 81 aa, Sus scrofa
LKGLVMFKDVAIHVSQEEWECLNPAQRNLYKDVMLENYSNLVSLGLSISKPAVISSLEQGKEPWMVVREVTGGPCPDLVSK

SEQ ID NO: 14440 - protein, 81 aa, Mandrillus leucophaeus
VTFEDVAVYFSWKEWGLLDEAQKCLYHDVMLENLTLTTSLGGCGAGDEEASYQQSTSSQRVSQVRLPKALPSPQKTNPCEI

SEQ ID NO: 14441 - protein, 81 aa, Mandrillus leucophaeus
VTFADVAVNFTKEEWTLLDPAQRNLYRDVMLENSRNLAFIDWATPCETKDATPQPDILPKRTFPEANRVCLTSISSQLSTL

SEQ ID NO: 14442 - protein, 81 aa, Mandrillus leucophaeus
SVAFEDVAVNFTQEEWALLSPSQKNLYRDVMLETFRNLASVGIQWKDQDTENLYQNLGIKLRSLVERLCGRKEGSEHRETF

SEQ ID NO: 14443 - protein, 81 aa, Mandrillus leucophaeus
TQGPLIFMDVAIEFSQEEWKCLEPAQRTLYRDVMLENYRNLVSLGICLPDLSVISTLEQKKDPWILQSEEKIGNNPDGREC

SEQ ID NO: 14444 - protein, 81 aa, Mandrillus leucophaeus
AQESVTFRDVAVFFSQDEWLHLGSAQRALYREVMLENYSSLVSLGIPFSMPKLIHQLQQGEDPCLEEREVPSDTCVGFKTW

SEQ ID NO: 14445 - protein, 81 aa, Mandrillus leucophaeus
GYVTFEDVAVYFSQEEWRLLDETQRLLYRNVMLENFSLLASLGLASSKTHEITQLESWEEPFMPAWEVMTAALPKGTWWVE

SEQ ID NO: 14446 - protein, 81 aa, Sus scrofa
LQESFSFEDLSVDFTQKEWQLLDPYQKDLYKDVMLENYSSLVSLGYEVMKPGVILKLEQGEEPWTGDGEIPGSDPPEQVLQ

SEQ ID NO: 14447 - protein, 81 aa, Sus scrofa
CFEELGLLGPARRRLYPEVMLETFWNVVSVGNQPFKPELIFQLEREEMLLMLETEIQRGRCSGENLPAVTQPEKLSVWQTW

SEQ ID NO: 14448 - protein, 81 aa, Sus scrofa
AQESVMFSDVSIDFSQEEWECLNDDQRALYRDVMLENYSNLVSMGHSISKPDVISFLEQGKEPWLVDRELTRGQWPVLESR

SEQ ID NO: 14449 - protein, 81 aa, Sus scrofa
MTFKDVAMDFTPEEWGELDPAQRAVMLDNYRNLASLWLPVSKPDNYSLKNGKEPSMLERKVPKSSCSDLETRPESKDSTSV

SEQ ID NO: 14450 - protein, 81 aa, Sus scrofa
SWGSVTFSDVAIDFSQEEWEWLQPAQRDLYRHVMLENYGHLVSLGLNISKPDVVSLLEQGKEPWLGKGDVNRDLFSASESN

SEQ ID NO: 14451 - protein, 81 aa, Bos mutus
GMVTFRDVAIDFSQEEWEFLDPAQRDLYVDVMLENYSNLVSLDTPFLRRRALDNCWGCEEVQEVRSQEGKGRREPSAQGTT

SEQ ID NO: 14452 - protein, 81 aa, Neophocaena asiaeorientalis
LLTFRDVAIEFSQEEWECLDPAQRALYRDVMLETYRNLLSLGEDNTPPEVGICPNISISFLTKELLKKKNINNRELYQPVV

SEQ ID NO: 14453 - protein, 81 aa, Neophocaena asiaeorientalis
CEGSVSFEDVTIDFSREEWQQLDPAQRRLYQDVMLEIYSHLFSVGYHIPNPEIIFRMEKRKEQWVREAELPCQRHHEGESG

SEQ ID NO: 14454 - protein, 81 aa, Neophocaena asiaeorientalis
ELQETVTFKDVAIDFTEEEWQQLDPAQRNLYWNVMLENYNNLITVGCPFTKPDVIFKLEQEEPWVVEEEVSKRHCPGEIWG

SEQ ID NO: 14455 - protein, 81 aa, Bos mutus
WLQGPMSFKDVAVEFTQEEWMMLDSAQRSMYRDVMLENYINLTLVEYQLCKPVISLSGQEDIRTVKSRIPQGTCPDWEIQF

SEQ ID NO: 14456 - protein, 81 aa, Bos mutus
LQASVSFKDVTVEFTQEEWHQMDSAQRTLYRDVMLENYSHLVSVGYCFTKPELIFMLEQGEDPWLLEKEFINRSSPEEFQP

SEQ ID NO: 14457 - protein, 81 aa, Bos mutus
RLTSEDVAIEFTQEEWEFLDPAQRALYRDVMLETYRNLLSVDISPTHVIKHLQPKANSDKREIFQTLMLGRPESCDIKHFH

SEQ ID NO: 14458 - protein, 81 aa, Neophocaena asiaeorientalis
WLQGPVSFEDVTVEFTQEEWVMLDSAQRSMYRDVMLENYMNLTLVEYQLCKPVISLSGQEDIRAVKRRIPQGTCLDWEIQL

SEQ ID NO: 14459 - protein, 81 aa, Neophocaena asiaeorientalis
LQDLVTFGDVAVDFSQEEWEWLNPAQRNLYRKVMLQNYRSLVSLGVSVSKPDVISLLEQGKEPWMVKKEGTRGACPDWEYA

SEQ ID NO: 14460 - protein, 81 aa, Bos mutus
RLTSEDVAIEFTQEEWEFLDPAQRALYRDVMLETYRNLLSVDISPTHVIKHLQPKATSDKRETFQTLMLGRPESCEIECFH

SEQ ID NO: 14461 - protein, 81 aa, Bos mutus
MSRLGRRRGRTRREERAEAAAPGQSLGSPGPVSESRRGYDSTKPNVIIKLEQGEEPWVVDSKFLQQQHSEDIYHYVTCDWH

SEQ ID NO: 14462 - protein, 81 aa, Nomascus leucogenys
SQGRVTFKDVTVNFTHGEWQRLNPKQRNLYRDVMLENYSNLVSVGREETTKPDVILRLEQGKEPWSVEEEVLGSGRPEKNG

SEQ ID NO: 14463 - protein, 81 aa, Nomascus leucogenys
QGLLTFRDVAIEFSQEEWKCLDPAQRTLYRDVMLENYRNLVSLDISSKCTLKEVSSTAQGNTEVIHTGTLQRHERHHIGDF

SEQ ID NO: 14464 - protein, 81 aa, Nomascus leucogenys
SKESVSFKDVAVDFTQEEWGQLDSPQRALYRDVMLENYQNLLALGPPLHKPDVISHLERGEEPWSMQREVPGGPCPEWELK

SEQ ID NO: 14465 - protein, 81 aa, Nomascus leucogenys
MDVAIEFCLEEWQCLDTAQQNLYRTVMLENYRNLVFLGIAVSKPDLITCLEQEKEPWEPMRRHEMVAKPPGGIVSLLNFFD

SEQ ID NO: 14466 - protein, 81 aa, Nomascus leucogenys
NLIFLTFEDVAIDFTQEEWAMMDTSKRKLYRDVMLENISHLVSLRYQISKSYIILQLEQGNELWQEGREFLQDQIPDRESA

SEQ ID NO: 14467 - protein, 81 aa, Nomascus leucogenys
FQELVTFRDVAIDFSRQEWEYLDPNQRDLYRDVMLENYRNLLSLGGHSISKPVVVDLLERGKEPWMILREETEFTDLDLQC

SEQ ID NO: 14468 - protein, 81 aa, Nomascus leucogenys
GSLTFRDVAIEFSLEEWQCLDTAQQNLYRNVMLENYRNLVFLGIAAPKPDLIIFLEQGKEPWNVKRHEMVEEPPVICSHFA

SEQ ID NO: 14469 - protein, 81 aa, Nomascus leucogenys
PIGLLTFRDVAIEFSQEEWKCLDPAQRTLYRDVMLENYRNLLSLGEDNFPPEVGMFLLCHPGWSAVTRSRFTATSPSGVQA

SEQ ID NO: 14470 - protein, 81 aa, Canis lupus
KPGAVSFADVAVYFSPEEWGCLRPAQRALYRDVMRETYGHLGALGFRGAKPALISWVEEEADLWGPDARDPEVGECVTETD

SEQ ID NO: 14471 - protein, 81 aa, Pteropus vampyrus
AAENDQVPDVAVDFTREEWQLLDTVQKNLYRDVMLENYSNLMSLGYQAAKPGAVVHWEKEEQGLVEREFPSHFSSEVIWQV

SEQ ID NO: 14472 - protein, 81 aa, Pteropus vampyrus
SVTFKDVFVCFSREEWELLEEVQRCLYRDVMLENFALVASLDCWREADHQEVPSEQHTSIGVSQVRTPKSGPFTQKAHPCE

SEQ ID NO: 14473 - protein, 81 aa, Pteropus vampyrus
MLESYRNLLFLGISVSDLYIVSILEQGKAPWTLESEWKIPQEPNRREHIEGVNTDLCPSYVIKKLKPTKPSSKGGEYQTVI

SEQ ID NO: 14474 - protein, 81 aa, Trichechus manatus
MAAPSPPPEPKEEWDYLDPAQRSLYKDVMMENYGNLVSLDVLNKDKDEEPTVKQEIEEIEEEVEPQSVIVTRIKSEIDQDP

SEQ ID NO: 14475 - protein, 81 aa, Trichechus manatus
SVVVEDVAVDFTQEEWALLDLSQRQLYRDVMMEIFRSLASVASQNLSDGDKLSTENIIVRFMKNDTWFSMVGEICELPGTE

SEQ ID NO: 14476 - protein, 81 aa, Trichechus manatus
VQESVTFKDVAVLFSQDEWGHLSLAQRALYRDVMLENYSNLVSVGLLGPKPDMFSQMRVGEEWMLEDTSGHSCLDWMTVFV

SEQ ID NO: 14477 - protein, 81 aa, Trichechus manatus
FLESVMFSDVSIDFSQEEWECLNEDQRDLYRDVMLENYSNLVSMAGCSFSKPDVISFLEQGKEPWLVDRELTRGQWPDLES

SEQ ID NO: 14478 - protein, 81 aa, Zalophus californianus
AQVCVISEDVFVSFSREEWMLLDDSQRLLYQDVMLENFALLASLGIVSSRSHSVAQLEQKEDPQMAAQVDMTPVSEREAQK

SEQ ID NO: 14479 - protein, 81 aa, Zalophus californianus
APGSVTFEEVAVYFSQEEWRLLNEAQRHLYRDVMLEVFALVASLGCGRGTEDEATSSEQNVSVGGSQINSTQKAYTQEHGL

SEQ ID NO: 14480 - protein, 81 aa, Zalophus californianus
APNSITFEDVAMDFSQEEWALLNSRQRKLYRDVMLENYRNLASLEKQLSKPTVITQMKQEDEMKTGTGNHQDTCSNGMVLL

SEQ ID NO: 14481 - protein, 81 aa, Zalophus californianus
GHALLTFRDVAIEFSQEEWGCLNHTQRELYRDVMLENYGHLLFLGLIVSKPDLVSFLEQTKDPWDGKRKKTVAFHPGLALS

SEQ ID NO: 14482 - protein, 81 aa, Zalophus californianus
TLSFKDVVVDFTSEEWQLLDAVQKNLYWDVILENYSNLVSVEDYLHKEEREYSYNRTLLYRKENEPIVTTCTTVDESHRRN

SEQ ID NO: 14483 - protein, 81 aa, Zalophus californianus
SKVPVTFGDLAIYFSQEEWEWLSPIQKDLYEDVMLENYQNLVSLGLSFRRPNVITLLEKGKAPWIVEPVRKRRGMDSGSKS

SEQ ID NO: 14484 - protein, 81 aa, Zalophus californianus
QGHVTFEDVAVYFSQEEWALLDEAQRHLYRTVMLENLALIASLGCWHGVKAEEAFSEQCVFMERVSQARTPDPGLSIPKAH

SEQ ID NO: 14485 - protein, 81 aa, Zalophus californianus
LQEAIVFEDVAVYFTRIEWSCLAPDQRALYRDVMLENYGHMASLGFLVAKPALISLLEQGEEPGALILQGTEEPGSTASLC

SEQ ID NO: 14486 - protein, 81 aa, Zalophus californianus
FKETVTFKDVAVVFTEEELGLLDPAQRKLYGDVMLENFRNLISVGGKIQSKMKTVIEAEPPEELSCWRIWQQIASDLTRCQ

SEQ ID NO: 14487 - protein, 81 aa, Zalophus californianus
TQDSVVFEDVAVDFTQEEWALLDFAQRSLYRDVMLENFQNLASLGYPLQTPYLISQWKQEEDLETAERGPIQGEHQEDFEI

SEQ ID NO: 14488 - protein, 81 aa, Zalophus californianus
MVEGAAQSQTCQGYPATKPDVILNFERGEESWSVEDEMQCQCISGKKRYGCDKCAVNAYEPLMTVLQRTHAGKKSHECCDC

SEQ ID NO: 14489 - protein, 81 aa, Zalophus californianus
FQEPVTFEDVAVYFTQNEWVILDPSQRALYREVMLENYANVASLAFLFTRPVLVSQLERGELPWGLEPWEPAGREALRGIC

SEQ ID NO: 14490 - protein, 81 aa, Zalophus californianus
QGLLSFSDVAVDFTWEEWQLLDTVQRNLYRDVMLENYSNLMSLERPLQCFSRGIHLKQKSDSKFQSKNYAEMNSVELNSHG

SEQ ID NO: 14491 - protein, 81 aa, Zalophus californianus
ELDSVTFKDVAIDFTLEEWRLMDPSQRNLHKDVMLENYRNLVSLGLAVSKPDMISHLEDGKGPCVVEREIARTPYPELETK

SEQ ID NO: 14492 - protein, 81 aa, Equus caballus
VHGSVTFADVAVSFSQEEWACLSPAQKALYRDVMLDNYSHLASLGGSSISKPDVITLLEQEKEPWMGVRKETGGQNPDLQS

SEQ ID NO: 14493 - protein, 81 aa, Equus caballus
MTQDFVTLKDVTMDFTVEDWEQLDLDQGDLFWDTALDNYQSLFLLNPPRPKLTSRPDGTEELEARVRGSPEATGPDKAESK

SEQ ID NO: 14494 - protein, 81 aa, Equus caballus
ESMTFGDVAVYFSWEEWRLLGEAQRDLYHDVMLENFALISSLDCWSATEDAKAPFEHSISVGVSQATTPKTGLISQNTHTC

SEQ ID NO: 14495 - protein, 81 aa, Equus caballus
LQVSVSFEDVTVDFSREEWQHLDPAQRRLYRDVTLENYSHLCSVGYQVPKPEVIFKLEQGEGPWMLEGEAPHQSCSDDDIG

SEQ ID NO: 14496 - protein, 81 aa, Equus caballus
MLENYGNMASLGFPLLKPAVISQLEGGGELGGPSPLAAGTEACPQALWTDIDIQTDNNLTKEMDEEKVNTSFELQRDFSQE

SEQ ID NO: 14497 - protein, 81 aa, Equus caballus
PLGPVIFEDVAIYFSQDEWGLLDEAQRLLYHAVMMENFALLSSVGSWHGAQDEEAPSEQGVSVGVSQVSTPKPGPSFQKAR

SEQ ID NO: 14498 - protein, 81 aa, Neovison vison
FKDVAVDITQEDWEIMRPVQKELYKTVTLQNYWNMVSLGLTVYRPTVIPLLEEPWMVIKEILEGPSPEWKTEAQECTPVTN

SEQ ID NO: 14499 - protein, 81 aa, Neovison vison
TQEEWQQLDPAQRNLYRNVMLENYNNLITVGCPFTKPDVIFKLEQEEEPWVVEEEVLRRHYPGEMWGIEHQKIQDRLLTQF

SEQ ID NO: 14500 - protein, 81 aa, Neovison vison
MLETYRNLISLGLQGSKPDVISRLEKGEEPWAPYSPRIEEGWIWSHGSESFESRTGKRGLTPRQEISKAVGSQRAKSEEHV

SEQ ID NO: 14501 - protein, 81 aa, Capra hircus
VQGPVSFEDVAVGFSGEEWQLLGPSQKALYWDVMLENYCNLVSVGYQAPKPDSFFQLEQGGPPWMVKGAALSPTCPGYQAT

SEQ ID NO: 14502 - protein, 81 aa, Capra hircus
QGLMTFEDVAVDFTQEEWQYLNPPQRTLYRDVMLETYSNLVSVGKNGYHVTKPDLILKLEVEEQCLPEGKIPIWSFPEAFQ

SEQ ID NO: 14503 - protein, 81 aa, Capra hircus
PKVPVTFDDVAVHFSEQEWGNLSEWQKELYKNVMRGNYESLVSMDYAISKPDLMSQMERGERPAMQEQDDSEEGEAPADPS

SEQ ID NO: 14504 - protein, 81 aa, Capra hircus
KSWGPLSFMDVFVDFTWEEWQLLDSAQKHLYRSVMLENYRNLVSLGYQYTKPSIIFQLEQEELWMMHSPSQGHSDKVWEID

SEQ ID NO: 14505 - protein, 81 aa, Chrysochloris asiatica
GWVPALFDEVAIYFSDEEWDVLTEQQKALYREVMRMNYETVLSLEFPFPKPDMITRLEGEEESQKSKEWQLHGGTFAENED

SEQ ID NO: 14506 - protein, 81 aa, Suricata suricatta
FREPVTFEDVTLGFTSDEWGLLDLEKKSLYREVMLENYRNLVSVEHQLSKPDVVSQLEEEEALCSVERGIPQDTFSECLAV

SEQ ID NO: 14507 - protein, 81 aa, Suricata suricatta
VYIYTTSFRDVTIEFSQEDWRFLNHSQQELYRDVMLENYGHLLFFGLVLSKPDLVFLEQRKGLCHGKRKETVVSYPALSSN

SEQ ID NO: 14508 - protein, 81 aa, Chrysochloris asiatica
LYKPVTFTDVAVEFTQEEWVMLDTAQRNLYRDVMLENYRNLTSVESQLCRPTVISLINEKEKSVKRRISQAICPDWEDQLK

SEQ ID NO: 14509 - protein, 81 aa, Chrysochloris asiatica
ARSLEEDGVCLSKQEWENLEDWQRELYRNVMTSNYETLVSLKVLGQPEGEVELATEMLGGLEEDGAGIAHPADRAMIKQEA

SEQ ID NO: 14510 - protein, 81 aa, Chlorocebus sabaeus
MDFTPEEWGKLDPAQRDVMLENYRNLVSLWLPVSKPENYNLENGKEPLKLERKTPKSSYSGEPDRWESSEMIAQQDNEEIL

SEQ ID NO: 14511 - protein, 81 aa, Suricata suricatta
FKEAVTFKDVAVVFTIEELGLLDSAQRKLYRDVTLENFRNLVSVGHLPLKPDMVSQLEAEEELWVMERETQRNGCCSEIRL

SEQ ID NO: 14512 - protein, 81 aa, Chlorocebus sabaeus
MLENYGNLVSVGLLSSKPKLITQLEEGAEPWMEVREAPSGTRAVQDYWFETKMSALKQSTSAGSVVGERRKSVMMEKGLDW

SEQ ID NO: 14513 - protein, 81 aa, Chrysochloris asiatica
SQELVLFKDVAVNFTQEEWQQLDCDEKIMYRDVMLETYSHLISLGFDITKPDVIIKLEQGDEPWVVEGDFPWQSSPEEGWK

SEQ ID NO: 14514 - protein, 81 aa, Chrysochloris asiatica
CQEPVTFEDVAIIFTEEEWGHLVPIQRDLYKEVMLENYTSIVSLDLVTKHESQDTSEEEISEETLRESFENKGPICPKLEV

SEQ ID NO: 14515 - protein, 81 aa, Suricata suricatta
VSVTFDDVAVTFTQEEWGQLDPAQRTLYQEVMLENCGLLVSLALPILLICDKGKPKTTVSATGEPALSEGDPIHEQLIQGV

SEQ ID NO: 14516 - protein, 81 aa, Chlorocebus sabaeus
FQDSVAFEDVDVNFTQDEWALLDPSQKNLYRDVMQETFRNLASVGKKWKDQKIEDEYKNPRRNLSLMREKLFESKESHYCG

SEQ ID NO: 14517 - protein, 81 aa, Suricata suricatta
MDLAPRPDPAQKSFRKNVMWEKRGDLGSVGPCVSQADLVSLLERGTEPWMVAGELAEGPRPGQQSVQETQELFPKRDPFAA

SEQ ID NO: 14518 - protein, 81 aa, Chrysochloris asiatica
MGTMIIEDVAVVFTHEEWDLLDPAQRKLYRDVMMETLRNLVSVGAIKKSHGWKDHLDNQGRHLRTGAIENLGECSEGNQCG

SEQ ID NO: 14519 - protein, 81 aa, Chlorocebus sabaeus
EPGVVSFADVAVYFCREEWGCLRPAQRALYRDVMRETYGHLSALGIGGNKPALISWVEEEAELWGPAARDPEVTKCPTEAD

SEQ ID NO: 14520 - protein, 81 aa, Mandrillus leucophaeus
ICELLTFKDISVDFTQEEWGQLAPAYQNLYREVMLENYSNLVSVGYQLSKPSVISQLEKGEEPWMAEKEGPGDPSSDLKSK

SEQ ID NO: 14521 - protein, 81 aa, Mandrillus leucophaeus
SKDLVTFGDVAVNFSQEEWEWLNPAQRNLYRKVMLENYRSLVSLGVSVSKPDVISLLEQGKEPWMVKKEGTRGTCPDWEYV

SEQ ID NO: 14522 - protein, 81 aa, Mandrillus leucophaeus
AQGLVTFADVAIDFSQEEWACLNSAQRDLYWDVMLENYSNLVSLDLESAYENKSLATEKNIHELRASKRNSDRRSKSLGRN

SEQ ID NO: 14523 - protein, 81 aa, Sus scrofa
MKPAQRNLYRDVMLENYSNLVTVGCQVTKPEVIFKLEQEEEPWVVEEEMLGRHCPEVWEVDEQLKKQQETHVRKVTSISKE

SEQ ID NO: 14524 - protein, 81 aa, Loxodonta africana
NFWILRLPPGSKGEVPKEWGKLDEWQKELYKHVMRGNYETLVSLDYAISKPEVLSQIEQGKEPCSWRRAGPKIPDVPVDPS

SEQ ID NO: 14525 - protein, 81 aa, Loxodonta africana
LQGSVSFKDVTVDFTQEEWQQLDPAQKALYRDVMLENYCHLISVGCHMTKPDMIHKLEQGEEPWTTERVYPSHAYLEEDGK

SEQ ID NO: 14526 - protein, 81 aa, Loxodonta africana
VVFTDVAVDFSQEEWECLDSYQRSLYRDVILENYSNLVSLGGGSISKPDVVTLLEQGKEPWMVVRDTKIRWSLGLESNYDA

SEQ ID NO: 14527 - protein, 81 aa, Loxodonta africana
PVGNAPVTFDDITVYLLQEEWMLLSRQQQMEIWGSDKLVAPLAGLTIANPELFCKLEQGAEPWLGNIQGQRSLQNHRSRKD

SEQ ID NO: 14528 - protein, 81 aa, Capra hircus
NFWILRLPPGSKGEAPKEWGKLDEWQKELYKHVMRGNYETLVSLDYAISKPEVLTQTEQGKEPCWRRAGPKVPDVPVDPSP

SEQ ID NO: 14529 - protein, 81 aa, Capra hircus
KKPVTFEDVAVNFTQEEWKCLDASQKVLYQDVISETVRNLMSVGGEKEERQEQSQSLGDEGTVDDKKASLAHRGSGPTSAP

SEQ ID NO: 14530 - protein, 81 aa, Capra hircus
FTFKDVAIEFSQEEWECLAPSQRALYRDVMLETYRNLVSLGDDNFSPEVGILSAGFAINKLSPRENTNLGELYGNENHGIK

SEQ ID NO: 14531 - protein, 81 aa, Capra hircus
LQELVTFKDVAVDFTEEEWEHLDPSQRHLYREVMLENFGNLISLAGHLLSEPEMIFHFEQDVVWMEETIPRGSYSECGILS

SEQ ID NO: 14532 - protein, 81 aa, Chrysochloris asiatica
AQELVTYEDVAVYFIRKEWKRLEPAQRDLYRDVMLENYGNVFSLDGENRSENDQEISEDTGSHGVLLGRFQKDISQDLKFK

SEQ ID NO: 14533 - protein, 81 aa, Capra hircus
TFKEAVTFTDVAVTFTEEELGLLDSAQKKLYQDVMLENFRNLVSVGCHPFRHDIFHLEKEKRLWVVKTATQREGKSEEKIQ

SEQ ID NO: 14534 - protein, 81 aa, Chrysochloris asiatica
SLGSILFNDVAIVFSQEEWEQLVPAQRDLYKDVMLETYHTLVSLGLTISKPNVISFLEQGEEPWLGERAVTGGLGPVLESG

SEQ ID NO: 14535 - protein, 81 aa, Chrysochloris asiatica
KPGIVRFADVAVYFSREEWACLRPAQRALYRDVMRETYGHLGALGFPGPKPALISWMERESEAWSPAAQEPKEGENLGGAP

SEQ ID NO: 14536 - protein, 81 aa, Chlorocebus sabaeus
AQESVTFRDVAVFFSQDEWLHLGSAQRALYREVMLENYSSLVSLGIPFSMPKLIHQLQQGEDPCLVEREVPSDTCLGFKTW

SEQ ID NO: 14537 - protein, 81 aa, Chrysochloris asiatica
TKSQVSFEDVAVDFTWAEWQLLNPTQKNLYKDVMLENYSNLVFLGYQIIKPNAVFKLEQGEEPCMTDDEMLSHNLPEVWLD

SEQ ID NO: 14538 - protein, 81 aa, Chrysochloris asiatica
LQEAVTFKDVAVVFSEEELGLLDSTQRTLYREVMLETFRNLLSVGHPPFKPDLISQLEREGKILTMVTEAQRDGCSEKRYS

SEQ ID NO: 14539 - protein, 81 aa, Chrysochloris asiatica
KDDLVAFEDVAVYFSQEEWGLLDMAQRALYRHVMLENFTLMASLGLTASRPQMIVQLEGGEEPWVTNRMDLASVTAKKVQR

SEQ ID NO: 14540 - protein, 81 aa, Suricata suricatta
MKPDVIFKLEQGEEPWVGDGEVPSVDCSEHVWQGNGHVAWYQEDQEKLRNLKQDHECDAFGKKLNLSMNFVPLRKSNSEDN

SEQ ID NO: 14541 - protein, 81 aa, Suricata suricatta
WLSPLRDVAIEFSQEEWGCLSYSQRELYRDVMLENYRHVLFLGLVVSKPDLVIFLEQQRELWDVKRKKIIASYPGRMSVNR

SEQ ID NO: 14542 - protein, 81 aa, Suricata suricatta
PQVSVSFEDVAVLISREEWGCLGPAQRCLYRDVMLETYRNLVSLGLQGSKPDVISRLEKGEEPWAPHSLRIEEGWIRSHRS

SEQ ID NO: 14543 - protein, 81 aa, Chlorocebus sabaeus
LQASVSFQDVTVEFTQEEWQHLGPVERTLYRDVMLENYSHLISVGYCITKPKVISKLEQGEEPWSLEEEFLNEKHQGYFKV

SEQ ID NO: 14544 - protein, 81 aa, Suricata suricatta
AQESLTLEDVAVDFSREEWQLLAPAQKDLYRDVMLENYRNLVSLEIRKVDGHLQCQLQNQSIQKSVEQCCEYITFANIFNQ

SEQ ID NO: 14545 - protein, 81 aa, Suricata suricatta
GCLTNYSPDPVTLEDVAVEFTQEEWTSVDPTQRNLYREEMLENHMNLVTLGWEICLNTKRSAPQQSILRGKASNVEMNSRQ

SEQ ID NO: 14546 - protein, 81 aa, Suricata suricatta
AQESLTLEDVAVDFSREEWQLLGPAQKDLYRDVMLENYRNLVSLGYQASTPDALCMLERGEGPWATGEAVRGGARPETRKV

SEQ ID NO: 14547 - protein, 81 aa, Sus scrofa
MAVSQAPVTFEDVAIEFSPEEWACLDPAQRALYRDVMLETYRNLLSLGEHRFPPEVGICPWVSLHFPVCASWEPLLCLTEL

SEQ ID NO: 14548 - protein, 81 aa, Sus scrofa
CWGLLSFKDVSMEFTWEEWQLLDSAQKHLYRDVTLENYSNLLSVGYHDTKPDLIFKLEQGEEPWIVNASISGQSCPEGWKE

SEQ ID NO: 14549 - protein, 81 aa, Sus scrofa
KPAAVRFADVAVYFSPEEWGCLRPAQRALYRDVMRETYGHLGALGFPGPKPALISWMEQESEAWSPAAQDPEEGESLGGPL

SEQ ID NO: 14550 - protein, 81 aa, Sus scrofa
GQMSLSFTDVAIDLSQEEWECLDLDQRALFREVMLENYRNLVSLGCPTPKPDVITLLEQEKEPWVVMREGTRNWYTDLESK

SEQ ID NO: 14551 - protein, 81 aa, Mandrillus leucophaeus
DSVTFDDVAVDFTQEEWTLLDPSQRDLYRDVMLENYENLASVEWRLKTKGPALRQDRSWFRTSNETQTARSHNGGQLCDRT

SEQ ID NO: 14552 - protein, 81 aa, Sus scrofa
TQGLVTFRDVAIEFSQEEWKCLEPAQRDLYRDVTLENFGNLVSLGLSISKPDVISLLEQGKDPWMMANDMTGPWCPDWESR

SEQ ID NO: 14553 - protein, 81 aa, Sus scrofa
WKEMLTFEDVALYFTREEWDTLGWAQKGVYREVMLANYRNMVSLGFQFPKPEVICQLEQWEEPWILDLPRAGTGTASGSAC

SEQ ID NO: 14554 - protein, 81 aa, Sus scrofa
SQGLLTVKDVAIDFSPEEWECLDLGQRDLYRDVMIEIYRHLVSLEYVISKPDLVRLLEQKKDPWDVKGMETVAIQPALSSH

SEQ ID NO: 14555 - protein, 81 aa, Sus scrofa
GYCVPEPEVILKLEQGEEPWVLEEEFSSQSYPELINSSRTYSRKVFNKGRKWFHDEKHERIHSEEKLYEYNKNENCLCLNE

SEQ ID NO: 14556 - protein, 81 aa, Sus scrofa
ARVSVTFDDVAVTFTQEEWGQLDPAQRTLYQEVMLENRGLLVSLGCPVPRPELICQLEHGGELWMVQKDLSQSTCPGERYR

SEQ ID NO: 14557 - protein, 81 aa, Nomascus leucogenys
AQGYVTFEDVAVYFSQEEWRLLDEAQKLLYRNVMLENFSLLASLGLASSKTHEITQLESWEEPFMPAWEVVTSATPRGTWW

SEQ ID NO: 14558 - protein, 81 aa, Nomascus leucogenys
DSVAFEDVAINFTCEEWALLGPSQKSLYRDVMQETIRNLDCIGMTWQTHDIEEDQYKDLRRNLRCHMVERSCEIKDNSQCG

SEQ ID NO: 14559 - protein, 80 aa, Nomascus leucogenys
MALSQGLFTFKDVAVEFSQEEWECLDPAQRALYRDVMLENYRNLLSLDEDNIPPENAFYPVQELRETLVFLILYSSKICL

SEQ ID NO: 14560 - protein, 81 aa, Nomascus leucogenys
GTVTFEDVAVNFSQEEWSLLSEAQRCLYHDVMLENLTLISSLGCWYGAKDETPSKQTLSIQQESPLRTRQTGVCTKKVHLW

SEQ ID NO: 14561 - protein, 81 aa, Nomascus leucogenys
EKETLTFRDVAIEFSLEEWECLSPAQQNLYMNVMLENYKNLVFLDIAVFKQDSVTCLEQEKEPWNMKRHEMVDEPPGKPDH

SEQ ID NO: 14562 - protein, 81 aa, Nomascus leucogenys
TLKEAVTFKDVAVVFTEEELRLLDFAQRKLYREVMLENFRNLLSVGHQPLHRDTFHFLKEEKFWMMETATQREGNLGPAFQ

SEQ ID NO: 14563 - protein, 81 aa, Bos indicus
MDSVVFEDVAVNFTLEEWALLDPGERKLYRDVMLETCRNLASVVKTRSSTQCDILKNELCSEEKKVRFPRNDSWSVFGENW

SEQ ID NO: 14564 - protein, 81 aa, Bos indicus
AQLTFKDVAIEFTQEEWECLDPAQRALYRDVMVETLSNIVSLDISHMHVIKKLQLNANIYGGEGFQIVILGRHRRNKIEDF

SEQ ID NO: 14565 - protein, 81 aa, Bos indicus
MLENYGNLASLGLVISKPDLVTFLEQMKDPWDARRMETPAVHPGIIDIGEKTYNCYDYAKAFNQSSKVIQQQNIQTKQKHY

SEQ ID NO: 14566 - protein, 81 aa, Bos indicus
SQELVTFEEVSVDFSQEEWALLAPTQKILYRDVMLENFRNLASVGYHLCKHSPITEVAQEELRPEGRGILQSACTDGATQL

SEQ ID NO: 14567 - protein, 81 aa, Canis lupus
PCRLVLFKDVAVDFSQEEWECLDLEQKDLYRDVMLENYSNLVSLGFSISKADVLSLLKQGKEPWKVVQEVTRSQSSDWESR

SEQ ID NO: 14568 - protein, 81 aa, Canis lupus
FQGFVIFRDVSIDFSEEEWECLDSTQRNLYKYVMLENYSNLVSVGKYTFLQKVYNPPEYLLPLRRISQLLSYILCVSFPYS

SEQ ID NO: 14569 - protein, 81 aa, Zalophus californianus
QEPVTFEDVAVYFTQNQWASLDPMQRALYLEVMLENYANITSLGGKNKIEREEQSPRLNISKDSAAHRLMVEGLLTEAPQH

SEQ ID NO: 14570 - protein, 81 aa, Equus caballus
QDSVTTEDVAVNFTPEEWALLDPSQKKLYRDVMWETFRILASVGKNEDIPSLKHVVGRLCESEEGSQCGENVSLLANLSLN

SEQ ID NO: 14571 - protein, 81 aa, Equus caballus
LQGSVSFKDVTVDFSQEEWQQLDPAQKTLYRDVMLENYCHLISVGFHMSKPDMIRKLEQGEELWTTERIFPSQSHLEEDGK

SEQ ID NO: 14572 - protein, 81 aa, Equus caballus
NFWILRLPPGSKGEAPKEWGKLDEWQKELYKHVVRGNYETLVSLDYAISKPEVLSQTEQGKEPCSWRRPGPKLPDVPVGPS

SEQ ID NO: 14573 - protein, 81 aa, Equus caballus
PQESVTFEDVAVYFTQNQWASLDPAQRALYGEVMLENYANMASLVAFPFPKPVLISQLERGEAPWGPDPWEAEVLRGVRPG

SEQ ID NO: 14574 - protein, 81 aa, Loxodonta africana
KVPVTFVDIAVYFSEDEWKSLDGWQKELYNNLVKENYKTLMSLDAEDPAPKPDAPPQVEPREEPCVWEQRNPEERDIPMDP

SEQ ID NO: 14575 - protein, 81 aa, Capra hircus
RGSVTFEDVAVYFSWEEWALLDEAQRCLYHDVMLENFALTSSLGCWHGVEDKEAPSERSICRGASQIRTLKADSSPQKGQP

SEQ ID NO: 14576 - protein, 81 aa, Capra hircus
MADLVMFRDVTVDFSQEEWECLNSNQRNLYRDVILENYSNLVSLGGCSISKPDVITLLEQGKEPWMVVRDEKRRWRLDLES

SEQ ID NO: 14577 - protein, 81 aa, Capra hircus
ALALISFEDVAITFTGEEWRHLDLAQRTLYQEVMLETCGLLVSLGHPVPEAELIQLLEYGPELWRVKRGLSGNTCIGEKSN

SEQ ID NO: 14578 - protein, 81 aa, Capra hircus
ARLSVTFDDVAVTFTQEEWGHLEPAQRTLYREVMLENRGLLVSLGCPVPRPELIYQLEHGQELWTVKRDLSRSTCPGDKGK

SEQ ID NO: 14579 - protein, 81 aa, Suricata suricatta
FGGVTFGDIAIYFSWKEWSLLDEAQRRLYYDVMLENFTLVSSLGKALPVPRGPDWSVSVGVSQASVSTAALSSRKTHPCEM

SEQ ID NO: 14580 - protein, 81 aa, Chlorocebus sabaeus
NFWILRLPPGSKGESPKEWGKLEDWQKELYKHVMRGNYETLVSLDYAISKPEVLSQIEQGKEPCHWRRPGPKIPDVPVDPS

SEQ ID NO: 14581 - protein, 81 aa, Chlorocebus sabaeus
SQGLLIFRDVAIEFSPEEWSYLDPAQQNLYRDVMLENYRNLVSLGIAVSKPDLITCLEQRNEPWNVKKHETIGRHPAVSSH

SEQ ID NO: 14582 - protein, 81 aa, Capra hircus
PTEPVTFRDVAVDFTQEEWGQLGPAQRTLYRDVMLETFGHLLSVGPELPKPDVISQLEQGAELWVAERGLAQGCRPALPPF

SEQ ID NO: 14583 - protein, 81 aa, Chrysochloris asiatica
NFWILRLPPGSKGEVPKEWGKLDEWQKELYKHVMRGNYETLVSLDYAISKPEVLSQIEQGKEPCNWRRTGPKIPDVPVDPS

SEQ ID NO: 14584 - protein, 81 aa, Chrysochloris asiatica
VVTFRDVAVDFSQEEWDWLNLSQRDLYRDVMLENYRNLVWLDWESWCEIKEISPKCYLDEEEISQGMATEKLTSHDFECSN

SEQ ID NO: 14585 - protein, 81 aa, Chrysochloris asiatica
MMENYRNLLALGPPVCKPDMISHLEQGEAPWQVYPRVYTAACPELETAPARSKECSYEEDPAQDSTVGRLLGTRPYSSIWG

SEQ ID NO: 14586 - protein, 81 aa, Suricata suricatta
SLEPDSFGDVAVLFSQEEWARLAPAQRELYRDVMLETYSHLVSLGLAVSKPDVISFLEQGKEPWLGEKAAAGGLGPELESR

SEQ ID NO: 14587 - protein, 81 aa, Chlorocebus sabaeus
MLENFALIASLGLISFRSHIVSQLEMGKEPWVPDSVDMTSAMARGAYGRPGSDFCRGTEGKDLPSEHNVSVEGVAQDRSPE

SEQ ID NO: 14588 - protein, 81 aa, Suricata suricatta
AQESVTFRDVAVVFSRDEWLCLDPAQRSLYREVMLENYGTLVSLGIPSSTPKVICRLQLGEDPCVLERETPQDACLGFKTG

SEQ ID NO: 14589 - protein, 81 aa, Suricata suricatta
WLTFRDVIVEFSPEEWECLGPAQRALYRDVMLENYRNLVSLALSPKCMIKELPPKENSNTGEVLQAVILERHESRDTEDHS

SEQ ID NO: 14590 - protein, 81 aa, Chrysochloris asiatica
QGCVTFEDVAVSFSQEEWGLLDETQRLLFCDVMLENFAIIASLVTQHESICNEEGIYEGSKCKKDFTCKYGLVQNQGSHTG

SEQ ID NO: 14591 - protein, 81 aa, Suricata suricatta
LSLPNPPLDVAIEFPQEDGGCLCLPQREVYGDVMLEIYGHLLFLGLVVSKPDLVIFLEQKRELWDVKRKETVASYPGNATL

SEQ ID NO: 14592 - protein, 81 aa, Mandrillus leucophaeus
SVCFHNQQTVNKSLEVAVHFTWEEWQDLDDAQRTLYRDVMLETYSSLVSLGHCITKPEVIFKLEQGAEPWLGEEWANQCLS

SEQ ID NO: 14593 - protein, 81 aa, Sus scrofa
PQGRVTFEDVALYFSWEEWNLLDEAQRCLYQDVMLETFVLASSLGCWPRAEDKEASSEQSISVGVSQIRTIKADSSPQKAQ

SEQ ID NO: 14594 - protein, 81 aa, Mandrillus leucophaeus
MTFEDIVVDFTREEWALLDTSQRKLFQDVMLENISHLVSIGKQLCKSVVLSHLQHVEKLSTQGMSLLQGREGDIKHQEIPF

SEQ ID NO: 14595 - protein, 81 aa, Mandrillus leucophaeus
VMFRDVAIDFSQEEWECLDSAQRDLYRDVMLENYSNLVSLDLPSRCASKDLSPEKNTYETELSQWEMSDRLENRDLEESKS

SEQ ID NO: 14596 - protein, 81 aa, Nomascus leucogenys
EMELLTFRDIAIEFSLEEWQCLDRAQQNLYREVMLENYRNLVSLGITLSKSDLITCLEQNKEPQNIKRNEMVSKHPVTCSH

SEQ ID NO: 14597 - protein, 81 aa, Nomascus leucogenys
RAEEAVTFKDVAVVFTEEELQLLDLAQRKLYRDVMLENFRNLLSVGHQPFHGDTFHFLREEKFWVMETTSQREGNSGGKIQ

SEQ ID NO: 14598 - protein, 81 aa, Nomascus leucogenys
DSVTFEDVAVDFTQEEWTLLDQTQRNLYRDVMLENYKNLVAVGKAGTILFIYLALSPRLECSGVISAHCKLCLLGSRHSSA

SEQ ID NO: 14599 - protein, 81 aa, Nomascus leucogenys
CEASVSFEDVTVDFSREEWQQLDPAQRWLYQDVMLELYSHLFSVGYHIPNPDVIFRMLKEKEPRVEEAELSHQRCQGLAQL

SEQ ID NO: 14600 - protein, 81 aa, Bos indicus
QDLVTFEDVTVEFTQEEWALLDSSQRKLYRDVMLENCRNLASLGKLYIIPSFQFVLDLETVLKAKWLTPKKPIFRKEHSND

SEQ ID NO: 14601 - protein, 81 aa, Bos indicus
PQGGVTFEDVALSFSWKEWKLLDAAQRRLYHDVMVENYALISSLGFWSGEEKVETSFEQSVSVAVSQARTSKEPSSSQKTH

SEQ ID NO: 14602 - protein, 81 aa, Bos indicus
APVILKDVVVTFTRQEWKLLDLTQRTLYQEVVLETSRLLVSLVCFFCVGITNRPHLYIGFPSDDKAKTKTTETAASQQALF

SEQ ID NO: 14603 - protein, 81 aa, Bos indicus
AQGCVTFEDVTIYFSPEEWGLLDEAQRLLYCDVMLENFALIASLGLASFRSHIVAQLEMGAEPWVPDQADMTSAMARGVYR

SEQ ID NO: 14604 - protein, 81 aa, Bos indicus
ERLTCEDVAIEFTHEEWVFLDPAQRALYRDVMLETYRNLVSLDISPTHVIKHLQLEANSDKLETFQTLMLGRPESCEIKHF

SEQ ID NO: 14605 - protein, 81 aa, Bos indicus
QGLFTFKDVAVEFTQEEWECLDPIQRALYRDVMLETYRNLLSLGSYSATFAVKELSSPKEDISKGELCHLMTLEKNETYGI

SEQ ID NO: 14606 - protein, 81 aa, Canis lupus
MIAVTFEDVAVDFTQEEWILLDLNQRNLYRSVMLENYQNLVSVEYQLSKPKLVAWLEQQELRTVETGVFQEWEMRPQTKES

SEQ ID NO: 14607 - protein, 81 aa, Canis lupus
FHEPVTFEDVILGFTSEEWGLLDLQQKSLYREVMLENYRNLVSVEHQLSKPDVVSQLEEEEALWSVERGIPQDTFSEYPAT

SEQ ID NO: 14608 - protein, 81 aa, Canis lupus
MAMYLTREEWRPLDPTQRDLYRDVMQENYGNVVSLDFEIRSENEVNPKQEISEDVEFGTASERPVGNTEENAENEEGFESG

SEQ ID NO: 14609 - protein, 81 aa, Canis lupus
KVPVTFVDIAVYFSEDEWKNLDEWQKELYNNLVKENYKTLMSLDPEGAGPKPDAPSQVEPREEPCVWEQRDPEEREILMDP

SEQ ID NO: 14610 - protein, 81 aa, Capra hircus
CQERLTSEDVAIEFTQEEWEFLDPDQRALYRDVMLETYRNLLSVGEDDFLPELPLDIAPTHVIKLLQPKVNSDKQETFQKL

SEQ ID NO: 14611 - protein, 81 aa, Capra hircus
PQAKVTFEDVAVFLSQDEWDRLGPAQRGLYRHVMMETYGNVVSVGIPGSKPEVISQLERGEEPWVLDKQGLQSAILRCEHK

SEQ ID NO: 14612 - protein, 81 aa, Capra hircus
LQGSFSFEDLSVDFTQKEWQLLDPHQKDLYKDVMLENYSSLVSLGYEVMKPGVILKLEQGEEPWTGDGEIPSSDSLDQVFQ

SEQ ID NO: 14613 - protein, 81 aa, Capra hircus
MEAVTFKDVAVAFTEEELGLLDSAQRKLYQDVMVENFRNLVSVEENNQSELRAVEERGLHEELSCWQIWQQIANDLTRCQD

SEQ ID NO: 14614 - protein, 81 aa, Capra hircus
SQEQVSFKDVCVDFTQEEWYLLDPAQKILYRDVILENYSHLVSVGNCITKPEVIFKIEQGEEPWILEERFPKQYRSEDWKV

SEQ ID NO: 14615 - protein, 81 aa, Capra hircus
DLDQVTFEDVVVDFTREEWGCLEPAQRTLYRDVMLETFRLLVSVGHWLPKPDVISLLEQEAELWAADEGGPRGMCPDLETR

SEQ ID NO: 14616 - protein, 81 aa, Capra hircus
MDSVVFEDVAVNFTLEEWELLDPAQRKLYRDVMLETCRNLATVGSCPQVKVSVSSPQWDVLETELCIEREVVRFTRNDSRS

SEQ ID NO: 14617 - protein, 81 aa, Capra hircus
VMFRDVAIDFSQEEWDCLDSAQRDLYRDVMLENYSNLVSLDLPSRGANKLLSPKKDIYETELSQWEMSAGLENCDLENSSS

SEQ ID NO: 14618 - protein, 81 aa, Capra hircus
AHGSLTFSDVAIGFSQQEWECLDPVQKTLYRDVMMENYGNLVSLGHSISKPNVITLLEQGKEPWIVVREETRSWCTDLDSR

SEQ ID NO: 14619 - protein, 81 aa, Chrysochloris asiatica
HKVSVSFEDVTVEFSREEWQHLDSAQRRLYRDVTLENYSHLLSVGYQVPKPEVIFKLEQGEEPWTLETETLHQSCSEELWQ

SEQ ID NO: 14620 - protein, 81 aa, Chrysochloris asiatica
TASSQEPMTFKDVAMDFTPEEWGKLDPAQRDVMLANYRNLVSLWLPVSKAENYNLENGKEPWMFERKNPKSSSTDWEARPE

SEQ ID NO: 14621 - protein, 81 aa, Chrysochloris asiatica
LQDLVTFEDVAVEFTQEEWALLDPSQRKLYRDVMLENSRNLASLGNQVGKPSLKAQLEQEDKVMTEKRRILPGSCLDLETV

SEQ ID NO: 14622 - protein, 81 aa, Chlorocebus sabaeus
LVTFRDVAIDFSQEEWECLDPAQRDLYRDVMLENYSNLISLDLESSRATKELSPEKEIYEMESLQWENMGKLINHHLQYNG

SEQ ID NO: 14623 - protein, 81 aa, Chlorocebus sabaeus
SVALEDVAVNFTQEEWALLSPSQKNLYRDVMLETFRNLASVGIQWKDQDTENLYQNLGIKLRSLGERLCGRKEGSEHRETF

SEQ ID NO: 14624 - protein, 81 aa, Suricata suricatta
LGSMSFKGVTVDFTRDEWLQLTGTQRTLCRGVMLENYSHPAAVGGGARCVSISLNLLKLTQERKPLKVVTAGSVFYQESHL

SEQ ID NO: 14625 - protein, 81 aa, Suricata suricatta
MLENYGHLLFLGLVVLKPDLVTFLEQKQDLWDVKGKETIASYPALSSNANERLPPRIFIESSFQNVSVDRYKHRALENGPL

SEQ ID NO: 14626 - protein, 81 aa, Chlorocebus sabaeus
TDAQLTFKDVAIEFSQEEWTCLDPAQKILYRDVMLENYRNLVSLAGISPFDLSIISLLEQGKEPWNVDSQEKIASGSGSEA

SEQ ID NO: 14627 - protein, 81 aa, Suricata suricatta
AAVTMTFDDVALYFSEQEWEILEKWQKKMYLQVMKTNYETLDSLGGVFSKPDLITWMEQGRTLLIRDQGPLENRVTLSLSA

SEQ ID NO: 14628 - protein, 81 aa, Chlorocebus sabaeus
VAFEDVAVNFTQEEWALLDIFQKNLYREVMLETFRNLTSIGKSWKDQNIEYEYQNPRRNFRSLMEDKVHEIKEDSHCGETF

SEQ ID NO: 14629 - protein, 81 aa, Suricata suricatta
AHGSVTFRDVAIDFSQEEWEFLDSAQRDLYRDVMWENYSNFISLDLESRYRTNTLSPEKDIYEIYSFQWEIMERIKSYSLQ

SEQ ID NO: 14630 - protein, 81 aa, Mandrillus leucophaeus
GKELLSFEDVAMYFTREEWGHLDWGQKDLYRDVMLENYRNMVLLGFQFPKPEVICQLENWDEQWILDLPRAGSRKASGSAC

SEQ ID NO: 14631 - protein, 81 aa, Suricata suricatta
YQEFVTFEDVAVHLTREEWGCLDPVQRNLYREVMLENYGNVVSVGFSISMPDGISQLEQDLQVFDLETKNREGLRDDCSDG

SEQ ID NO: 14632 - protein, 81 aa, Mandrillus leucophaeus
PQESVTFKDVSVDFTQEEWYHVDPAQRSLYRDVMLENYSHLVSLGYQVSKPEVIFKLEQGEEPWISEGEIQRPFCPDWKTR

SEQ ID NO: 14633 - protein, 81 aa, Mandrillus leucophaeus
AQVSVTFDDVAVTFTQEEWGQLDLAQRTLYQEVMLENCGLLVSLGCPVPRPELIYHLEHGQEPWTRKEDLSQDTCPGNKGK

SEQ ID NO: 14634 - protein, 81 aa, Mandrillus leucophaeus
AQESLTLEDVAVDFTWEEWQFLSPAQKDLYRDVMLENYSNLVAVGYQASKPDALSKLEQGEEPCTTEDEIYTRICCGGQPQ

SEQ ID NO: 14635 - protein, 81 aa, Sus scrofa
MLENYSHLISVGYCIPKPELIFRLEQGEQPWILEEESPSQSYPGVCRVDNQLEQSQEIQNRQFWQAPLINNNALTIERGNV

SEQ ID NO: 14636 - protein, 81 aa, Sus scrofa
PQAAVSFKDVTVAFTQEEWQQLDSAQRTLYRDVTLENYSHLVSVGYCFTKPELIFMLEQGDDPWLLEKEFVKRRSPEEYQP

SEQ ID NO: 14637 - protein, 81 aa, Mandrillus leucophaeus
GWVPALFDEVAIYFSDEEWEVLTEQQKALYREVMRMNYETVLSLEFPFPKPDMITRLEGEEESQNSDEWQLHGGTSAENEE

SEQ ID NO: 14638 - protein, 81 aa, Sus scrofa
QQRAVSFKDVVVGFTEEEWHRLNPAQRALYRDVMLETYSNLVSVGYKGTKPYVILRLEQQEAPWICEAACSGCHCRENIWQ

SEQ ID NO: 14639 - protein, 81 aa, Mandrillus leucophaeus
GPLTFTDVAIEFSLEEWQGLDTAQQNLYRNVMLENYRNLVFLGITVSKPDLITCLEKEKEPWNMKRHEMVDEPPVICSHFA

SEQ ID NO: 14640 - protein, 81 aa, Sus scrofa
AHMAFRDVAVDFTQEEWMLLSPAQRSLYREVMLENYSNMVSLGIPFSKPKLITQLEQGKETWREERKCPPATCSAEPQPEL

SEQ ID NO: 14641 - protein, 81 aa, Mandrillus leucophaeus
AKGLPSNDTDWPQEKEGKAQIVVPVTFRDVAVIFTEAEWKRLSPEQRNLYKEVMLENYRNLLSLGQEIETILANMVKPRLY

SEQ ID NO: 14642 - protein, 81 aa, Sus scrofa
AVTFKDVAVTFTEEELGLLDSTQRKLYRDVMLENFRNLLSVGSKNPNEMETLRKVALKYLSHEELSCWQIWKQVAGDLTRR

SEQ ID NO: 14643 - protein, 81 aa, Sus scrofa
VSVTFDDVAVTFTQEEWGQLDPAQRTLYQEVMLENRGLLVSLGEQGKPTTTKPTTCERALSGGASFQEHLAQGASEDSRLG

SEQ ID NO: 14644 - protein, 81 aa, Neophocaena asiaeorientalis
DSVTCEDVAVNFTLEEWALLNPTQKKLYRDVMQETFRNLASVGTKWDDDDIEEQYKNQGGKPRNHTVVRFSEHKDHNPCGG

SEQ ID NO: 14645 - protein, 81 aa, Neophocaena asiaeorientalis
AHGSVTFRDVAIDFSQEEWEFLDSAQRDLYRDVMWENYSNFISLAGPSISKPDVITLLDEGKEPWMVVREGTRRHHPDLES

SEQ ID NO: 14646 - protein, 81 aa, Bos mutus
VTFKDVTVEFTREEWKLLDTAQRTLYREVMQENYSHLISVGYCANRPNAIFKLKQGKEPWILEVQFPRQNNPELIQNTPNF

SEQ ID NO: 14647 - protein, 81 aa, Nomascus leucogenys
QGTVTFEDVAVHFSWEEWGLLDEAQRCLYRDVMLENLALLTSLDVHHQKQHLGEKHFRSNVGRALFVKTCTFHVSEEPSTC

SEQ ID NO: 14648 - protein, 81 aa, Nomascus leucogenys
KSQESLTLEDVAVEFTWEEWQLLGPAQKDLYRDVMLENYSNLVSVGYQASKPDALFKLEQGEPWTVENDSHICPEIKKVDN

SEQ ID NO: 14649 - protein, 81 aa, Nomascus leucogenys
MLENYNSIVSLGLPVPQPDVIFQWKRGDKPWMVDLHGSEEREWPESVPLDWETKPEIHDASDEKSEGSLRECLGRQSPLCP

SEQ ID NO: 14650 - protein, 81 aa, Canis lupus
MNRSQEEWYLLDPAQKILYRDVILENYSHFVSVGYCITKPEVVFKIEQGEEPWILEAGFPSHCHQEDWKVADLIESSQNNE

SEQ ID NO: 14651 - protein, 81 aa, Suricata suricatta
ITGLLTFRDVAIEFSQEEWGCLSHSQRELYRDVMLENYGHLLFLDLVVLKPDLVTFLERKRELWDVKRKETVASYPGSTNL

SEQ ID NO: 14652 - protein, 81 aa, Suricata suricatta
GYLSHSQWELYRDVMLENYRHLLFLGLIVSKPDLVIFLEKKWVLWDVKRKETVMTAGGGGGGVSVDPYKPSAVENGPLVMD

SEQ ID NO: 14653 - protein, 81 aa, Chrysochloris asiatica
FQGSLSFEDVAVGFTWEEWQFLDPSQKDLYKDVMLENYNHLVSVGYPATKPDSIFRLEQGETPWIVEGAIHTRTSAGEDAE

SEQ ID NO: 14654 - protein, 81 aa, Chrysochloris asiatica
CRESVTFRDVAVLFSQEEWLYLDLAQRTLYRNVMLENYRNLVSLGIPFSKPKVISQLQQGEDPWMMEKGTPPGTCQGVKME

SEQ ID NO: 14655 - protein, 81 aa, Chrysochloris asiatica
LSPPRPRLRMFLGPLKTQWDLLDPAQRKLYRDVMVETLRNLASVGAIKKSRDWKDHLDNQERHLRIHMRTHSGERPYECKE

SEQ ID NO: 14656 - protein, 81 aa, Chlorocebus sabaeus
AQVSVTFEDVAVTFTQEEWGQLDAAQRTLYQEVMLETYGLLMSLGCPLFEPELIYQLDCREELWIVKKDLSWPVLPGDNTK

SEQ ID NO: 14657 - protein, 81 aa, Chlorocebus sabaeus
LQGLVSFKDVAVDFTQEEWQQLDPAQRTLYRDVMLENYSHLVSMGYPVSKPDVISKLEQGEEPWIIKRDISNWIYPDEYQA

SEQ ID NO: 14658 - protein, 81 aa, Chrysochloris asiatica
MLENYSHLVSLGYQVTKPDALSRLDSGDWPWISQQFASSQICISSIIHTGVKPHRCHLCGEAFSRQFKLAQHLRRIHRGEK

SEQ ID NO: 14659 - protein, 81 aa, Suricata suricatta
CQESVTFEDVAVIFTEEEWTHLVPIQRDLYKEVMLENYKSIVSLGLPVPRPDVIFQLKRGDEPWIVDLHGSEESDCPETIS

SEQ ID NO: 14660 - protein, 81 aa, Chrysochloris asiatica
MLENYRDFVSLGLLVPNPDVIFQLERGEEPWMLDFQEAEEKEGPEGLNARPNGQDSTQRQKVSKNAKPQNTLMGNIRKNGL

SEQ ID NO: 14661 - protein, 81 aa, Suricata suricatta
LVTFRDVVISFSQEEWECLDSAQRNLYWDVMMENYSNLVSLDLESKYDTKCLFNGKDIIDSPQCKEIESKFVGLENSTFRN

SEQ ID NO: 14662 - protein, 81 aa, Suricata suricatta
LQGQLTFQDVAVEFSQEEWGRLNHRQRELYADVILETYGHLLFLGLLVSKPDLVIFLEHEKEMRGVKRQETVASHPAISSP

SEQ ID NO: 14663 - protein, 81 aa, Chlorocebus sabaeus
FQEPVTFEDVAVYFTQNEWASLHPTQRALYREVMLENYANVTSLLAFPFPKPALISHLERGEAPWGPDPWDTEIPRGISQG

SEQ ID NO: 14664 - protein, 81 aa, Mandrillus leucophaeus
QGLLTFRDVAIEFSQEEWKCLDPAQRTLYRAVMLENYRNLVSLAISSKCMMKEFSSTVQGNREVLHTGTLQRHESHHIGDF

SEQ ID NO: 14665 - protein, 81 aa, Mandrillus leucophaeus
LAHLMMFRDVAVDFCQEEWECLDLEQRDLYRDVMLENYSNLVSLGLCIYQPEVFSLLEKGKEPWKILRDETRGPCPDMQSR

SEQ ID NO: 14666 - protein, 81 aa, Mandrillus leucophaeus
DSISLEDVAVNFTLEEWALLDPGQRNIYRDVMRATFKNLACIGEKWKDQDVEDDPKNQGRKPSSPTVETLCENKEDRPCGK

SEQ ID NO: 14667 - protein, 81 aa, Mandrillus leucophaeus
FQEAVTFKDVAVAFTEEELGLLDSAQRKLYRDVMLENFRNLVSVGHQSFKPDMISQLEREEKLWMKEFQTQRGKHSGFLCF

SEQ ID NO: 14668 - protein, 81 aa, Mandrillus leucophaeus
GTVAFEDVAVNFSQEEWSLLSEVQRCLYHDVMLENWVLISSLGYWCGSEDEEAPFKRNILQLADHQGTHHKQKLHRCEAWG

SEQ ID NO: 14669 - protein, 81 aa, Sus scrofa
YQEFVTFEDVAVHLTREEWGCLDPVQRDLYREVMLENYGNLVSLGFPLAKPDGISQLEQDLQVFDLETEHRDVLRDDCSDG

SEQ ID NO: 14670 - protein, 81 aa, Sus scrofa
KEAVTFKDVAVVFTEEELGLLDLTQRKLYQEVMLENFRNLVSVGGKIQHETETVPEAGPHEDLSCWQIWQHIARDLTRCQD

SEQ ID NO: 14671 - protein, 81 aa, Sus scrofa
VAFEDVAVNFTPEEWALLGPSQKKLYRDVMRETLRNLASVGKKWEDHNTEDQYKVQGRNLRSQTLESLCKSEEGSQCGEDF

SEQ ID NO: 14672 - protein, 81 aa, Bos mutus
GWVPALFDEVAIYFSDEEWEVLTEQQKALYREVMRMNYETVLSLEFPFPKPDMITRLEREEESQNSDEWQLQGGTFAEKEE

SEQ ID NO: 14673 - protein, 81 aa, Neophocaena asiaeorientalis
YQELVTFRDVAVDFSQEEWDCLNSSQRHLYSNVMLENYRILVSLGLCFSKPSVILLLEQGKEPWMVKRELTKDLCSDWESL

SEQ ID NO: 14674 - protein, 81 aa, Neophocaena asiaeorientalis
KSKSKAPVTFGDLAIYFSQEEWEWLSPIQKDLYEDVMLENYQNLVSLGLSFRRPNVITLLEKGKAPWMVEPVKRRRGLGPL

SEQ ID NO: 14675 - protein, 81 aa, Neophocaena asiaeorientalis
PALGSVTFEDVAVYFSQEEWKLLDEAQRFLYHDVMLETFALAASLGLSSSRYHVVQLELRGEPWVHDRVDMTPDRARGAQI

SEQ ID NO: 14676 - protein, 81 aa, Neophocaena asiaeorientalis
QGHVIFEDVAVSFSQEEWGLLNDAQRLLYCDVMLENLSLIASLGCWHGVEAEEAVSEQCVSVEQVTEDRNPKLEPSILKPL

SEQ ID NO: 14677 - protein, 81 aa, Bos mutus
ESVTFEDVAVDFTQEEWSLLDKSQKNLFRNVMLETVSHLVSVGNQISKSEVISQLEQGKELWTAAAGGLQGQSPGERQGPG

SEQ ID NO: 14678 - protein, 81 aa, Nomascus leucogenys
AQESLTLEDVAVDFTWEEWQFLSPAQKDLYRDVMLENYSNLVAVGYQARKPDALSKLERGEEPCTTEDEIYARICSGGQPQ

SEQ ID NO: 14679 - protein, 81 aa, Nomascus leucogenys
FQGSVSFKDVTVGFTQEEWQHLDPSQRALYRDVMLENYSNLVSVGYCVHKPEVIFRLEQGEEPWRLEEEFPSQSFPEVWTA

SEQ ID NO: 14680 - protein, 81 aa, Nomascus leucogenys
TQGHLTFRDVAIEFSQEEWKCLDPVQKALYRDVMLENYRNLVSLGICLPDLSVISMMKQRTEPWTVENEMKVAKNPDRWEG

SEQ ID NO: 14681 - protein, 81 aa, Nomascus leucogenys
RVQSCVTFEDVFVYFSREEWELLEEAQRFLYRDVMLENFALVATLAFIFPVPCSCAVGGGRPWVPDRADITAATVKETYRG

SEQ ID NO: 14682 - protein, 81 aa, Nomascus leucogenys
QQGYVTFEDVAVYFSQEEWRLLDEAQKLLYRNVMLENFSLLASLGLASSKTHEITQLESWEEPFMPAWEAVTSATPRGCWH

SEQ ID NO: 14683 - protein, 81 aa, Nomascus leucogenys
MRNMIPDNENPPQQGEADQNDSVAFEDVAVNFTPEEWALLDPSEKNLYREVMQETLRNLASIEVLWKRDSLKMKVISMEKF

SEQ ID NO: 14684 - protein, 81 aa, Nomascus leucogenys
DSISLEDVAVNFTLEEWALLDPGQRNIYRDVMRATFKNLACIGEKWKDQDIEDDYKNQGRNLRSPMVEALCENKEDRPCGK

SEQ ID NO: 14685 - protein, 81 aa, Nomascus leucogenys
EPGAVNFADVAVYFCREEWGCLRPAQRALYRDVMRDTYGHLSALGIGGHKPALISWVEEEAELWGPAAQDPEMAKCQTETD

SEQ ID NO: 14686 - protein, 81 aa, Nomascus leucogenys
SQTLVTFKDVFVDFTREEWKLLDTAQQIVYRNVMLENYKNLVSLGYQLTKPDVILRLEKGEEPWLMERGIHQETHPDSETA

SEQ ID NO: 14687 - protein, 81 aa, Nomascus leucogenys
YQIPVSFKDVVVGFTQEEWHQLSPAQRALYRDVMLETYSNLVSVGYEGTKPDVILRLEQEEAPWIGEAACLGCHCWGISKL

SEQ ID NO: 14688 - protein, 81 aa, Canis lupus
GLVTFRDVAIDFSQEEWECLDPAQRDLYVDVMLENYSNLVSLDLESTYETKNTNSEKDIFEINFSQWEVKERSKTLGLEAS

SEQ ID NO: 14689 - protein, 81 aa, Canis lupus
AQGLVTFRDVAIEFSQEEWKCLEPAQRDLYKDVTLENFSNLVSLGLSISKPDVISLLEQGREPWMITNDMTGLWCPELESR

SEQ ID NO: 14690 - protein, 81 aa, Canis lupus
SQGLVTFRDVALDFSQEEWEWLDPSQKDLYRDVMLENYRNLVWLGLSISKPNMISLLEQGKEPWMVEKEMSDDWESWYEIK

SEQ ID NO: 14691 - protein, 81 aa, Muntiacus muntjak
ALERLTSEDVAIEFTQEEWEFLDPAQRALYRDVMLETYRNLLSVDPMEAAAAENMCDFECQGRDDKRNYKGTPVSLDGNVP

SEQ ID NO: 14692 - protein, 81 aa, Muntiacus muntjak
TTVELKLPDLPANEKVSVSFEDVTVDFSREEWQHLDSAQRRLYQDVMLEIYSHLLSLGKPSQNVNLRGTLWVKCCPFKKTC

SEQ ID NO: 14693 - protein, 81 aa, Canis lupus
QLTFKDVAIKFSEEEWECLDSAQRALYRDVMLENYRNLVSLDSSASFMIKELLPKKEINNRKLCQPVVLGRQESHDLEDFD

SEQ ID NO: 14694 - protein, 81 aa, Chrysochloris asiatica
FQKLVTFEDVAVYFTQAEWDGLSPTQRVLYRDVMLENYGHVASLGFPLLKPAVISQLEGGGDLWGPPPVPTGMEIGPQGLW

SEQ ID NO: 14695 - protein, 81 aa, Chlorocebus sabaeus
EEGYVTFEDVAVYFSQEEWRLLDEAQRLLCHNVMLENFSLLSSLGLASSKTHDITQLESWKEPFMPASEVVTSAILRDCWH

SEQ ID NO: 14696 - protein, 81 aa, Suricata suricatta
AQGLVTFRDVAIEFSQEEWKCLEPAQRSLYRDVTLENFSNLVSLGLSISKPDVISLLEQGREPWMIANDMTGPWCPELESR

SEQ ID NO: 14697 - protein, 81 aa, Chlorocebus sabaeus
FQLPLTFEDVAIYFSEQEWQDLEAWQKELYKHVMRSNYETLISLDDGLPKPELISWIEHEGEPFRNWRESQKSGNIICSSG

SEQ ID NO: 14698 - protein, 81 aa, Chlorocebus sabaeus
MLYFGDSEAKQLAQVLLLFPLTGYDITKPNVIIKLEQGEEPWIMEGEFPCQHSPEVWKFDDLIERIQENEDKHSRQAACIN

SEQ ID NO: 14699 - protein, 81 aa, Suricata suricatta
LQGLLTFRDVAIEFSQEEWGCLNHSHQRELYRDVMLENYGHLLFLGLVLKPDLVFLLERKQEHLGTPFPENDYECIKNGEF

SEQ ID NO: 14700 - protein, 81 aa, Chrysochloris asiatica
LQGLVLFKDVTVDFSRDEWQQLDLAQKSLARDVMLENYFSLVSVGYHISKPQVIFNFEQGEEPYLLDDCEIWYQSCLVGDI

SEQ ID NO: 14701 - protein, 81 aa, Chrysochloris asiatica
ILEPVTFEDVTVVFTEAEWKRLSSEQKSLYREVMLEIYRNLFSLAESKPEIYPSSSCLLAFPCQQFLSQHMLQIFPGFCAD

SEQ ID NO: 14702 - protein, 81 aa, Suricata suricatta
SQDLVTFKDVAIDFSQEEWEWLNSAQRNLYKNMMLENYQNLVSLGLCLPKPYVIASLEQGRAPWEMKNEMTGSPELILEKN

SEQ ID NO: 14703 - protein, 81 aa, Chrysochloris asiatica
TLGLLTFRDVAVEFSQEEWDCLDPAQRALYWDVMLENYGNLVSLGIPPSGTNIVSILKKETEFWAVEKTTELAEHPELLEQ

SEQ ID NO: 14704 - protein, 81 aa, Mandrillus leucophaeus
NKGPVTLKDVIVEFTKEEWKLLTPAQRSLYKDVMLENYSHLVSVGYHVNKPNAVFKLKQGREPWILEVEYPHRGFPEDLWS

SEQ ID NO: 14705 - protein, 81 aa, Mandrillus leucophaeus
TFKEGLTFKDVAVVFTEEELGLLDPVQRNLYRDVMLENFRNLLSVGHHPFKHDVFPLEKEKKLGMMKTATQRKGKSADKIQ

SEQ ID NO: 14706 - protein, 81 aa, Sus scrofa
PQGSVSFKDVTVDFTQEEWQQLDPAQKALYRDVMLENYCHLISVGFHMTKPDMIRKLEQGKELWTTEKIFPSQSYPEEDGT

SEQ ID NO: 14707 - protein, 81 aa, Mandrillus leucophaeus
VAFEDVAVNFTHEEWALLGPSQKNLYRDVMRETIRNLNCVGMDDIINVLFVFYRCDVVERFGKSKDGSQCEETLSQIRNST

SEQ ID NO: 14708 - protein, 81 aa, Mandrillus leucophaeus
EMGPLTFRDVAIEFSLEEWQCLDTAQQDLYRKVMLENYRNLVLAGIDVSKPNLITCLEQGKDPWNMKRHSMVVKPPVETRF

SEQ ID NO: 14709 - protein, 81 aa, Sus scrofa
QEGVNFRIVTVDFTQEEEGTLNTAQRALDRDVILEDHRDIVSWESVTALGKRESTSKQSIVDDEPSRRVKIERLTRDSSWL

SEQ ID NO: 14710 - protein, 81 aa, Sus scrofa
FRGPVTFKDITVEFTQEEWQLLDNAQRTLYREVMQENYHHLISVGYCVNKPNAVFKLKQGKEPWILEVEFPRRNNPEDLWN

SEQ ID NO: 14711 - protein, 81 aa, Mandrillus leucophaeus
SQESVTFQDVAVDFTEKEWPLLDSSQRKLYKDVMLENYSNLTSLGYQVGKPSLISHLEQEEEPRTEERGTHQGACAGERER

SEQ ID NO: 14712 - protein, 81 aa, Mandrillus leucophaeus
EMGLLTFRDVAIEFSLGEWQCLDRAQQNLYRDVMLENYKNLVSLGIAVSKSDLITHLEQNKEPRNIKKNEMLAKHPVMCSH

SEQ ID NO: 14713 - protein, 81 aa, Sus scrofa
KSWGPLSFMDVFVDFTWEEWQLLDPAQKHLYRSVMLENYSNLVSLGYQHTKPRIIFQLEQEEPRLMQIPSQGHPDKVWEID

SEQ ID NO: 14714 - protein, 81 aa, Mandrillus leucophaeus
QEPLSFKDVAVVFTEEELGLLDSTQRQLYRDVMLENFRNLLSVGERNPPGDKNGRDMEYIQDEELRLFSHEELSSCKIWEE

SEQ ID NO: 14715 - protein, 81 aa, Sus scrofa
VTFRDVAVFFSQDEWLCLDSAQRTLYREVMLENYSTLFSLGWESLFETTVSEEENKEVMNKLIGDGPFDFKLGKIYINEDK

SEQ ID NO: 14716 - protein, 81 aa, Bos mutus
QDPVTFEEVSVDFSQEEWAQLAPAQKILYQDVMLENYRNLTSVGYHLRRPRLLTQEELRTRKRRLLQDTCAEGNDNPLQYS

SEQ ID NO: 14717 - protein, 81 aa, Neophocaena asiaeorientalis
APLPLTFEDVAVYFSEQEWRDLEPWQKELYKQVMRTNYEILVSLGDGLPKPELISWLEQGRELFRIWGESQKSGNIICTSA

SEQ ID NO: 14718 - protein, 81 aa, Nomascus leucogenys
SQESVTFQDIAVDFTEKEWPLLDSSQRKLYKDVMLENYSNLTSLGYQVGKPSLISHLEQEEEPRTEERGAHQGACADWETP

SEQ ID NO: 14719 - protein, 81 aa, Nomascus leucogenys
VMFRDVAIDFSQEEWECLDSAQRDLYRDVMLENYSNLVSLDLPSRCASKDLSPEKNTYETQLSQWEMSDRLENCDLEESNS

SEQ ID NO: 14720 - protein, 81 aa, Nomascus leucogenys
VKESVTFKDVAIDFTLEEWRLMDPTQRNLHKDVMLENYRNLVSLGLAVSKPDMISHLENGKGPWVTVREISRIPCPDMEPK

SEQ ID NO: 14721 - protein, 81 aa, Nomascus leucogenys
VTFEDVTIIFTWEEWKFLDSSQKSLYREVMWENYTNVMLVENWNESYKSQEEKFRYLEYENFSCWQGWWNAGTQMYENQNY

SEQ ID NO: 14722 - protein, 81 aa, Nomascus leucogenys
MKPAQRNLYRDVMLENYSNLVTVGCQVTKPDVIFKLEQEEEPWVMEEEMFGRHCPGFFFVLQCENTSYFLSCYFADWELGR

SEQ ID NO: 14723 - protein, 81 aa, Bos indicus
MAGQDLAVRFSEDEWRLLGEGQRALYLDVMRENYDTLASLGTAEPLPLSAFLSPSEPGGAVGARSRAGDRQEPPQGGGPLG

SEQ ID NO: 14724 - protein, 81 aa, Bos indicus
WSQMPVTFEDMALYLSREEWGRLDHTQQSFYREVLQKRSGLSLAGFPFSRPFWASQVQGKGEAPGSSRQLGHEEEEKRGVV

SEQ ID NO: 14725 - protein, 81 aa, Bos indicus
MLENYRNLVSVEHQLSKPDVVSQLEEEEELWSVERGIPQDTFSECPEAQLEPQLDPFPAGNPLMNIEVVEVLTLNQEVAVP

SEQ ID NO: 14726 - protein, 81 aa, Canis lupus
PWLPLTFEDVAIYFSEHEWPNLEAWQKELYKHVMRTNYEILVSLDGRLPKPELISWIEQGREFFKNWGESQKSGNIICPSA

SEQ ID NO: 14727 - protein, 81 aa, Canis lupus
SKVPVTFGDLAIYFSQEEWEWLSPIQKDLYEDVMLENYQNLVSLGLSFRRPNVITLLEKGKAPWVVEPVRKRRGLDSGFKC

SEQ ID NO: 14728 - protein, 81 aa, Canis lupus
GQGSVTFRDVTVEFTRDEWLQLTGTQRTLYRDVMLENYSHLLSVGCHLTKPEVIFRLEQGEDLWPSEGEFPDQGDQDRSEE

SEQ ID NO: 14729 - protein, 81 aa, Canis lupus
SQGSLSFGDVTVDFSQEEWQHLDPDQRTLYRDVMLENYHNFVSVGYLIKKPAVIFKLEEGKEPWIVEEELLYQNYQAQGKQ

SEQ ID NO: 14730 - protein, 81 aa, Canis lupus
SQGLVTFEDVAVYFSLEEWERLDTDQRDLYKDVMQENYGILVSLGYPIPKPDLIFRLEQGEEPWVPDSPRPEEGDIVTGVY

SEQ ID NO: 14731 - protein, 81 aa, Canis lupus
EEWALLNPSQKKLYRDVMQETFRNLCESIGNIHIFRKMPLITCFSFLRQACSKCGESFSQNPNHKQIKKTPTGIKLRKCSF

SEQ ID NO: 14732 - protein, 81 aa, Muntiacus muntjak
CEGLVSFEDVTMDFSREEWQQLDPSQRHLYQDVMLEIYSHFFSVGYHIPNPEIIFRIEEGKEPWVRETELPCQRYHEGEFG

SEQ ID NO: 14733 - protein, 81 aa, Canis lupus
EPVTFADVAVLFTPEEWMFLDSAQRNLYRDVMLENYRNLASVGKARLVTSSAHSCSTYRFPECAEPPLQPQDSISNQDIFA

SEQ ID NO: 14734 - protein, 81 aa, Muntiacus muntjak
APVTFDDITVYLLQEEWVLLSQQQKNICGSDKMVAPLGPSIASPELFYKLEQGPEPWLASVQGQRSHLSPNPGKNKMGFME

SEQ ID NO: 14735 - protein, 81 aa, Muntiacus muntjak
HLTFKDVAVEFSQEEWECLDPAQRALYRDVMLETYRNLLSVAVSHIHVIKKLKPKANSDTGVFQRVMLGRYESHEIRDFYF

SEQ ID NO: 14736 - protein, 81 aa, Mandrillus leucophaeus
MGPLTFRDVAIEFSLKEWQCLDTAQRNLYRNVMLENYRNLVFLVMCSHFAQDLWPEQNIKDSFQKATLKRYGTCRHENLPL

SEQ ID NO: 14737 - protein, 81 aa, Mandrillus leucophaeus
LQEPVTFRDVAVDFTQEEWGQLDPTQRILYRDVMLETFGHLLSIGPELPKPEVISQLEQGTELWVAERGTIQGCHPGWEPP

SEQ ID NO: 14738 - protein, 81 aa, Mandrillus leucophaeus
IQGQVNFEDVFVYFSQEEWVLLDEAQRLLYRDVMLENFALMASLGHTSFMSHIVASLVMGSEPWVPDWVDMTLPVATETLG

SEQ ID NO: 14739 - protein, 81 aa, Mandrillus leucophaeus
SKAPITFGDLAIYFSQEEWEWLSPIQKDLYEDVMLENYRNLVSLGLSFRRPNVITLLEKGKAPWMIEPVRRRRAPDSGSKC

SEQ ID NO: 14740 - protein, 81 aa, Mandrillus leucophaeus
PDLVMFRDVAVDFSQEEWECLNSYQRNLYRDVILENYSNLVSLGKHSISVSNNLVIHRTEFLDLESRYDTKKLFQEKDIYE

SEQ ID NO: 14741 - protein, 81 aa, Mandrillus leucophaeus
WSQNSVTFQEVAVDFSQEEWALLDPAQKNLYKDVMLENFRNLASVGYQLCGHSLISKVDQEELKTDERGILQGDCADWETR

SEQ ID NO: 14742 - protein, 81 aa, Mandrillus leucophaeus
YLGPVTFEDVAVLFTEAEWKRLNLEQRNLFKEVMLENLRNLVSLESKPEVHTCPSCPLAFGSQQFLSQDELHNHPIPGFHA

SEQ ID NO: 14743 - protein, 81 aa, Sus scrofa
PEDTVTFEDVAVVFTDEEWRHLIPIQRDLYKEVMLENYKSIVSLGLPVPGPDVIFQLKRGDEPWIEELHGSEGKECAENVY

SEQ ID NO: 14744 - protein, 81 aa, Sus scrofa
FHPVAFEDVAVNFTQEEWECLDAGQRVLYQEVMSETFRNLMSVGKKLGFLHKHPVPGLQDLWFPWAGRSVQLTSLFLDSVP

SEQ ID NO: 14745 - protein, 81 aa, Sus scrofa
FSHIQGAAWSEASLYSHSFCTLPRPAENDHIPGYCVPEPEVILKLEQGEEPWVLEEEFSSQSYPELINSSRTYSRKVFNKG

SEQ ID NO: 14746 - protein, 81 aa, Sus scrofa
GPESVTFKDVAVDFTQEEWGQLDSPQRALYRDVMLENYQNLLSLGPPVCKPDVISHLERGEEPWQVPRDVPAGARSGEQDT

SEQ ID NO: 14747 - protein, 81 aa, Sus scrofa
WFQDLKFKDVAIYFSQKEWECLHFAQKDLYREVMFENYNNLIALAGFSNSKPDVISLLEQGKEPWLVRSKEIKNGVQPPGS

SEQ ID NO: 14748 - protein, 81 aa, Sus scrofa
SQDSVTFEEVTVDFSQEEWALLDPAQKILYRDVMLENFRNLASLGYQLCKHSLITEMEQEEQKPEGRGILQGAGTDWETQL

SEQ ID NO: 14749 - protein, 81 aa, Neophocaena asiaeorientalis
SQELLTFKDISVDLTQEEWGQLAPAHRNLYREVMLENYGNLVSVGYQLSKPGVISQLEKGEEPWLMEREISGGPSPDLEDE

SEQ ID NO: 14750 - protein, 81 aa, Neophocaena asiaeorientalis
FQDLVMFRDVTVDFSQEEWECLNSNQRNLYRDVILENYSNLVSLGGCSVSKPDVITLLEQGKEPWMVVRDEKRRRSLDLES

SEQ ID NO: 14751 - protein, 81 aa, Bos mutus
SVTFEDVAVYFSWNEWCLLDEVQIRLYLDVMLENFALVCMLGSCHGVQHAETCSEQNVFAEGASQISTLRAELSPENTQPC

SEQ ID NO: 14752 - protein, 81 aa, Neophocaena asiaeorientalis
KSPGSISFEDVTVNFTQEEWGQLDPDQRTLCRDVTLENYRILISLGHCITKPEEIFKLEQEAPWILEEEFASHCYPDELKV

SEQ ID NO: 14753 - protein, 81 aa, Neophocaena asiaeorientalis
SEELVTFKDVAVDFTQEEWGQLDSPQRALYRDVMLENYQNLLALGPPVCKPDVISHLERGEEPWWAPRAVPGGAGPEPEWE

SEQ ID NO: 14754 - protein, 81 aa, Neophocaena asiaeorientalis
KDQGLLTLEDVAVDFTWEEWQLLAPAQKDLYRDVMLENYSNLLSVGYQASKPDALSRLKRGEPWPVEDEIHSQICPEMRKD

SEQ ID NO: 14755 - protein, 81 aa, Bos mutus
QGPLMFQDVAIDFTQEEWECLDLSQRELYRDVMLQKYGNLASLGLVSKLDLVTFLEQLEDPRNIRRMGTTAIYPGNMENLK

SEQ ID NO: 14756 - protein, 81 aa, Neophocaena asiaeorientalis
MLENYRNLVALGHQLYKPEVITQLEREEQWMMERDCPPDSHPDGENSPEIKKSNQNISDENKTCDMLMERLTGDSFWYSIL

SEQ ID NO: 14757 - protein, 81 aa, Nomascus leucogenys
IQGQVNFEDVFVYFSQEEWVLLDEAQRLLYRDVMLENFALMASLGHASFMSHIVASLVMGSEPWVPDWVDMTLAVATETPG

SEQ ID NO: 14758 - protein, 81 aa, Nomascus leucogenys
AHALVTFRDVAIDFSQKEWECLDTTQRKLYRDVMLENYNNLVSLGYSGSKPDVITLLEQGKEPCMAARDVTGRQYPGLLSR

SEQ ID NO: 14759 - protein, 81 aa, Nomascus leucogenys
GWLTNYSQDSVTFEDVAVDFTQEEWTLLDQTQRNLYRDVMLENYKNLVAVDWESRINTKWSAPQENFLQGKTSSVVEMNSE

SEQ ID NO: 14760 - protein, 81 aa, Nomascus leucogenys
QSLLTFRDVAIEFSQEEWKCLDPAQRTLYRDVMLENYRNLVSLGISSKCTLKEFSSTAQGNREVIHTGTLERHESHHIGDF

SEQ ID NO: 14761 - protein, 81 aa, Nomascus leucogenys
LLTFRDIAIEFSLVEWQYLDHAQQNLYRDVMLENYRNLVSLVTRSYFTQDLHPEQGIKDSLQKVTPRTYGKCGHENLQFKK

SEQ ID NO: 14762 - protein, 81 aa, Nomascus leucogenys
EMELLTFRDVAIEFSLEEWQHLDVAQQNLYRNVMLENYRNLAFLGIAVSKPDLITCLEQGKKPWNMKRHEMVDEPPGICPH

SEQ ID NO: 14763 - protein, 81 aa, Nomascus leucogenys
CEASVSFEDVTVDFSREEWQHLDPAQRRLYWDVTLENYSHLLSVGYQVPKSEATFKLEQGEGPWTLEGEAPHQSCSGGAIG

SEQ ID NO: 14764 - protein, 81 aa, Nomascus leucogenys
PQGLLTFRDVAIEFSQEEWKCLDPAQRTLYRDVMLENYRNLVSLDISSKCMMNMFSSTGQGNTEVIHTGTLQRHASHHTGD

SEQ ID NO: 14765 - protein, 81 aa, Nomascus leucogenys
VQEPVTFKDVAVDFTQEEWGQLDLVQRTLYRDVMLETYGHLLSVGNQIAKPEVISLLEQGEEPWSVEQACPQRTGPEWVRN

SEQ ID NO: 14766 - protein, 81 aa, Nomascus leucogenys
YQDSVTFDDVAVDFTPEEWALLDTTEKYLYRDVMLENYMNLASVEWEIQPRTKWSSLQQGFLKNQIFSGIQMTRGYNGWKL

SEQ ID NO: 14767 - protein, 81 aa, Bos indicus
HSEERLTFQDVAIDFTQEEWECLDLGQRKLYRDVMLENYRNLASLGLVSKVDLVTFLELLKDPRNIRRMKTTAIYPAVSPQ

SEQ ID NO: 14768 - protein, 81 aa, Bos indicus
MLENYKSIVSLAGLPVPGPDVIFQLKRGDEPWLVEFHGFEGKEGAENVSLDWETKPEIQGASEEEKSEGSLKENLGRKGPP

SEQ ID NO: 14769 - protein, 81 aa, Bos indicus
DEALMAFRDVAVAFTQKEWKLLSPAQRTLYRDVMLENYSHMVSLGIAFPKPKLIIQLEQGDEPWREESECLLDLCAEGRKE

SEQ ID NO: 14770 - protein, 81 aa, Bos indicus
MAALDLCALPQEEWGLLGPAQKGLYREVMLETYRNLVSLGAGLAGPKPEVIAQLEQGDELWVLDMHGAEQPSVDGSAHGTR

SEQ ID NO: 14771 - protein, 81 aa, Bos indicus
MVENFRNLVSVGHVPFKADMVSQLETEEKLWTMERETQRNGHSSEIHSAVTSGSKIPNEMETLGKVMFKYLSCEELSCWQI

SEQ ID NO: 14772 - protein, 81 aa, Canis lupus
PQKSVTFEDVAVYFTQTEWDGLSPAQRALYRDVMLENYGNVASLGFSLLKPAVISQLEGAGELEGPSPLAAGTEIGPQGLW

SEQ ID NO: 14773 - protein, 81 aa, Muntiacus muntjak
QNGSVSFEDVAVGFSQEEWQLLGPSQKALCWDVMLENYCNLVSVGYQAPKPDSLFRLEQGRPPWKVKGAALSPTCAEEMWE

SEQ ID NO: 14774 - protein, 81 aa, Canis lupus
AQVSVTFDDVAVIFTQEEWGQLDPAQRTLYQEVMLENCGLLVSLGCPVPRPELLYQLKHGQELWMVKKDLCQSTYPGDKGK

SEQ ID NO: 14775 - protein, 81 aa, Muntiacus muntjak
MGRLMFRDVAIDFTQEEWECLDLGQRELYKDVMLENYGNLASLGLVSKLDLIASLEQLNNPRNIRRLETTAIYPGSLLLAC

SEQ ID NO: 14776 - protein, 81 aa, Canis lupus
PKGLLTFRDVAIEFSQEEWGCLNHTQRELYRDVMLENYGNLLFLGLIVSKPDLVSFLEQKKEPWSVKRKKRVTIHPAQRFG

SEQ ID NO: 14777 - protein, 81 aa, Canis lupus
QGTMPFGTMTAALTHHGWRPLIPAPRGTPRFKEGIPENVRNLVLLGLPVSQPGMNSQSEQREEGPWMLEGGGLRSTCPDWK

SEQ ID NO: 14778 - protein, 81 aa, Muntiacus muntjak
ISFEDVAVNFTLEEWQLLNPTQKTLYRDVMLENYSNLVLLGYQVIKPEVIFKLEQEKPWLLDEEILSQNFSEKVWLDNDLK

SEQ ID NO: 14779 - protein, 81 aa, Muntiacus muntjak
RTGPLTFGDVAVEFSGEEWAWLDSAQRSLHRSVMLENYRNLASLGLCMSKPEMISSLEQSKEPWAVKAKSTRGRCPDLNLC

SEQ ID NO: 14780 - protein, 81 aa, Muntiacus muntjak
MGRLTFRDVAIDFTQEEWECLDLGQRELYTDVMLENYGNLASLGLVSKLELVAFLEQMKDPTNIRRMETTAIYPEMYHLTH

SEQ ID NO: 14781 - protein, 81 aa, Sus scrofa
HVTFEDVAVSFSQEEWGLLSEAQRLLYCDVMLENLSLVASLDCWHGGEAEEAIPEQCVSIEQVAQARNPKLDPSFLKTLTS

SEQ ID NO: 14782 - protein, 81 aa, Mandrillus leucophaeus
FQEPVTFEDVAVYFTQNEWASLHPMQRALYREVMLENYANVTSLSAFPFSKPDLIFQLEQGEAAWGPDPWTLAGGEALRGM

SEQ ID NO: 14783 - protein, 81 aa, Mandrillus leucophaeus
ARGCVVFEDVFVYFSREEWELLDDAQRLLYHDVMLENFALLASLGIAFSRSCAVIKLEQAEEPWVYDQVDMTSATEREAQS

SEQ ID NO: 14784 - protein, 81 aa, Sus scrofa
WECLDLGQRHLYRDVMLEICRHLVSLGEDPFLPEFLFSHWVWDPAFAECLLPFSCPYNRFSDPTILGVTESWWVQVERLHN

SEQ ID NO: 14785 - protein, 81 aa, Sus scrofa
MLENHSSVAGLAGFLVFKPELISRLEQGQEPWVLDLQGTEGREAPRPSRTDSMIGSNSQQACEDVDILKPDSRVTMVKLLP

SEQ ID NO: 14786 - protein, 81 aa, Sus scrofa
KSWGPLSFMDVFVDFTWEEWQLLDPAQKHLYRSVMLENYSNLVSLGYQHTKPRIIFQLEQEEPRLMQIPSQGHPELLPCLM

SEQ ID NO: 14787 - protein, 81 aa, Sus scrofa
MLENYRSLVSLGVSASKPDVISLLEQGKEPWMMKKEGTRRACPDWEYASKNNEFSSKQVTYEESSKVVIMARSHLSYNLDC

SEQ ID NO: 14788 - protein, 81 aa, Sus scrofa
MWENYSNFISLAGPSISKPDVITLLDEGKEPWMVVREGTRRHHPDLESRYRTNTLSPEKDIYEIYSFQWEIMERIKSYSLQ

SEQ ID NO: 14789 - protein, 81 aa, Sus scrofa
TARSQASMTLKDVAMDFTPEEWGELDPAQRAVMLENYRNLASLWLPVSKPDNYSLKNGKEPSMLERKVPKSSCSDLETRPE

SEQ ID NO: 14790 - protein, 81 aa, Sus scrofa
SEDLVTFGDVAVDFSQEEWEWLSPAQRHLYRKVMLENYRSLVSLGVSASKPDVISLLEQGKEPWMMKKEGTRRACPDWEYA

SEQ ID NO: 14791 - protein, 81 aa, Bos mutus
VTFEDVAVYFSWEEWRLLAEAQRSVYLDVMLENYALIASLGCCCGTENAEAPSEQITSLGVSQARTSKAALSSQKIHPCET

SEQ ID NO: 14792 - protein, 81 aa, Neophocaena asiaeorientalis
EEGRVTFEDVAVYFSQEEWGLLDRAQRLLYRSVMLENFSLMASLGLTSSRTHEVTQLEQWGEPFVPACGVVITATPRGCWC

SEQ ID NO: 14793 - protein, 81 aa, Neophocaena asiaeorientalis
ASQGLLTFQDVVIEFSQDKWEFLDSTQWELYRDAMLENYKNLVSLGPVSKPDLVTFMEQKKGPWDVKGMETIAIHPGTGDP

SEQ ID NO: 14794 - protein, 81 aa, Bos mutus
LQESVTFRDIAVLFSRDEWLHLDAAQRTLYREVMLENYSTLVSLGIPFSMPKLICQLQQGEDPCMVEREIPQDTCLGFKIW

SEQ ID NO: 14795 - protein, 81 aa, Neophocaena asiaeorientalis
MDSVVFEDVAVNFTAEEWALLDLAQRKLYRDVMLETFRNLASVGSCSQVKTSRSSAHWDILETGLCSEEKVVRFTRNDSMS

SEQ ID NO: 14796 - protein, 81 aa, Neophocaena asiaeorientalis
LESVTFRDVTVDFTQEEWQQLEPSQKDLYRDVMLENLQNLVSLDLEMRPEMKEPDLKGEISGDKPSGAWGSAVDGARTQGD

SEQ ID NO: 14797 - protein, 81 aa, Neophocaena asiaeorientalis
VMFRDVAIDFSQEEWECLDSAQRDLYRDVMLENYSNLVSLDLPSRGANKDLTPKEDTYETELSQWEMSARLENCDLEESNS

SEQ ID NO: 14798 - protein, 81 aa, Bos mutus
QLPLTFEDVAIYFSEQEWQNLEAWQKELYKQVMRANYEILLSLDNGLPKPELISWIEQGRELFKKWGESQESRNIICSAAD

SEQ ID NO: 14799 - protein, 81 aa, Nomascus leucogenys
YSEQVSFKDVCVDFTQEEWYLLDPAQKILYRDVILENYSNLVSVGYCITKPEVIFKIEQGEEPWILEKGFPSQWHPERKWK

SEQ ID NO: 14800 - protein, 81 aa, Nomascus leucogenys
SCEPVIFEDVTLGFTPEEWGLLDLKQKSLYREVMLENYRNLVSVEHQLSKPDVVSQLEEAEDFWPVERGIPQDTIPEYPEL

SEQ ID NO: 14801 - protein, 81 aa, Nomascus leucogenys
LPREIAPVTFDDITVYLLQEEWVLLSQQQKELCGSDKPVATLGPTVANPELFCKFGRGPEPWLGSVQGQRSLLEHHPGKKQ

SEQ ID NO: 14802 - protein, 81 aa, Nomascus leucogenys
GLLTFRDVAIEFSLVEWQCLDRAQQNLYRDVMLENYRNLVSLGIAVSKPDLITRLEQNKEPQNIKRNEMLAKHPVTCSHFT

SEQ ID NO: 14803 - protein, 81 aa, Nomascus leucogenys
GALTFRDVAIEFSLEEWQCLDTEQQNLYRNVMLDNYRNLVFLGIAVSKPDLITCLEQEKEPWNVKTHDMVAEPPVICSHIA

SEQ ID NO: 14804 - protein, 81 aa, Nomascus leucogenys
GCAFVAFRDVAVDFTQEEWRLLSPAQRTLHREVMLETYNHLVSLEIPSSKPKLIAQLERGEEPWREERKCPLDLCPESKPE

SEQ ID NO: 14805 - protein, 81 aa, Nomascus leucogenys
VTFEDVAVYFSQEEWELLDAAQRHLYHTVMLENLELVTSLGNALSQHVLLCSFVGADLPNCFPNWLHHFTSLSAVYKCSSC

SEQ ID NO: 14806 - protein, 81 aa, Bos indicus
MIENYRNLACLGLVVSKPDLVTFLEQMKDVRNIRRMETIGIYPGIKTYNCGEYGKVSNESSNLIQQQRAQNSQKQYKCNKC

SEQ ID NO: 14807 - protein, 81 aa, Bos indicus
PLESVTFEDVAVDFTQEEWALLDASQRKLFRDVMLENISHLVFVGYQHCKLDVIFQLEQGEELWIEGRGFFQSHSPGRESA

SEQ ID NO: 14808 - protein, 81 aa, Bos indicus
TSEPVSFADVAVYFSPEEWGYLRPAQRALYRDVMRETYGHLGALGFRGTKPALISWVEEEAQLWGPDAGPPEMGECVTEAD

SEQ ID NO: 14809 - protein, 81 aa, Bos indicus
SQGSVSFRDVAVDFTQEEWQQLDPEEKMTYRDVMLENYSHLVSVGYDSTKPNVIIKLEQGEEPWVVDSKFLQQQHSEKVWK

SEQ ID NO: 14810 - protein, 81 aa, Bos indicus
AQELLTLEDVAVEFNWEEWQLLDSAQRDLYWDVMLENYNNLVSLGYQGTKPDMLSKLEHGREPCIIENEMRNRICPGIWKG

SEQ ID NO: 14811 - protein, 81 aa, Bos indicus
VVFEDVAIYFSQEEWGLLDEAQRLLYCQVMVQNAALLSSVGCRHATQDEEALSEQHDVAARSQVKTPKPGPCIQKPHPSKT

SEQ ID NO: 14812 - protein, 81 aa, Bos indicus
LMEAVTFGDVAVHFSREEWQCLDPGQRALYKEVMLENHSSVAGLAGFLVFKPELISRLEQGQDPWVLDLQGAEGREEARTT

SEQ ID NO: 14813 - protein, 81 aa, Bos indicus
AQELVTFEDVAVYFIRKEWKRLEPAQRDLYRDVMLENYGNVFSLDGETRTEPDSEISEDRGAHGVLLGRFQKDISQGLKFE

SEQ ID NO: 14814 - protein, 81 aa, Bos indicus
VEEDFRFKDVVIYFSAKEWECLHSAQKDLYQDVMLENYNNLISLGFANFKPDVISLLEQRKEPWMVKGKETEEWCPDSESR

SEQ ID NO: 14815 - protein, 81 aa, Bos indicus
MDFTSENWEQLGQGQGDLFWDAALDNYWNLFLLNPPGPNLTFHPDGGEKLEALVKESPESTDTGIAETSPLPQDFLEAGLF

SEQ ID NO: 14816 - protein, 81 aa, Canis lupus
PQGSVSFKDVTVDFTQEEWQQLDPAQKALYRDVMLENYCHLISVGFHMTKPDMIRKLEQGEELWTTERIFPSQSYLEEDGK

SEQ ID NO: 14817 - protein, 81 aa, Canis lupus
SQDSVTFEEVVVDFSQEEWALLDHAQKILYRDVMLENFRNLASLGYPLCKHSLITEVEQEALGPEEGGIVQSACTDWNIQL

SEQ ID NO: 14818 - protein, 81 aa, Canis lupus
TFKEAVTFKDVAVVFTEEELGLLDSAQRKLYRDVMLENFGNLVSVGHQPFKRDMIHLVREEKFWMVKLATQRKGNSGDKVQ

SEQ ID NO: 14819 - protein, 81 aa, Canis lupus
VMAHMAFRDVAVNFSQEEWMLLSPAQRSLYREVMLENYSNLVSLGIPFSKPKLITQLEQGKESWREEGKCSPALCPAEPKP

SEQ ID NO: 14820 - protein, 81 aa, Canis lupus
EDSVVFEDVAVDFTVEEWALLDSAQRKLYREVMLENLKNLASVDDETQFKASGSVSQQDVYGNKIPKEHKIAKSTRNDSWA

SEQ ID NO: 14821 - protein, 81 aa, Canis lupus
TWVPLTFSDVAIDFSQEEWECLNSDQRDLYRDVMLENYTNLVSLDIDFTTETNKLSSGKSSYEVNSYHRETMKRSKTFNLM

SEQ ID NO: 14822 - protein, 81 aa, Canis lupus
CEGSVSFEDVTMDFSREEWQQLDPAQRCLYQDVMLEIYSHLLFVGYNIPNPEIISRMEKGEEPWMREIQLPHQRHRERAFG

SEQ ID NO: 14823 - protein, 81 aa, Muntiacus muntjak
SVTFEDVVVYFSWEEWGLLDENQRCLYHDVMLENFALVTSLGCWYGMEEAVAFSVESVPVEQTSRGKTVTPDPSIEKTQPC

SEQ ID NO: 14824 - protein, 81 aa, Canis lupus
PHWLVTFRDVAIDFSQEEWECLNSTQRDLYRDVMLENYSNVISLAGCSIPKPDVFSLLEQGKDPWMVMRAMTRRRSSDLES

SEQ ID NO: 14825 - protein, 81 aa, Canis lupus
SQELLTFQDVSVDFTHEEWGQLSLAHRNLYREVMLENYGNLVSVAGYQLSKPSVISQLEKGQEPWMTEKKGPGDPSPDLKN

SEQ ID NO: 14826 - protein, 81 aa, Muntiacus muntjak
VTFSDVAIDFSHEEWRWLNSTQRNLYKDVMVQNYENLVSLGLSIPKPYVIALLEDGKEPWMVEEKLSKDMFPDCKSRWENK

SEQ ID NO: 14827 - protein, 81 aa, Equus caballus
STTCDLFIDVAIAFSQQEWEGLDPVQKTLYQDVMMENYRNLLSLAGHAISKPGVITLLEQGKEPWMVVREETRRWCLFVCD

SEQ ID NO: 14828 - protein, 81 aa, Neovison vison
DQESVTFKDVAIDLTQEEWTLMDRSQRKLYIDVMLENITHLVSVGCQFFQADVISQWEQGGELWRDDRGFAQGWTPGLENS

SEQ ID NO: 14829 - protein, 81 aa, Loxodonta africana
EHQLSKPDVVSQLEEAEELWLKEREIPQDTFPEVAEAQLDPHVDPLPAGEGDSNPLRKIEVAEVLTLNQEAARSRNAQIRA

SEQ ID NO: 14830 - protein, 81 aa, Suricata suricatta
LKPAQRNLYRDVMLENYSNLVTVGYQVTKPDVIFRLEQEEEPWVVEEEMLGRHCSEVWEVDEQQIKKQQEALLRKVTSISK

SEQ ID NO: 14831 - protein, 81 aa, Chrysochloris asiatica
MLENYSNLVSLGYQAMKADTIFQLEQGKPWLVEEEITSQYLPGEKPYRCDECQKAFSSKSQLINHHRIHTGEKPYGCSECG

SEQ ID NO: 14832 - protein, 81 aa, Chlorocebus sabaeus
KLIQNHKAKGLPSNDTDWPQEKEGKAQIVVPVTFRDVAVIFTEAEWKRLSPEQRNLYKEVMLENYRNLLSLGEAVFFPFLH

SEQ ID NO: 14833 - protein, 81 aa, Suricata suricatta
FQVPVTFDDVAVYFSELEWGKLDEWQKELYKHVMRGNYEMLVSLDYAISKPDILTQMERGEEPCPAGLWGHEEGTDREAAR

SEQ ID NO: 14834 - protein, 81 aa, Suricata suricatta
YKGPVTFKDVTVEFTREEWQLLDAAQRTLYKEVMQENYRHLVSVGYRVNKPNAVFKLKQGKEPWILEVEFPGRNYPEDLWK

SEQ ID NO: 14835 - protein, 81 aa, Mandrillus leucophaeus
VAFEDVAVNFTQEEWALLDIFQKNLYREVMLETFRNLTSIGKSWKDQNIEYEYQNPRRNFRSLIEEKVNEIKEDSHCGETF

SEQ ID NO: 14836 - protein, 81 aa, Suricata suricatta
PQGSVSFQDVTVDFTQEEWQRLDPAQKTLYRDVMLENYCHLISVGFHMTKPDMIRKLEQGEELWTTERMFPSQSCLEEDEK

SEQ ID NO: 14837 - protein, 81 aa, Sus scrofa
SQVTVTFEDVAVLFSRDEWRKLGPSQKNLYQDVMLENYSNLVSLGLPFSKPKVISLLQQGEDPWKVEKESPGSFSPGWKSS

SEQ ID NO: 14838 - protein, 81 aa, Mandrillus leucophaeus
MGPLTFRDVTVEFSLEEWQCLDTAQRNLYRDVMLENYRNLVFLGIAVSKPDLITCLEQGKEPWNMKRHEMVAKPPAFYLMG

SEQ ID NO: 14839 - protein, 81 aa, Mandrillus leucophaeus
MEGLVMFQDLFIDFSQEEWECLDAAQKDLYRDVMMENYSSLVSLGLCIPKPDVISLLEQGKEPWMVSRDVLGGWCPDRLKK

SEQ ID NO: 14840 - protein, 81 aa, Sus scrofa
CQDTVTFEDVAVVFTDEEWRHLIPIQRDLYKEVMLENYKSIVSLDWKTKPEIQGASEEEKSEGTLRGKLERKDPVSPKLKV

SEQ ID NO: 14841 - protein, 81 aa, Sus scrofa
PLTFKDVAIEFSQEEWDCLDPDQRALFWDVMLETYGNLLSVGISPRCAIKELSPKEDVNNGELVQTRGFERPVSHNFDDSD

SEQ ID NO: 14842 - protein, 81 aa, Neophocaena asiaeorientalis
SQESVSFEDVAVYFTQNQWASLDSAQRTLYREVMLENYANVTSLAAFPFPKPDLIFQLERGKAPGGLDPWTPIRRKVRGVC

SEQ ID NO: 14843 - protein, 81 aa, Bos mutus
QGLLSFEDVALYFTREEWDMLDWAQKALYRDVMLDNYRHVVSLGFQFPKPEVICQLEQWEEPWILDLPRAGTRKASGSACP

SEQ ID NO: 14844 - protein, 81 aa, Neophocaena asiaeorientalis
SVTFEDVAVYFSQEEWRLLDEAQRFLYHDVMLETFALVASLGCSHGAEVKETPSEQNVFVEMPRINTSKTNLSTQEAYPWE

SEQ ID NO: 14845 - protein, 81 aa, Neophocaena asiaeorientalis
DGGKVSFKDVTVDFSREEWQHLDPAQRLLYRDVMLENYSHLRSVGYQVPKPEVIFKLEQGEGPWTLEEETPHQSCSDEDNG

SEQ ID NO: 14846 - protein, 81 aa, Neophocaena asiaeorientalis
PLGPVSFKDVAVDFTQDEWQQLDPEQKTTYRDVMLENYSHLVSVGCHIIKPEVITKLEKGEEPWIVGGEFLLQSYPEEDWE

SEQ ID NO: 14847 - protein, 81 aa, Neophocaena asiaeorientalis
AHGSVMFSDVSIDFSQEEWDYLDLEQRDLYRDVMLENYSNLVSLGCFVSKPDVISLLEQGKEPWKVVRKGRRRYPDLETNY

SEQ ID NO: 14848 - protein, 81 aa, Neophocaena asiaeorientalis
MLENISHLVSVGNQLYKSDVISHLEQGEQLSREELGFLQGQSPVISGREDDLRKQEMISMQHIYKKDTSVISAMQRSHSQE

SEQ ID NO: 14849 - protein, 81 aa, Nomascus leucogenys
VTLRDVVINFSQEEWEYLDSAQRNLYWDVMMENYSNLLSLDLESRNETKHLSIGKDIIKNTGSQCEVMENSKLHGLESSIL

SEQ ID NO: 14850 - protein, 81 aa, Nomascus leucogenys
LTQGQLSFRDVAIEFSQEEWKCLDPGQKALYKDVMLENYRNLVSLICLPDLSVISMLEQKKDPWTLQSEVKIAKNPNGREC

SEQ ID NO: 14851 - protein, 81 aa, Nomascus leucogenys
AAQMVTFKDVAVTFTREEWRQLDLAQRTLYREVMLETCGLLVSLGHQVPKPELVHLLEHGQELWTVKRGLSHPTCAGDRAQ

SEQ ID NO: 14852 - protein, 81 aa, Nomascus leucogenys
ETNLLGPLTFRDVTIEFSLEEWQCLDTAQQNLYRDVMLENYRNLVFLGIAVFKPDLITCLKQGKEPWNMKRHEMVTKPPGM

SEQ ID NO: 14853 - protein, 80 aa, Nomascus leucogenys
MELLTFRDVAIEFSPEEWKCLDPAQQNLYRDVMLENYRNLVSLELHTEHHQRTDGHFISLGEGQVYHGVMAIAASIGVWV

SEQ ID NO: 14854 - protein, 81 aa, Nomascus leucogenys
MHSLKKATFEDVAIDFWSFLLMDTSKRKLYRDVMLENISHLVSLGHQISKSCIILKQLWREGREFLQGQSPDRETALKKKH

SEQ ID NO: 14855 - protein, 81 aa, Nomascus leucogenys
MLENYRNLVFLDIAAFKPDLIIFLEQGKEPWNMKRHEMVEEPPVICPYFAQDLWPEQGIEDSFQKMILRRYENCGYGNLHL

SEQ ID NO: 14856 - protein, 81 aa, Nomascus leucogenys
DSVTFEDVAVDFTQEEWTLLDQTQRNLYRDVMLENYKNLVAVDWESRINTKWSAPQENFLQGKTSSVVEMVRFRRYNLLPS

SEQ ID NO: 14857 - protein, 81 aa, Bos indicus
ESVTFKDVAVLFTQDEWAQLSPAQRALYRDVMLENYSNLVSLDWVITPMNKKSILKAAIPEGELGQWMIKERFTRDSCWKY

SEQ ID NO: 14858 - protein, 81 aa, Bos indicus
PQESVTFEDVAVNFSHEEWQCLTHAQRHLYKDVMLENYGNMVSLGFSFSKPPLISRLEQGTEPYVQDRQDWEFLSCSYPVS

SEQ ID NO: 14859 - protein, 81 aa, Bos indicus
QACVTFEDVAIYFSQDEWRLLNETQRFLYCDVMLENFALTTSLGCWHGVDKEEAASEQSVSVAVSHIHTSKADSLTQMAHP

SEQ ID NO: 14860 - protein, 81 aa, Bos indicus
EAPKVPFDDVAVYFSEQEWGKLDEWQKELYKHVMRGNYETLVSLDYAISKPEVLSQIEQGKEPCSWRRAGPKVPDVPVDPS

SEQ ID NO: 14861 - protein, 81 aa, Bos indicus
CQDPVTFEDVAVVFTDEEWRRLVPTQRDLYKEVMLENYKSIVSLAGLPVPGPDVIFQLKRGDEPWLVEFHGFEGKEGAENV

SEQ ID NO: 14862 - protein, 81 aa, Bos indicus
MALSQKRLTSKDVAIEFTQEEWEFLDPAQRALYRDVMLETYRNLLSVGLGQAGGLDPLWLLLRKIYLSYTCDQAFTTQSEQ

SEQ ID NO: 14863 - protein, 81 aa, Canis lupus
YQRPVSFKDVVVGFTQEEWYRLNPAQRALYRDVMLETYSNLVSVGYEGTKPYVILKLEQEEAPWICEAACSGCHCQENICQ

SEQ ID NO: 14864 - protein, 81 aa, Canis lupus
SQESVTFRDVAIDFSQEEWEWLQPAQRDLYRHVMLENYSHLVSLGLNISKPYVVSLLEQGKGPWLEKGDVRRDLFSESHGE

SEQ ID NO: 14865 - protein, 81 aa, Canis lupus
YQGPVTFKDVIVEFTREEWQLLNAAQRTLYREVMQENYGHLISVGYHVNKPNAVFKLKQGKQPWILEVEFPHWNSPEDLWK

SEQ ID NO: 14866 - protein, 81 aa, Canis lupus
AQESVTFRDVAVLFSHDEWLHLDSAQRTLYREVMLENYGTLVSLGIPFSTPKVIYQLQQGEDPCTVDREVPQDACVGFKTQ

SEQ ID NO: 14867 - protein, 81 aa, Canis lupus
TARSQAPVTFKDVAMDFTPEEWGKLDPAQREVMLENYRNLVSLWLPVSKPDNYNLENGKEPLMLERKTPKSSYSDLESKPE

SEQ ID NO: 14868 - protein, 81 aa, Canis lupus
AQESVMFSDVSIDFSQEEWECLNDDQRDLYRDVMLENYSHLVSMAGHSVSKPDVISFLEQGKEPWLVDRELTRDQWPVLES

SEQ ID NO: 14869 - protein, 81 aa, Canis lupus
FQESVTFEDVAVIFTDEEWRHLVPIQRDLYKEVMLENYKSIVSLDWETKPEIHGTSDKEKSEGTVRGKLEGEVPVCPKFEV

SEQ ID NO: 14870 - protein, 81 aa, Canis lupus
QVLVSFEDVAVLLSREEWGRLGPAQRGLYSDVMLETYRNLISLGFQSLMEKKGLTPKQEISKAMGFRRAKSEYVRNVSKES

SEQ ID NO: 14871 - protein, 81 aa, Canis lupus
MFQVTFSDVAIDFSHEEWGWLDSAQRDLYKDVMVQNYENLVSVGLSIPKPYLISLLEDGKEPWMVEKKTSKDWESRWENKE

SEQ ID NO: 14872 - protein, 81 aa, Sus scrofa
SQEQVSFKDVCVDFTQEEWYLLDPAQKILYRDVILENYSHLVSVGNCITKPEVIFKIEQGEEPWILAEKFPKQCRSEDWKV

SEQ ID NO: 14873 - protein, 81 aa, Neophocaena asiaeorientalis
QAQETLTFDDVTVDFTWEEWQLLTPPQKDLYQEVMLENYSNLLSVGYRVRKPDVLSNWDHGEPWMMEDEIHCRIHSGYQAS

SEQ ID NO: 14874 - protein, 81 aa, Neophocaena asiaeorientalis
PQGSVSFKDVTVDFTQEEWQQLDPAQKALYRDVMLENYFHLISVGFHMTKPDMIHKLEQGKELWTTEKIFPSQSYLEEDWK

SEQ ID NO: 14875 - protein, 81 aa, Bos mutus
PDTVVFEDVAVDFTQEEWALLNLAQRNLYRDVMLENFRNLASLVVVRILKEDYQVYVVWAQASGVTLGDREKIGGLGPFEN

SEQ ID NO: 14876 - protein, 81 aa, Neophocaena asiaeorientalis
WSQMPVTFEDVAVYLSREEWGRLDHTQQSFYRDILQKRNGLSLGFPFSRPFWASQVQGKGEASGSCQQMGDEEEEKRGAVE

SEQ ID NO: 14877 - protein, 81 aa, Neophocaena asiaeorientalis
AQGSVTFEDVAVYFSCEEWCLLDEVQIHLYLDVMLENFALVCMLGSWRGVDEETPSEENICVEGVSQIRTPRAGSSPEKAQ

SEQ ID NO: 14878 - protein, 81 aa, Neophocaena asiaeorientalis
FRGPVTFKDVTVEFTQEEWQLLDAAQRTLYREVMQENYRHLISVGYCVNKPNAVFKLKQGKEPWILEVEFPRQKYPEDLWN

SEQ ID NO: 14879 - protein, 81 aa, Neophocaena asiaeorientalis
GPVKFEDVVVIFTEAEWKRLSLEQRNLYKEVMLENFRNLVLLADSKPEVHPWPFAFCPLAFDGQQFLSHHELCSHLIPYSC

SEQ ID NO: 14880 - protein, 81 aa, Neophocaena asiaeorientalis
GMKFEDVAIDFSQEEWGLLDEAQRLLYYNVMLENFALVASLGCCHGTEDEEAPSEQSISVEGESQVRASKAGPSTQKTHPC

SEQ ID NO: 14881 - protein, 81 aa, Neophocaena asiaeorientalis
SLGLVSFEDVAVNFTWEEAQDLDDAQRTLYRDVMLENYSSLVSLGHCITRPEVIIKLEQGAAPWTVKEKPQTRVSRANVQI

SEQ ID NO: 14882 - protein, 81 aa, Nomascus leucogenys
GTVTFEDVAVNFTQEEWNLLSEAQRCLYRDVMLENLALISSLSCWCGVEDEAAPSKRSIYIQRETQVRTPMAGVSPKKAPH

SEQ ID NO: 14883 - protein, 81 aa, Nomascus leucogenys
QGLLTFRDVAIEFSQEEWKCLDPAQRTLYRDVMLENYRNLVSLDTSSKCMMTTLSSTGQGNTEVFHTGTLQRQASYRIGAF

SEQ ID NO: 14884 - protein, 81 aa, Nomascus leucogenys
VTFKDVAVTFTREEWRQLDLAQRTLYREVMLETCGLLVSLGDRAQVHTREPTTYPPVLSEQAFLQGSLTLESSTSSDSRLG

SEQ ID NO: 14885 - protein, 81 aa, Nomascus leucogenys
DPEQVTFEDVVVEFSQEEWGQLKPAQRTLYRDVMLDTFRLLVSVAHWLLKLNVISLLEQEAELQAVDSGLPQGVYPEIKGH

SEQ ID NO: 14886 - protein, 81 aa, Nomascus leucogenys
QGLLTFRDVAIEFSQEEWKCLDPAQRTLYRDVMLENYRNLVSLDISSKCMVKEFLSAAQGKREEFHTGTLERHESHHIGHF

SEQ ID NO: 14887 - protein, 81 aa, Nomascus leucogenys
PQASVCFEDVAMAFTQEEWEQLDLAQRTLYREVTLETWEHIVSLGLFLSKSDVISQLEQEEGLCRAEQVAPRDWKATLEEN

SEQ ID NO: 14888 - protein, 81 aa, Nomascus leucogenys
TFKEAVTFKDVAVVFTEEELGLMDPAQRKLYRDVMLENFRNLLSVGNQPFHQDTFHFLRKEMFWMIKTTSQREGNSGGKIQ

SEQ ID NO: 14889 - protein, 81 aa, Nomascus leucogenys
TFKEAMTFKDVAVVFTEEELGLLDLAQRKLYQDVMLENFRNLLSVGHQAFHRDTFHFLREEKIWMMKTATQREGNSGDKIQ

SEQ ID NO: 14890 - protein, 81 aa, Nomascus leucogenys
EEALMAFWDVAVAFTQKEWKLLSSAQRTLYREVMLENYSHLVSVGIAFSKPKLIKQLEQGDEPWREENEHLDLCPAQTPSS

SEQ ID NO: 14891 - protein, 81 aa, Nomascus leucogenys
EMGPLTFRDVAIEFSLEEWQCLDTAQQDLYRKVMLENYRNLVFLAGIAVSKPDLVTCLEQGKDPWNMKRHSMVVKPPGFLL

SEQ ID NO: 14892 - protein, 81 aa, Nomascus leucogenys
PQGLLTFRDVAIDFSQEEWKCLDPAQRTLYRDVMLENYRNLVSLEFRSVTQAKVQWCHLSSLQPPLPRFKQFSCLSLPSSW

SEQ ID NO: 14893 - protein, 81 aa, Bos indicus
AQESVMFSDVSIDFSQEEWEFLNDDQRDLYRDVMLENYSNLVSMGHSISKPDVISFLEQGKEPWLVDRELTRDQWPVLESR

SEQ ID NO: 14894 - protein, 81 aa, Bos indicus
FQESVTFRDVSIDFSREEWEWLQPAQRDLYRHVMLENYGHLVSLGLNMSKPDVVSLLEQGKEPWLGNGDVSRELFPASKSN

SEQ ID NO: 14895 - protein, 81 aa, Bos indicus
ALVSVTFRDVAVFFSRDEWLCLDSAQRTLYQEVMLENYSTLFSLGILFSKPKVILRLEQGEDPWMVENGVSQSTYLGWESL

SEQ ID NO: 14896 - protein, 81 aa, Bos indicus
VTFPDIAVRFSQREWRLLDETQRLLYLDVMLENYTLISSLGCCCGAEGGETPCEKTVPIGVSWTGSPTATPFSQKTHPCEK

SEQ ID NO: 14897 - protein, 81 aa, Bos indicus
QGESVTFKDVAVDFTQEEWGQLDSPQRALYRDVMLENYQNLLSLGPPVCKPDVISHLERGEEPWQAPRDGPAGPDPEPGWE

SEQ ID NO: 14898 - protein, 81 aa, Bos indicus
MRPVQKELYKTVTLQNYWNMVSLGLTVYRPTVIPMLEEPWMVLKEILEGPSPEWETKAQECTLVENVSKLKKDGIKLIKLE

SEQ ID NO: 14899 - protein, 81 aa, Bos indicus
RKEGPCARDVAVGFTRKEWQELDPTQKTLYRDVMLENYSHLVSVGCQVTKPAVISRLEQGQEPWMEEEEILRWSFPEVSQV

SEQ ID NO: 14900 - protein, 81 aa, Bos indicus
MWLWTSHRAAWQQMKPAQRNLYRDVMLENYSNLVTVEVWKVDEQIKKQQETLVRNVTSISKKTLIKENAVEYKNVAKVFPL

SEQ ID NO: 14901 - protein, 81 aa, Bos indicus
ALKVKMALSCHADYRWICVTPLKVNETDFEWEKIKNHIGLLTFADVYIEFSQEEWECLDPAQRTLYRDVMLETYRNLLSVI

SEQ ID NO: 14902 - protein, 81 aa, Muntiacus muntjak
MAFEDVAVHFSQEEWGLLDTAQRSLYRRVMLENFALLASLGLSVSRPHVVTQLERGEEPWVLSGVDVTLPQDAQRRPRRGS

SEQ ID NO: 14903 - protein, 81 aa, Canis lupus
PQESVTFKDVAVDFTQEEWHHVDAAQRLLYRDVMLENYSHLVSLGYQVSKPEVIFKLEQGEEPWISEGEIQRPCCPVFRTW

SEQ ID NO: 14904 - protein, 81 aa, Muntiacus muntjak
PQGSTPFSSLTVDFTQGGWRQLAPAPRDRFEEGMPEKSRNLVLLGLPVSQPGMNFQLEQREGSWMLKRDGLRNACPDWKII

SEQ ID NO: 14905 - protein, 81 aa, Canis lupus
SCGSLSFEDVTVGFTQEEWQHLDHAQRTLYRDEMLENYSHLISVGCCIPKPEVILKLEEVDQPWILEEESPSQSYPGRLIT

SEQ ID NO: 14906 - protein, 81 aa, Muntiacus muntjak
ILGSLSFRDVAVGFTRKEWQQLDPTQRTLYRDVMLENYNHLVSVGCQVTKPAVISRLEQGQEPWMEEEEILTWSFPEFIAY

SEQ ID NO: 14907 - protein, 81 aa, Muntiacus muntjak
SEDPVTFQEVLVDFSQEEWAQLAPAQKILYQDMMLENCRNLTSVGYHLCKPRLLTQGELRTRKRRLLQDTCADQNSQLKTK

SEQ ID NO: 14908 - protein, 81 aa, Muntiacus muntjak
LTEAAELEFLSVNYTLKKWKGTALSQRALYWNIMLENCCSLAPLGENRMASSQLSQKQDISEELKSADRTSGILCGLILGG

SEQ ID NO: 14909 - protein, 81 aa, Muntiacus muntjak
AQELVTFEDVAVYFIRKEWKRLEPAQRDLYRDVMLENYGNVFSLDGETRTEPDSEISEDTGSHGVLLGRFQKDISQGLKFE

SEQ ID NO: 14910 - protein, 81 aa, Canis lupus
SEESVTFEDVAIYFSENEWTGLAPAQRVLYRDVMLENYGAVAALAAFPFPKPALISQLERGEAPWCKAPQGALDGEGPRGI

SEQ ID NO: 14911 - protein, 81 aa, Muntiacus muntjak
SQRSLTFRDVAIDFSQEEWGFLDPAQRELYAAVMSEIYQNLVWLGISVAEPNIAFLLERGSQPWVMRAEDAEAPGAGESGT

SEQ ID NO: 14912 - protein, 81 aa, Muntiacus muntjak
KSWGPLSFMDVFVDFTWEEWQLLVPAQKRLCRSVMLENYSNLVSLGYQHTKPSIIFQLEQEELWMMQILSQGHPGKLRQKT

SEQ ID NO: 14913 - protein, 81 aa, Canis lupus
SQSLVTFGDVAVNFSQEEWEWLNSAQRNLYRSVMLENYRNLVSLGLCVSKPDMISSLEQRKEPWMVKRKLTRGRCPDLKAV

SEQ ID NO: 14914 - protein, 81 aa, Equus caballus
AILSSSFRGPETHRLSQVIQFSSTGYCTPKPEVILKLEQGEEPWILEEEFPSQSDPELTNSSRNYSRKKFSVFNKGRKWPH

SEQ ID NO: 14915 - protein, 81 aa, Mandrillus leucophaeus
NSGLLTFRDVAIEFSLEEWQCLDTAQKNLYRNVMLENYRNLAFLGVAVSKPDLITCLEKDKEPWNMKRHEMVDEPPGICPH

SEQ ID NO: 14916 - protein, 81 aa, Mandrillus leucophaeus
MNKAGYSMDVIVEFTKEEWKLLTPAQRTLYKDVMLENYSHLVSVGYHVNKPTAVFKLKQGKEPWILEVEFPHRVLPYLWSI

SEQ ID NO: 14917 - protein, 81 aa, Sus scrofa
AQESLTFEDVAVNFSFGEWQCLTHIQKRLYKDVMLENYRNMVSLGFPFPKPSLISHLEQETEPCVQDPQDREFLSCSHPAD

SEQ ID NO: 14918 - protein, 81 aa, Neophocaena asiaeorientalis
TKASNVALLPGVVCADDECGMCLKFAETVTFKDVAVVFTEEELALLDSTQINLYQDVMLENFRNLVSVGEDSDLPDPGRSL

SEQ ID NO: 14919 - protein, 81 aa, Neophocaena asiaeorientalis
PKVSRSLENDGVCFSEQEWENLEGWQKELYTNAMKSSYETLVSLMEGVMIKQEIQYTQDGSTDLPGEFSGIAEEHAFLSPE

SEQ ID NO: 14920 - protein, 81 aa, Neophocaena asiaeorientalis
QLTFKDVAIEFSQEEWECLDPAQRALYRDVMLETYGNLLSLDTSLKCVIEESAPKENSHTGEVLQTVLLERHESCETEDYG

SEQ ID NO: 14921 - protein, 81 aa, Bos mutus
LTFEEVAMYFSQEEWELLDPTQKALYNDVMQENYENVIFLALFVLPKPKVISCLEQGEEPWVQRPLEFKDSSEELPTGLKL

SEQ ID NO: 14922 - protein, 81 aa, Bos mutus
SQESVTFQDVAVDFTEKEWPLLDSTQRKLYKDVMLENYSNLASVGCQVGKPSLISHLEQEEELRTEDRELHRGPCPDWATP

SEQ ID NO: 14923 - protein, 81 aa, Bos mutus
QETLTFDDVAVDFTWEEWQLLAPAQKALYRDVMLENYSNLVSAEVLSKLDQGEPWMMDDETHCQTRSEVWKFDDHLLEYLQ

SEQ ID NO: 14924 - protein, 81 aa, Nomascus leucogenys
AHALVTFRDVAIDFSQKEWECLDTTQRKLYRDVMLENYNNLVSLGLLSRHKTKKLSSEKDIHEISLSKGSIIEKSKTLRLK

SEQ ID NO: 14925 - protein, 81 aa, Nomascus leucogenys
CLQLRDVAIEFSQEEWKCLDPVQKALYRDVMLENYRNLVSLGICLPDLSVISMMKQRTEPWTVENEMKVAKNPDRWEGIKD

SEQ ID NO: 14926 - protein, 81 aa, Nomascus leucogenys
MAEEFVTLRDVGLDLPLEDWEQLGLEQGDMFWDTALDNCQDLFLLDPPRPNLTSHADGGEDLEPLAGGSPEATGPDVTETK

SEQ ID NO: 14927 - protein, 81 aa, Nomascus leucogenys
ELELLTFRDVAIEFSPEEWKCLDSAQQSLYRDVMLENYRNLVSLGVAISNPDLVIYLEQRKEPYKVKIHETVAKHPAMCSH

SEQ ID NO: 14928 - protein, 81 aa, Nomascus leucogenys
SQESLTFKDVFVDFTLEEWQQLDSAQKNLYRDVMLENYSHLVSVGYLVVKPDVIFRLGPGEESWMADGGTPVRTCAGEDRP

SEQ ID NO: 14929 - protein, 81 aa, Nomascus leucogenys
EMEPLQFRDVAVEFSLEEWHCLDTAQQNLYRDVMLENYRHLVFLGIVVSKPDLITCLEQGKKPLTMKRHEMIANPPVMCYH

SEQ ID NO: 14930 - protein, 81 aa, Nomascus leucogenys
LVTFRDVAIDFSQEEWECLDPAQRDLYRDVMLENYSNLISLDLESSRTTKKLSPEKEIDEMESLQWENMEKLINHQYNGLG

SEQ ID NO: 14931 - protein, 81 aa, Nomascus leucogenys
SLDMVSFEEVAVHFTWEEWQNLDDAQRTLYRDVMLETYSSLVSLGHHITKPEMIFKLEQGAEPWIVEETPNLRLSGGSRKV

SEQ ID NO: 14932 - protein, 81 aa, Nomascus leucogenys
IGGDVTFSDVAIDFSHEEWACLDSAQRDLYKDVMVQNYENLVSVAGLSITKPYVITLLEVGKEPWRVEKKLSKGMIPDNKE

SEQ ID NO: 14933 - protein, 81 aa, Bos indicus
AAGSVTFNDVTMAFTRKEWEQLDPAQKSLYKDVMLENYSNLASMGYQALKPDMISKLEKGEEPWLGKGKGARQGGSSEIAR

SEQ ID NO: 14934 - protein, 81 aa, Bos indicus
TATSSHWRSFKDVPVDLSREEWPHVDPVQRCLYQDVTLETYSQLCAVGNQVPKPEVIFKLEQEEGPWTLEEETPHQSCSDV

SEQ ID NO: 14935 - protein, 81 aa, Canis lupus
FQEAVTFKDVAVVFSEEELGLLGPAQRKLYRDVMLENFRNLVSVGHSSSKPDVISQLEREEKLCTKEFHTQGGGRNQKEME

SEQ ID NO: 14936 - protein, 81 aa, Canis lupus
PQASVSFKDVTVEFTHEEWRQMDSAQRTLYRDVMLENYSHLVSVGYCFTKPELIFTLEQGEDPWLLKKEFLRESSPEDSQP

SEQ ID NO: 14937 - protein, 81 aa, Muntiacus muntjak
SVTFPDVAVYFSWEEWRLLDEAQRCLYLDVMLENYALISSLGCCCGTENAEAPSERITSLGVSQARTTKAALSTQKTHPCE

SEQ ID NO: 14938 - protein, 81 aa, Canis lupus
SLETVTFKDVAVDLTQEEWQHMKPAQRNLYRDVMLENYSNLVTVGYQVTKPDVIFKLEQEEEPWVIEEEMLGRHCPEVWEV

SEQ ID NO: 14939 - protein, 81 aa, Neophocaena asiaeorientalis
HVIFEDVAVSFSQEEWGLLNDAQRLLYCDVMLENLSLIASLGCWHGVEAEKAVSEQCVSVEQVTEDWNPKLEPSILKPLTS

SEQ ID NO: 14940 - protein, 81 aa, Bos mutus
QDSVVFEDVAVNFTLEEWALLDPGQRKLYRDVMLETCRNLASVENWMFLDIGGHQTLERDWRNHLVEKLCIDNEGHHCLEA

SEQ ID NO: 14941 - protein, 81 aa, Neophocaena asiaeorientalis
TAQGSVLFEDVSVDFTQKEWQLLDRAQRLLYRDVMLENYGHLVSLGHCVSKPELILKLEQEEPWILKGQLPSESHPEVQRT

SEQ ID NO: 14942 - protein, 81 aa, Bos mutus
SLTLEDVAVDFTWEEWQLLAPPQKALYRDVMLENYSNLVSVGSFFSSFLEMRKDDCLLQENLQNQSCPKRMEQCHEHNALG

SEQ ID NO: 14943 - protein, 81 aa, Bos mutus
MYLGLQVSKPDVISQLEQGTEPWIVEPSIPVGTPGDWVTRPENSITASELDISGEEPSPGAVAEKHKRDDPWSTNFLETCE

SEQ ID NO: 14944 - protein, 81 aa, Bos mutus
VSFRDVAVDFSREEWQQLDLDQKNLYRDVMLETCSHLLSIELSRSLRNVAFIKKVLTIQRDYAYKGIRKIIRVSQNIPSPK

SEQ ID NO: 14945 - protein, 81 aa, Neophocaena asiaeorientalis
GVMESVTLEDVAVGLIQEWTLLDDARRNLCRYVLLDNCRTLAPRGTPSCKACLVSQVGPREELMTAEQGILCATGVDWESQ

SEQ ID NO: 14946 - protein, 81 aa, Bos mutus
QGPVTFEDVAVYFSLEEWGLLNLTQKSLYRDVMLENFGLIGSLGCLRRLQDEDALLELGESCRVRLSEKPSLCGTSGQVFP

SEQ ID NO: 14947 - protein, 81 aa, Neophocaena asiaeorientalis
KAQETLTFDDVAVDFTWEEWQFLAPPQKDLYRDVMLENYSNLLSVGFQASKPDILSKLDQGEPWTMEDEIRCRTHSEVWKV

SEQ ID NO: 14948 - protein, 81 aa, Bos mutus
DFTQEEWQQLAPAQKTLHRDVMLEIYSHLVSVGCSYLKLDIISKLEHGKDPWTIESELSRWTYSGGEKSSDSCQQIISGEL

SEQ ID NO: 14949 - protein, 81 aa, Neophocaena asiaeorientalis
DEALMAFKDVAVAFTQKEWKLLSPAQRTLYRDVMLENYSHMVSLGIAFPKPKLIIQLEQGDEPWREENSSLLDLCPEPRTE

SEQ ID NO: 14950 - protein, 81 aa, Nomascus leucogenys
VAFEDVAVNFTQEEWTLLDISQKNLFREVMLETFRNLTSIGKKWKDQNIDYEYQNPRRSFRSLIEEKVNEIKDDSHCGETF

SEQ ID NO: 14951 - protein, 81 aa, Nomascus leucogenys
LQGPVSFRDVAVDFTQEEWQQLDPDEKITYRDVMLENYSHLVSVGYDITKPNVIIKLEQGEEPWIVEGEFPCQHSPEVWKV

SEQ ID NO: 14952 - protein, 81 aa, Nomascus leucogenys
MFKEAVTFKDVAVAFTEEELGLLGPAQRKLYRDVMVENFRNLLSVGHQPFKQDVSPIERNEQLWIMTTATRRQGNLDTLLV

SEQ ID NO: 14953 - protein, 81 aa, Bos indicus
KSWGPLSFMDVFVDFTWEEWQLLDSAQKHLYRSVMLENFRNLVSLGYQYTKPSIIFQLEQEELWMMHSPSQGHSGAQEFVY

SEQ ID NO: 14954 - protein, 81 aa, Bos indicus
QETLTFKDMAMVFSKEELALLDSAQINLYQDVMLENFRNLVSVGEDNKHLVTKHQTTGLIFSSEQLRFSRQEAWSGMPLPS

SEQ ID NO: 14955 - protein, 81 aa, Bos indicus
IQDTVVFEDVAVDFTQEEWALLNLAQRNLYRDVMLENFRNLASLGYPLHKPYLILQWKQEEDLETVERRLFPRGASSFAQG

SEQ ID NO: 14956 - protein, 81 aa, Bos indicus
SRSLENDGVCFSEQEWENLEDWQKELYANVMKSNYETLVSLKVLGQPEGEVELGAEMPGDLEEEESRGVHPVEEVVVKQET

SEQ ID NO: 14957 - protein, 81 aa, Bos indicus
LQELVTFKDVAVDFTEEEWQHLDPSQRHLYREVMLENFGNLISLAGHLLSEPEMIFHFEQEDDVWMEETIPRSSYSGDEPY

SEQ ID NO: 14958 - protein, 81 aa, Canis lupus
FQGSVSFKDVTVGFTLEEWQHLDSTQRSLYRDVMLENYSNLVSLGYCVTKPEVIFRLEQGEEPWMLEEEFPSQSFPGYSID

SEQ ID NO: 14959 - protein, 81 aa, Crocuta crocuta
GWVPALFDEVAIYFSDDEWDVLTEQQKALYREVMRMNYETVLSLEFPFPKPDMITRLEGDEESQNSDEWQLQGGSFAENEE

SEQ ID NO: 14960 - protein, 81 aa, Canis lupus
LMEAVTFGDVAVHFSREEWQCLDPGQRALYKEVMLENHSSVAGLAGFLVFKPELISRLEQGQEPWVLDLKGVEGREGARTF

SEQ ID NO: 14961 - protein, 81 aa, Canis lupus
MFQVTFSDVAIDFSHEEWGWLDSAQRDLYKDVMVQNYENLVSVAGLSIPKPYLISLLEDGKEPWMVEKKTSKDWESRWENK

SEQ ID NO: 14962 - protein, 81 aa, Canis lupus
MAVTFEDVTVIFTWEEWKFLDSSQKKLYREVMWENYTNVMSVGNWKESYKFQEEKFRYLEHENLPWWQGWRNASTQIYENR

SEQ ID NO: 14963 - protein, 81 aa, Muntiacus muntjak
SRSLENDGVCFSEQEWENLEDWQKELYANVMKSNYETLVSLKVLGQPEGDMELGAEMPGDLEEEESRGGHPVEEVMVKQET

SEQ ID NO: 14964 - protein, 81 aa, Canis lupus
PQEPVTFEDVAVYFTQSQWASLDHAQRDLYREVMLENYANVASLGAFPFPKPVLVSQLERGEAPWGPDPWEAEVVRCISPG

SEQ ID NO: 14965 - protein, 81 aa, Muntiacus muntjak
EVQETLTFDDVAVAFTWEEWQLLAPAQKALYRDVMLENHSNLVSVGFQASTPEVLSKLDQGEPWTMDDEVHCRTRSEVWKF

SEQ ID NO: 14966 - protein, 81 aa, Canis lupus
VTTNPMTFTDVAVEFTQEEWMMLDSSQRRIYRDVVLENYINLTSVEHQLWKTIVISLLGQKEVRTMKRRVLQGEVGSMEGT

SEQ ID NO: 14967 - protein, 81 aa, Canis lupus
FQEVVTFKDVAVVFTIEELGLLDSTQRKLYRDVMVENFKNLVSVGHLPFKPDMVSQLEAEEKRWMMERETQRNGYSSEDHV

SEQ ID NO: 14968 - protein, 81 aa, Muntiacus muntjak
LLETVTFKDVAVDLTQEEWQQMKPAQRNLYRDVMLENYSNLVTVGCQVTKPDVIFKLEQEEEPWVVEEELLGRHCSEVWKV

SEQ ID NO: 14969 - protein, 81 aa, Muntiacus muntjak
RDGSVTFEDVAVYFSWEEWALLDDAQRCLYHDVMLENFALTSSLALLGTCRSSGGAMKKSSELHRMDMTPFSTRWTQSCWH

SEQ ID NO: 14970 - protein, 81 aa, Muntiacus muntjak
MHESVTFEDVAVDFTQEEWALLDTSQRKLFRDVMLENISHLVFVGYQHCKLDVIFQLEQGEELWIEGRGFFQSHSPGRKSA

SEQ ID NO: 14971 - protein, 81 aa, Muntiacus muntjak
LLESVTFGDVAVVFSRDEWLHLDAAQRSLYREVMLENYSALVSLGIPLSIPKLICQLQQGEDPCMVEREIPQDVCLGFKTW

SEQ ID NO: 14972 - protein, 81 aa, Muntiacus muntjak
SHSGSVSFSDVAVDFSREEWQQLDLDQKNLYRDVMLETYSHLLSIGYQVPETEVFMLEQGKEPWALQGEGPYQSCPEELWQ

SEQ ID NO: 14973 - protein, 81 aa, Gorilla gorilla
QEGVNFKIVTVDFTQEEQGTWNPAQRTLDRDVILENHRDLVSWDLATAVEKKDSASKQRIFDEEPANGVKIERFTRDDPWL

SEQ ID NO: 14974 - protein, 81 aa, Gorilla gorilla
SITFKDLAVRFSEEEWRLLEEGQREFYRDVMRENYETLVSVGTAELLPLSAFLSPSEPGRAVGGGSHADEGQEPAGCEDPQ

SEQ ID NO: 14975 - protein, 81 aa, Sus scrofa
MKISDLVSEFGLCISKPYVISLLEQGKEPWVMKSERTSSPFPDWESIYETQELPLKQFVCDDVLMERITTCGLKCSTFGEN

SEQ ID NO: 14976 - protein, 81 aa, Sus scrofa
LSQVSVTFQDVAVDFTGEEWQLLGCAQRKLYWDVMLENFRNILSVSGPKTKVIFRMKQGHDPWMVDGENPHWHCPVESEKP

SEQ ID NO: 14977 - protein, 81 aa, Sus scrofa
SEGSLSFGDVTVDFTQEEWKHLDPSLRMLYRDVMLENYHNLVSVGYFTTKPEVIFKLEQGGEPWILEEEFLYQTCPGELVI

SEQ ID NO: 14978 - protein, 81 aa, Sus scrofa
FQGSLSFKDVAVGFTRKEWQQLDSAQRTLYREVMLENYSHLVSVGCQVTKPAVISRLEQGQEPWMKEEEILRWSAPGERTS

SEQ ID NO: 14979 - protein, 81 aa, Bos mutus
VTFEDVAVLFTRDEWRKLAPPQRNLYQDVMLENYNNLVSLGHLFPKPKVISLLQQGEDPWKVEKESPGGSSLEEQEIKLST

SEQ ID NO: 14980 - protein, 81 aa, Neophocaena asiaeorientalis
SYESLSFEDVTLDFTQEEWQQLDPAQRTLYRDVMLENYSHLVSVGYCIPKPELIFRLEQGEQPWVLEEESPSKSSPEVCKV

SEQ ID NO: 14981 - protein, 81 aa, Bos mutus
MAFRDVAVDFTQDEWVLLSPAQRSLYREVMLENYSNLVSLGIPFSKPELITQLEQGKETWREERKCSPVSCLGADCRAGTE

SEQ ID NO: 14982 - protein, 81 aa, Neophocaena asiaeorientalis
LQEPVTFADVAVLFTPEEWLFLDSAQRSLYRDVMLENYRNLASVGDQLCKASTFSHLEQREELCVTERGIFPGTHLEPQLQ

SEQ ID NO: 14983 - protein, 81 aa, Neophocaena asiaeorientalis
AQGKVNFEDVFVYFSQEEWGLLDEAQRLLYREVMLENFALMASLGCSHGMEEEEIHFEQSVSVKGVSQVTIPKTFPSSQKA

SEQ ID NO: 14984 - protein, 81 aa, Nomascus leucogenys
QGLLTFRDVAIEFSQEEWKCLDPAQRTLYRDVMLENYRNLVSLDISSKCLAKEFSSTGQGNTEVIHTGTLQRHESHHIGEC

SEQ ID NO: 14985 - protein, 81 aa, Nomascus leucogenys
RRESVTFEDVAVYFSENEWIGLGPAQRALYRDVMLENYGAVASLAFPFPKPALISQLERGEAPWCSLPQGALDGEAPRGIS

SEQ ID NO: 14986 - protein, 81 aa, Nomascus leucogenys
TQTLLTFRDVAIEFSLEEWKCLDLAQQNLYRDVMLENYRNLFSIGLTVSKPGLITCLEQRKEPWNVKRQEAVDGHPEMGFH

SEQ ID NO: 14987 - protein, 81 aa, Bos indicus
NKSGMTLSQTQLTVEDVDIKFTPEEWECLDPAQRALYWDVMEETYRNLLSVDCSDQVKTHIYPEGQSKIFIIHVSLLPQSI

SEQ ID NO: 14988 - protein, 81 aa, Bos indicus
MDPVAFEDVAVNFTLEEWALLGPSQKKLYRDVMRETLSNLALIRDAWEDHNTEDQYKNQERNLRSHILQRLCESKEGSQAG

SEQ ID NO: 14989 - protein, 81 aa, Bos indicus
GQSHVTFEDVAVYFSQEEWCLLDEAQIQLYLDVMLENFALVCMLGSWPGVGDEETPFEQSKSAGVSQIGAPRTDSSAEKVQ

SEQ ID NO: 14990 - protein, 81 aa, Canis lupus
GAELLTFRDVCVDFTLEEWQQLDSAQKNLYRDVMLENYSHLVSVGYLGAKPDVVLRLGRGEEAGMTEGETPTWKYPGERAL

SEQ ID NO: 14991 - protein, 81 aa, Canis lupus
LVTFRDVAIDFSQEEWECLNSTQRDLYRDVMLENYSNVISLDLESSCKIIKSSPEKGAYEMESLQGENMRKSFSHNLDCNG

SEQ ID NO: 14992 - protein, 81 aa, Canis lupus
SQESVTFQDVAVDFTEKEWPLLDSSQRKLYKDVMLENYSNLASVDWETPSKSKWSILMEDIFGKETSSGVTVERTHLGDKP

SEQ ID NO: 14993 - protein, 81 aa, Muntiacus muntjak
MGLLTFQDVTVDFTQEEWECLDLGQRGLYRDVMLENYGNLACLGLVVSKPDLVTFLEQMKDPWNVRRIETAIYPGMCLLNI

SEQ ID NO: 14994 - protein, 81 aa, Muntiacus muntjak
VSVTFEDVAVYFSWEEWGLLNDAQRCLYHSVMLENLSLVISLGCWHGVEDEEAPSEQNISVHGLSQVRIPKAGMFSQKAHF

SEQ ID NO: 14995 - protein, 81 aa, Muntiacus muntjak
SQEAVTFKDVAVVFTEEELGLLDSAQRKLYQDVMVENFRNLVSVGHLPFKADMVSQLETEEKLWTMERETQRNGHSNEIHS

SEQ ID NO: 14996 - protein, 81 aa, Canis lupus
PQAKVTFEDVAVLLSQEEWDRLGPAQRGLYRHVMMETYGNVVSLGLPGSKPNVICQLERGEEPWVLDGQGTKETGGLGSGH

SEQ ID NO: 14997 - protein, 81 aa, Ailuropoda melanoleuca
SPGAVSFADVAVYFSPEEWGCLRPAQRALYRDVMRETYGHLGALGEARRSIQDPVEGPVPGRDAGDLRPPGRARAAARQRG

SEQ ID NO: 14998 - protein, 81 aa, Gorilla gorilla
LYEAVTFKDVAVIFTEEELGLLDPAQRKLYRDVMLENFRNLLSVGGKIQTEMETVPEAGTHEEFSCKQIWEQIASDLTRSQ

SEQ ID NO: 14999 - protein, 81 aa, Mandrillus leucophaeus
GVNKMSNEELVGQNHGMEGEACVGGDRDLYKDVMVQNYKNLVSVTGLSVTKPYVITVLEDGREPWMVEKKLSKDWESRWEN

SEQ ID NO: 15000 - protein, 81 aa, Mandrillus leucophaeus
VAFEDVAIHFSQEEWELLDETQRLLYHDVMLENFAVMASLGCWCGAEDEGAPSAESISVAELSQGRTPKADTSTDKSHPCE

SEQ ID NO: 15001 - protein, 80 aa, Sus scrofa
TQASVSLEDVTVDFSREEWQHLDPAQRRLYRDVTLENYSHLRSVGYHVPKPEVICKLEQGEGPWTLEEETPHQRCSGERV

SEQ ID NO: 15002 - protein, 81 aa, Neophocaena asiaeorientalis
TQVSVTFDDVAVTFTQEEWRQLDPAQRTLYQEVMLENCRLLVSLGCPVPRFELIFQLEQGQKLWTMKKDLSQSTCPGKRCR

SEQ ID NO: 15003 - protein, 81 aa, Bos mutus
PLLSQSCKLFREQRKMNQSLLISQPFAYMTDLEAQQPSSSSLLYLLTGCHIIKPEVITKLEQGEEPWVVEGEFLLQSHPEE

SEQ ID NO: 15004 - protein, 81 aa, Bos mutus
LTFQDVAIDFTQEEWECLDLGQRKLYRDVMVENYRNLASLDNSEHRLRVNIHSSMSEHLQFNNECENSQSKQFEGSMSRGS

SEQ ID NO: 15005 - protein, 81 aa, Neophocaena asiaeorientalis
FQEPVSFKDVAVTFTKEELGLLDSTQRKLYQDVMLENFRNLVSVGYLPFRLDMILQLGRKKKLWVMEPEAQGAGCSGHGNQ

SEQ ID NO: 15006 - protein, 81 aa, Bos mutus
QEPVTFEDVAVYFTQNQWASLDSAQRALYREVMLENYANVASLVVSPFPRPDLISQLERGEAPWDPDPWEAEDLRGICPGG

SEQ ID NO: 15007 - protein, 81 aa, Neophocaena asiaeorientalis
TRVSVTFDDVAVTFTQEEWGQLDLDQRTLYQEVMLENCGLLVSLGCPVPRSELIYQLEQGQELWTVKKDLSRSTCPGDKGK

SEQ ID NO: 15008 - protein, 81 aa, Neophocaena asiaeorientalis
FQEPVSFKDVAVVFTEGELGLLDSAQRKLYRDVMLENFRNLLSVGNQPFKPELIFQLEREELLMMETETQRDGCSGTKSQH

SEQ ID NO: 15009 - protein, 81 aa, Nomascus leucogenys
ACGSITFGDVAIDFSHQEWEYLNLVQKTLYQEVMMENYDNLVSLGHSISKPDLITLLEQGKEPWMIVREETRGECTDLDSR

SEQ ID NO: 15010 - protein, 81 aa, Nomascus leucogenys
PQVSLTFEDVAVLFTRDEWRKLAPSQRNLYRDVMLENYRNLVSLGLSFTKPKVVSLLQQGEDPWKVEKDSSGVSSLGCKST

SEQ ID NO: 15011 - protein, 81 aa, Nomascus leucogenys
MGSLTFRDVTIEFSLEEWQCLDTAQDVMLENYRNLLHLITCLKQGKEPWNMKRHEMVTKPPVISSHFTRDFWPDQSIKDCF

SEQ ID NO: 15012 - protein, 81 aa, Nomascus leucogenys
MFSDVSIDFSPEEWEYLDLEQKDLYRDVMLENYSNLVSLGCFISKPDVISLLEQGKEPWKVVRKGRRQYPDLETRYETKKL

SEQ ID NO: 15013 - protein, 81 aa, Nomascus leucogenys
GCMTFEDIAIYFSQEEWGLPDEARRLLYLEVMLENFALDFVQKYRVWWSLQQTSCNVPLVKGASPGCGHGKEDEETPSEQN

SEQ ID NO: 15014 - protein, 81 aa, Bos indicus
MLDFEEIRYDSTKPNVIIKLEQGEEPWVVDSKFLQQQHSEKVWKVGDLIERIQENGDECSRQAVSINSRTLTEEREDAFDK

SEQ ID NO: 15015 - protein, 81 aa, Bos indicus
MDPTQRDLHKDVMLENYRNLVSLGLAISKPDMISHLENGKGPWVVVREASRTPFSELETKPTTKNTIPTEDFSKKHLSQDA

SEQ ID NO: 15016 - protein, 81 aa, Bos indicus
LAVRFADVAVYFSPEEWGCLRPAQRALYRDVMQETYGHLGALGATPNKKEEEPEAGLGAKSPRKAPGKERPEELVKHNPGT

SEQ ID NO: 15017 - protein, 81 aa, Muntiacus muntjak
ESVTFEDIAVDFTQEEWALLDTSQRKLFRDVMLENISHLVSVGNQLYKSDVISQLEQGEQLSRKKLGFLQGQSPVISDRED

SEQ ID NO: 15018 - protein, 81 aa, Canis lupus
WKESVTFKDVIVDFTQEEWKQLDPFQRDLFRDVTLENYTHLVSIGLQVSKPDVISQLEQGTEPWIIEPGIPVGTFGDCETR

SEQ ID NO: 15019 - protein, 81 aa, Muntiacus muntjak
RDPVAFEDVAVNFTLEEWALLGPSQKKLYRDVMRETLSNLALIRDKWEDHYTEDQYKNQERNLRSHILQRLCESKEGSQCG

SEQ ID NO: 15020 - protein, 81 aa, Muntiacus muntjak
PQESVTFQDVAVDFTEKEWPLLDSTQRKLYKDVMLENYSNLASVGCQVGKPSLISHLEQEEELRTEDRELHQGPCPDWATP

SEQ ID NO: 15021 - protein, 81 aa, Gorilla gorilla
YEGSVSFRDVAIDFSREEWQHLDLSQRNLYRDVMLETYSHLLSVGEKLWDHNQHRKIIGYKPASSQDQKIYSGENSYECAE

SEQ ID NO: 15022 - protein, 81 aa, Ailuropoda melanoleuca
ISFEDVAVDFTSEEWQLLNPTQKSLYRDVMLENYSNLVFLEVWLDNCLKMWHQDNQDKLRSMERGHEYDVFRKIFHSSINF

SEQ ID NO: 15023 - protein, 81 aa, Mandrillus leucophaeus
GPLTFMDVAIEFSLEEWQCLDTAQQNLYRDVMLENYRNLIFLGIAVSKPDLITCLEQGKEPWNMKRHEMMAKPPGWSAVAS

SEQ ID NO: 15024 - protein, 81 aa, Mandrillus leucophaeus
IMEEAVTFKDVAVFFTEEELGLLDPAQRKLYRDVMLENFRNLLSAGHQPFHQDTFHFLREEKFWMMETVTQREGNSGGKIQ

SEQ ID NO: 15025 - protein, 81 aa, Mandrillus leucophaeus
MSNVTFSDVAIDFSHEEWAWLDSAQRDLYKDVMVQNYENLVSVAGLSVTKPYVIMLLEDGKEPWMVEKKLSKVYPFPLLHS

SEQ ID NO: 15026 - protein, 81 aa, Mandrillus leucophaeus
LQVSLTFEDVAVLFTRDEWRKLAPSQRNLYRDVMLENYRNLVALGLPFTKPKVISLLQQGEDPWKVEKDSSGDSSLGSKSS

SEQ ID NO: 15027 - protein, 81 aa, Sus scrofa
MTFEDVAVDFTQEEWQYLNPLQRTLYRDVMLETYSNLVSVEEACQVDEQIERQHEDDQDKYLLQIGLPDKKTVITKSGHDY

SEQ ID NO: 15028 - protein, 81 aa, Neophocaena asiaeorientalis
VQASLSFEDVAVRFTWEEWQLLDPSQKDLYRNVMLENYCNLVSVGYQTPKPDSLFQLEQGEPPWRVEGAGQSQTCPEEIWE

SEQ ID NO: 15029 - protein, 81 aa, Bos mutus
QEPVTFEDVAVYFTQNQWASLDSAQRALYREVMLENYPNITSLTFPFPKPDLVFWLERGEEPGCLDPWTLVRGEDPRGTCG

SEQ ID NO: 15030 - protein, 81 aa, Neophocaena asiaeorientalis
MTFEDVAVDFTQEEWQYLNPPQRNLYRDVMLETYSNLVSVGQQVTKPDLILKLEVEEPFLPEGKIPIWSFPEEACQVDEQF

SEQ ID NO: 15031 - protein, 81 aa, Bos mutus
VFLQVSFEDVTVDFSQEEWQHLDPVQQRLYWDVTLETYSHLCAVGYQVPKPEVIFRLEQGEGSWTLDKETPHHSCSAIPFS

SEQ ID NO: 15032 - protein, 81 aa, Neophocaena asiaeorientalis
AQESVMFSDVSIDFSQEEWEYLNDDQRDLYREVMLENYSNLVSMAGHSISKPDVISFLEQGKEPWLVDRELTTDQWPVLES

SEQ ID NO: 15033 - protein, 81 aa, Bos mutus
QQSLTFQDVAIDFSQEEWGFLDPAQRELYTAVMLETYQNLVWLGISVAEPNIAFLLERGPQPWVMREEDAGAPGAESESTE

SEQ ID NO: 15034 - protein, 81 aa, Neophocaena asiaeorientalis
FQGSVSFTDVTVGFTQEEWQHLDPTQRSLYRDVMLENYSNLVSVGYCVTKPEVIFRLEQGEEPWILEEEFPRQSFPEVWKT

SEQ ID NO: 15035 - protein, 81 aa, Bos mutus
QESVVFSDVSIDFSLEEWEFLNLEQRDLYRDVMLENYSNLVSLGCFISKPDVISLLEQGKEPWKVVRKGRRQYPDLETNYE

SEQ ID NO: 15036 - protein, 81 aa, Nomascus leucogenys
ELLAFKDVAIEFSAEEWKCLDPAQDVMLQNYRNLGVAICNPDLITCLEQRKEPYNVKIHETVAKSPVISLQVYRENQCPLY

SEQ ID NO: 15037 - protein, 81 aa, Nomascus leucogenys
QGLLTFRDVAIDFSQEEWKCLDPAQRTLYRDVMLENYRNLVSLDTSSKCMMKIFFSTGQGNTEVFHMGTLQTQASHHIGDF

SEQ ID NO: 15038 - protein, 81 aa, Nomascus leucogenys
LVMFQDLSIDFSQEEWECLDAAQKDLYRDVMMENYSSLVSLDSEFRCKTKDSCLPKEIYEATSSQWVRMEKCHSLVGSSVR

SEQ ID NO: 15039 - protein, 81 aa, Nomascus leucogenys
CEVSVSFEDVTVDFSREEWQQLDSTQRRLYQDVMLENYSHLLSVGFKVPKPEVIFKLEQGEGPWTLEGEAPHQSCSDGKFG

SEQ ID NO: 15040 - protein, 81 aa, Nomascus leucogenys
EKGPLTFRDVVIEFSQEEWQCLDTAQQDLYRKVMLENFRNLVFLGIAVSKPDLVTCLEQGRDPWNMKRHSMVATPPGVFFV

SEQ ID NO: 15041 - protein, 81 aa, Nomascus leucogenys
WSQNSVTFQEVAVDFSQEEWALLDPAQKNLYKDVMLENFRNLASVGYQLCRHSLISKVDQEQLKTDERGILQGGCADWETQ

SEQ ID NO: 15042 - protein, 81 aa, Nomascus leucogenys
SQELLTFKDISIDFTQEEWGQLAPAHQSLYREVMLENYSNLVSVGYQLSKPSVISQLEKGEEPWMAEKEGPGDPSSDSKSK

SEQ ID NO: 15043 - protein, 81 aa, Nomascus leucogenys
SQELLTFKDVSVDFTQEEWGQLAPAHRNLYREVMLENYGNLVSVGYRLSKPGVISQLEKGEEPWLMERDISGVPSSDLESK

SEQ ID NO: 15044 - protein, 81 aa, Canis lupus
ISFEDVAVDFTLEEWQLLNPTQKNLYRDVMLENYSNLVFLEVWLDNSLKMWHQDNQDKLRSMERGHEYDVFRKIFHSSINF

SEQ ID NO: 15045 - protein, 81 aa, Canis lupus
AQESLTFDDVAVEFTLEEWQLLAPFQKDLYRDVMLENYRNLVSVGFHTSKPDVLSKLDQGEPTWTVENEIPCRTRSEIWKL

SEQ ID NO: 15046 - protein, 81 aa, Canis lupus
LTFDDVAVEFTLEEWQLLAPFQKDLYRDVMLENYRNLVSVEIWKLDYLPEHLQNKIMENNLEQWHELKTFENNVHQSTTHF

SEQ ID NO: 15047 - protein, 81 aa, Canis lupus
AQVLVTFKDVAVTFTREEWGQLDLDQKALYQEVMLETYGLLVSLGHPVPKPELTHLLECGQELWKGKRGLSHSTCSGDDTK

SEQ ID NO: 15048 - protein, 81 aa, Canis lupus
DHVTFEDVFVYFSREEWELLEEAQRLLYRDVMLENFALVASLDCWREADNEETPSEQSVSVGGSQLRTSKSGAFIPKPHLC

SEQ ID NO: 15049 - protein, 81 aa, Muntiacus muntjak
QLTFKDVFIDFSPEEWECLDPAQRTLYKDVMVETLMNLLSVEMSHIHMIKKLHAKASSGKGEIFQRVMFGRAESLDIKDFR

SEQ ID NO: 15050 - protein, 81 aa, Muntiacus muntjak
SIAFQDLAVRFSEDEWRLLGEGQRALYLDVMRENYDTLASLGTAEPLPLSAFLSPSELGGAVGARSRVGDGKEPTQGGGPV

SEQ ID NO: 15051 - protein, 81 aa, Canis lupus
AHHLVMFRDVAVDFSQEEWECLNSYQRNLYRDVILENYSNLVSVGCSISKPDVITLLEQGKEPWMVVRDERRRSLDLESRY

SEQ ID NO: 15052 - protein, 81 aa, Muntiacus muntjak
MRENYETVISLELFVLPKPKAISCLEQGEEPYIQGSPVFKDNPGALLSEIKLKNDMENYQPMCLSDLEIQAPGDIVSKKPS

SEQ ID NO: 15053 - protein, 81 aa, Canis lupus
LQRLLTFRDVAIEFSQEEWTCLNHTQRKLYRDVMLENYGHLLFLGLIVSKPDLVSFLEQKKEPWSVKRKKRVTIHPGKVAQ

SEQ ID NO: 15054 - protein, 81 aa, Gorilla gorilla
GEGSLSFEDVAVGFTREEWQFLDQSQKVLYKEVMLENYSNLVSIGYQGTKPDSLFKLEQGEPPGIVEGAAHSQICPGFVIQ

SEQ ID NO: 15055 - protein, 81 aa, Ailuropoda melanoleuca
NFWVLRLPPGSSGEAPKEWGKLDEWQKELYKHVMRGNYETLVSLDYAISKPEVLSQTEQGKEPCSWRRTGPKVPDVPVDPS

SEQ ID NO: 15056 - protein, 81 aa, Gorilla gorilla
WEESLTLEDVAVDFTWEEWQFLSPAQKDLYRDVMLENYRNLVAVGYQASKPDALSKLEREEETCTTEDEIYSRICSEIRKI

SEQ ID NO: 15057 - protein, 81 aa, Sus scrofa
GGVTFEDIALYFSWEEWRLLDEAQRCLYRDVMLENYALISSLGFWSEEDIEVPFEQSFSVGTSQARTSKEPSSSQKTQPCE

SEQ ID NO: 15058 - protein, 81 aa, Sus scrofa
YKGSVMFSDVSVDFSQEEWEFLDPAQRDLYKDVMLENYSNLVSMGLCMPKPQVISLLEQGKEPWMVGRELTKGLCSDLESM

SEQ ID NO: 15059 - protein, 81 aa, Neophocaena asiaeorientalis
MAHLMMFRDVAVDFSQEEWECLNLEQRALYRDVMLENYSNMVSLGLCLYQPDVFSLLEKGKEPWMVLKDETGGPCPDMQSR

SEQ ID NO: 15060 - protein, 81 aa, Bos mutus
FSFPTQLTFKDVFIDFTPEEWECLDPAQRTLYKDVMVETLRILLWVRITSFRSGGILWGTSACSLCVSWEPLFFLLRSKPC

SEQ ID NO: 15061 - protein, 81 aa, Neophocaena asiaeorientalis
AQGSLTLKDVAVDFTWEEWQLLDPDQKDLYRDVMLENYSNLVSVGYQVNKPDILSMLEQGEPPWTLEDEVHSHPHPETDKV

SEQ ID NO: 15062 - protein, 81 aa, Bos mutus
QGNVTFEDVFVSFSQEEWGLLDEAQRLLYREVMLENFALMASLGYASSMSHGVSPQELGREPWVSDWANTIPALTREAQSA

SEQ ID NO: 15063 - protein, 81 aa, Bos mutus
FQGSLSFRDVAVGFTRKEWQELDPTQKTLYRDVMLENYSHLVSVGCQVTKPAVISRLEQGQEPWMEEEEILRWSFPEVSQV

SEQ ID NO: 15064 - protein, 81 aa, Bos mutus
EWQRLSPEQRDLYRDVTLENYRNLVSMGGEDSTKPEVILRLENGEEPWMVGTQELRSCSPAEKDWAIEEQSWRFQDIEQNL

SEQ ID NO: 15065 - protein, 81 aa, Neophocaena asiaeorientalis
WSQDSVTFEEVAVDFSQEEWALLDPAQKILYRDVMLENFRNLASVGYHLCKHSLITEVEQEELRPEQRGILQGTYRDRDTQ

SEQ ID NO: 15066 - protein, 81 aa, Neophocaena asiaeorientalis
VLLTFRDVAIEFSQGEWECLDPTQRALYREVILETYRNMLSLDISTRCVIKELSPKEDINKGELFRILMLGRHKRNDIKDF

SEQ ID NO: 15067 - protein, 81 aa, Nomascus leucogenys
EMGPLTFRDVAIEFSLEEWQCLDTSQQNLYRNVMLDNYRNLVFLGIAVSKPDLITCLEQGKEPCNMKRHAMVAKPPVVCSH

SEQ ID NO: 15068 - protein, 81 aa, Nomascus leucogenys
EKGPLTFRDVAIEFSLEEWQCLDTAQQDLYRKVMLENYRNLVFLAGIAVSKPDLITCLEQGKEPWNMKRHAMVDEPPVIYS

SEQ ID NO: 15069 - protein, 81 aa, Nomascus leucogenys
MIYVAIEFSLEEWQCLDTAQRDLYRNVLLENYRNLVFLGIAVSKPYLITCLEQKKEPWNIKRHEMVAKPPVMSFHFAQDLW

SEQ ID NO: 15070 - protein, 81 aa, Nomascus leucogenys
DKKESLTFQDVAVDFTREEWDQLYPAQKNLYRDVMLENYRNLVALGYQLYKPEVIAQLELEEEWVIERDSLLDTHPDGENR

SEQ ID NO: 15071 - protein, 81 aa, Nomascus leucogenys
MFREAVTFKDVAVVFTKEELGLLDLSQRKLYRDVMLENFRNLLSVGHQPSHRDTFHFRREEKFWIMETATQTEGNSGGKIQ

SEQ ID NO: 15072 - protein, 81 aa, Nomascus leucogenys
SLGSELFRDVAIVFSQEEWQWLAPAQRDLYRDVMLETYSNLVSLGLAISKPDVISFLEQGKEPWMVERVVSRGLCPVLESR

SEQ ID NO: 15073 - protein, 81 aa, Nomascus leucogenys
PQGHLTFMDVAIEFSQEEWKSLDPGQRALYRDVMLENYRNLVSLGICLPDLSIISMLKQRREPLTLQSQVKIVKNTDGREC

SEQ ID NO: 15074 - protein, 81 aa, Bos indicus
PAQLTFKDVFIDFTPKEWDSLDPAQRTLYKDVMVETLRNLLSVDVSQIRMIKKLQAKGNSGKEEIFQRVVFGRAESHEIED

SEQ ID NO: 15075 - protein, 81 aa, Bos indicus
MAMYLTREEWRPLDPTQRDIYRDVMQENYGNVVSLDFEIRSENEVNPKQEISEDVEFETASERPVGNTEENPESEEAFDNR

SEQ ID NO: 15076 - protein, 81 aa, Bos indicus
LQGSVTFEDVAVYFSWEEWSLLDDAQRRLYHSVMLENLALIISLGCWHGAEDEEASSEQNISVHGMSQVRIPKAGMFSQKA

SEQ ID NO: 15077 - protein, 81 aa, Bos indicus
PKVPVTFDDVAVHFSEQEWGNLSEWQKELYKNVMRGNYESLVSMDYAISKPDLMSQMERGERPAMQEQEDSEEGEAPADPS

SEQ ID NO: 15078 - protein, 81 aa, Bos indicus
SQESVTFQDVAVDFTQEEWALLDTSQRTLFREVMLENISHLVSVGNQVYKSDVISHLEQGEQFSREGLGFLQGQSPVISDR

SEQ ID NO: 15079 - protein, 81 aa, Canis lupus
MLYRELMLENYGTLVSLGILFSKPKVIFQLQQGEDPWMVENGVSQSPCVGWENLFETTVSEEENQEVMNKLLGDSFFDFKL

SEQ ID NO: 15080 - protein, 81 aa, Canis lupus
RSAFVAFRDVAVDFTQEEWRLLSPAQRTLHREVMLETYNHLVSLEIPFSKPKLISQLEQGEEPWIEERQHPLGLCSGSKLN

SEQ ID NO: 15081 - protein, 81 aa, Muntiacus muntjak
MGWLTFWDVAIDFTQEEWECLDLGQRDLYTDVMVENYRNLASLGLVVSKPDLVTFLEQMKDLRNIRRMQTAVIYPVFSKSS

SEQ ID NO: 15082 - protein, 81 aa, Muntiacus muntjak
AVTFTDVAVDFSQDEWEWLTLAQRTLYKKVMIENYSNLASLGLCVSKPDVISLLEQDKEPWTMKGELTRGPCADLEYVWMK

SEQ ID NO: 15083 - protein, 81 aa, Muntiacus muntjak
WREDSVTFADVAVYFTQEEWTLLNPFQRKLYGNVMLENYKNLTTAGYQAFKPTLISWLEQEVLKTVERGILQEWEMQLTSN

SEQ ID NO: 15084 - protein, 81 aa, Canis lupus
HRGGLLTFRDVAIEFSQEEWGCLNHTQRELYRDVMLENYGNLLFLDLIVSKPDLVSFLEQKKEPWSVKRKKRVTIHPGKWK

SEQ ID NO: 15085 - protein, 81 aa, Crocuta crocuta
QAQLTFRDVAIEFSQEEWECLDPAQRALYRDVMLETYRNLVSLGEESVPPEIIGYFFNIYLSDSSATFMIKELLSVRDINN

SEQ ID NO: 15086 - protein, 81 aa, Gorilla gorilla
KEPGEAPVTFDDITVYLLQEEWVLLSQQQKELCGSNKLVAPLGPTVANPELFCKFGRGPEPWLGSVQGQRSLLEHHPGKKQ

SEQ ID NO: 15087 - protein, 81 aa, Gorilla gorilla
PQKSVTFEDVAVYFTQAEWDGLSPAQRALYRDVMLENYGNVASLGFPLLKPAVISQLEGGGELGGPSPLAAGTGLQGLQTV

SEQ ID NO: 15088 - protein, 81 aa, Sus scrofa
GNASGLTLEDVTLGDVAIEFSPEEWACLDPAQRALYRDVMLETCRNLLSLGEHRFPPGVGICPWVSLRFPSCASWEPLCLA

SEQ ID NO: 15089 - protein, 81 aa, Neophocaena asiaeorientalis
QLTFEDVAITFSQEEWECLDPAQRALYRDVMLETYRNLLSLAVSHIHVIKKLKPKANSDTGEVFQTVMLGRHESHEIRDFY

SEQ ID NO: 15090 - protein, 81 aa, Bos mutus
PQESVTFEDVAVNFSHEEWQCLTHAQRHLYKDVMLENYGNMVSLGFSFSKPPLISRLEQGAEPYVQDRQDWEFLSCSYPVS

SEQ ID NO: 15091 - protein, 81 aa, Bos mutus
TARSQASVTFKDVAMDFTPEEWGRLDPTQRDVMLENYRNLVSLWLPVSKPENHSLENGKEPLLLERKAPKSSCSDSETSPR

SEQ ID NO: 15092 - protein, 81 aa, Neophocaena asiaeorientalis
QESVTFKDVAVDFTLEEWGQLGPGQRELYRDVMLENYQNLLSLGAGLPGSKPDVISRLERGEEPRMERREAWRVTCSDLET

SEQ ID NO: 15093 - protein, 81 aa, Neophocaena asiaeorientalis
VSVNFEDVAVTFSWEEWGLLDEAQRYLYHDVMLENLALITSLGCCHEVENEKASFEQRTSVQRVSQIRSPKANLSFKKVHP

SEQ ID NO: 15094 - protein, 81 aa, Neophocaena asiaeorientalis
SLGSDLFRDVAVVFSQEEWEQLAPAQRDLYRDVMLEIYSNLVSLGLAISKPDVISFLEQGREPWMVEKVATGGHCPDQVSQ

SEQ ID NO: 15095 - protein, 81 aa, Neophocaena asiaeorientalis
SQGPVSFTDVAVDFTQEEWQQLDPDEKTTYRDVMLENYSHLVSVGYDSTKPNVILKLEQGEEPWVADGEFPRQFHPEEVWK

SEQ ID NO: 15096 - protein, 81 aa, Neophocaena asiaeorientalis
FQMSLSFRDVAIDLSQEEWECLDPVQRALYRDVMLENYSNLVSLGCSSPKPDVITLLEQEKEPWTAMREGTRSWYTDLESK

SEQ ID NO: 15097 - protein, 81 aa, Nomascus leucogenys
EMGPLTFRDVAIEFSLEEWQCLDTAQQDLYRKVMLENYRNLVFLGIAVSKPDLVTCLEQGKDPWNMKRHSMVVKPPVICSH

SEQ ID NO: 15098 - protein, 81 aa, Nomascus leucogenys
ARGCVVFEDVFVYFSWEEWELLDDAQRLLYHDVMLENFALLASLGIAFSRSRAVMKLEQGEEPWVYDQVDMTSATEREAQR

SEQ ID NO: 15099 - protein, 81 aa, Nomascus leucogenys
MLENHQNLLALGPPLHKPDVISHLERGEEPWSMQREVPGGPCPEWELKAVPSQQQGICKEEAAQEPIMERPLGGAQAWGLQ

SEQ ID NO: 15100 - protein, 81 aa, Canis lupus
PKVLVSFEDVSVYFTKTEWKLLDLRQRILYKRVMLENYGHLESLGFLSSKPHLVSWLEQGEGPWGADMCGTPAAAGIQTDD

SEQ ID NO: 15101 - protein, 81 aa, Canis lupus
AQGSVMFNDVSIVFSQEEWEYLDLEQKDLYRDVMLENYSNLVSLGCFISKPDVISLLEQGKEPWKVVRKGRRRYLDLENRY

SEQ ID NO: 15102 - protein, 81 aa, Canis lupus
AQGGVTFEDIAVYFSWKEWRLLDEAQRRLYHHVMLENFTLISSLGCCCGAEAVEAPIEQNASGGVSQTRTPRVALTSQKTH

SEQ ID NO: 15103 - protein, 81 aa, Canis lupus
QESVTFKDVAVDFTLEEWGQLGPGQRELYRDVMLENYRNLLSLGAGPPGSKPEVITRLERGEEPKMEKREARQATCPDLDT

SEQ ID NO: 15104 - protein, 81 aa, Crocuta crocuta
PKVPVTFDDVAVHFSEQEWGNLSEWQKELYKNVMRGNYESLVSMDYAISKPDLMSQMERGERPPMREQEDSEEGETPADPS

SEQ ID NO: 15105 - protein, 81 aa, Muntiacus muntjak
RMKSVTFEDVAVYFTQTEWDSLSTAQRALYRDVMLENYGNVASLGFPLLKPAVISQLEGGGELEGPSPLASGAGTGPQGLW

SEQ ID NO: 15106 - protein, 81 aa, Canis lupus
MSRAEGRCSTAEPPRCPSYLFLYAGLCISKPDIISLLEQGKEPWMMKGEMTRDLYPDLKYVWMTRELPPNQDIYEEKLSQA

SEQ ID NO: 15107 - protein, 81 aa, Canis lupus
GWLTFRDMAIEFSQEKECLDSAQWALYRDVMLENYRNLVSLDISPTHVIKKLQPKENSDTEVFQTVMLQRSEGYEIKDFFF

SEQ ID NO: 15108 - protein, 81 aa, Muntiacus muntjak
MGRLTFWDVAIDFTQEEWECLDLGQRELYMDVMLENYANVASLGLVSKLDLVTLLEQLKDPRSIRRMETTAIYPAMTPQDT

SEQ ID NO: 15109 - protein, 81 aa, Canis lupus
FQGSLTFSDVAIGFSQQEWECLDPVQKSLYRDVMMENYGNLVSLGYSISKPDVITLLEQGKEPWMVLREETKRWDTDSFLS

SEQ ID NO: 15110 - protein, 81 aa, Canis lupus
KCLINYSQDPVTFDDVAVEFTQEEWTLPDQIQRRPYRDVVLENYKNLASIDWEICLNSKWSAPQQNILQGKTPSVVEMNSR

SEQ ID NO: 15111 - protein, 81 aa, Muntiacus muntjak
QVTFKDVAIEVSQEEWKFPDPAQRTLYRDVMVETYRNLLSVENSLFDLNIISILEQVREPQNVENKVKKVNAWGHIKGMNT

SEQ ID NO: 15112 - protein, 81 aa, Bos mutus
FLKGISQESVKFRDVAVVFSPDLWAHLSPEERELYRDVMLDTCAQLVLLGRWTYKVEVISSLRQGRDPRMLEGEATSAAWP

SEQ ID NO: 15113 - protein, 81 aa, Bos mutus
SQGLVTFEDVAVYFSLEEWERLDAEQRELYKEVMRENYGILVSLGYPVPKPDLIFRLEQGEEPWVPDSPRPEDGDIVTGVY

SEQ ID NO: 15114 - protein, 81 aa, Neophocaena asiaeorientalis
MLENYRNLASLGLCISKPDVISLLEQDKEPWMMKGEITRRLPTDLEYVWMRKELSPNQDIYEEKLSQAMIMERLTGCDLKC

SEQ ID NO: 15115 - protein, 81 aa, Neophocaena asiaeorientalis
RKVPVSFEDVSVYFTKTEWKLLDLRQRVLYKRVMLENYRHLVSLGFSSSKPHLVSRLERGEGPWVADVHRMGTTTGMQAGD

SEQ ID NO: 15116 - protein, 81 aa, Neophocaena asiaeorientalis
MDSVVFEDVAVNFTAEEWALLDLAQRKLYRDVMLETFRNLASVGSCPQVKTSRSSAHWDILETGLCSEEKVVRFTRNDSCS

SEQ ID NO: 15117 - protein, 81 aa, Bos mutus
SKAPVTFGDLAIYFSQEEWEWLSPIQKDLYEDVMLENYQNLVSLGLSFRRPNVITLLEKGKAPWMVDPVKRRRGLDLGSKC

SEQ ID NO: 15118 - protein, 81 aa, Bos mutus
SQGLLTFEEVAIYFSQEEWELLNPTQKALYNDVMHENYETVISLALFVLPKPKVMYLEQGEEPYIQGSPMFKDNPGELLSD

SEQ ID NO: 15119 - protein, 81 aa, Bos mutus
FQDQVTFEDVVVDFTQEEWGHLEPAQRTLYRDVMLETFGLLVSVGHWLPKPDVISLLEQEAELWAADKGGPRDLETRPQSK

SEQ ID NO: 15120 - protein, 81 aa, Bos mutus
QEQVSFKDVCVDFTQEEWYLLDPAQKILYRDVILENYSHLVSVGNCITKPEVIFKIEQGEEPWILEERFPKQWHSGKSYKY

SEQ ID NO: 15121 - protein, 81 aa, Nomascus leucogenys
MNMSQASVSFQDVTVEFTQEEWQHLGPVERTLYREVMLENYSRLVSVIYKLEQGAEPWSLDDEFLNQRYPGYFKVDHIKGI

SEQ ID NO: 15122 - protein, 81 aa, Nomascus leucogenys
AQGLVTFRDVAIEFSLEEWKCLEPAQRDLYREVTLENFGHLASLGLSISKPDVVCLLEQGKEPWMIANDVTGPWCPDLESR

SEQ ID NO: 15123 - protein, 81 aa, Nomascus leucogenys
EEALMAFWDVAVAFTQKEWKLLSSAQRTLYREVMLENYSHLVSVGIAFSKPKLIKQLEQGDEPWREENEHLDLCPESRSVA

SEQ ID NO: 15124 - protein, 81 aa, Bos indicus
TQVSVTFDDVAVTFTQEEWGHLDPAQRTLYREVMLETCRLLMSLGCPVPRPELIYQQEHGQELWTVKRDLSRSTCAGYSSE

SEQ ID NO: 15125 - protein, 81 aa, Bos indicus
MLENYRNLASLGLVVSKLDLVTFLEQMKNPWDVRRLEAPAIYTGWKPFACTECGNTSNQNSKLAQDRQIHAGKKPYECKEC

SEQ ID NO: 15126 - protein, 81 aa, Canis lupus
AQGGVTFEDIAVYFSWKEWRLLDEAQRRLYHHVMLENFTLISSLGCCCGAEAVEAPIEQSASGGVSQTRTPRVALTSQKTH

SEQ ID NO: 15127 - protein, 81 aa, Canis lupus
GQSPVTFEDVAVYFSKEEWKLLDAGQRHLYYSVMLENFELMTSLGCWYGMEDEGARSKQNASVERMSQVRIPSVNPSTQKA

SEQ ID NO: 15128 - protein, 81 aa, Muntiacus muntjak
GLVMFKDVAIDVSQEEWECLNPAQRNLYKDVMLENYSNLVSLGLSVSKPAMITSLEQGKEPWMVLREVTGERCPDLVSKCE

SEQ ID NO: 15129 - protein, 81 aa, Canis lupus
QAEVTFEDVAVLFSREEWGRLGPSQRGLYRDVMLETYRNLVSLGAGPAGPKPGVITQLERGDEPWDLDAQGAKGTERLRVS

SEQ ID NO: 15130 - protein, 81 aa, Muntiacus muntjak
HSGFVVFEDVAIYFSQEEWGLLDEAQRLLYCQVMLQNVALLSSVGCRHGTQDEVALSEQHDAAARSQVKTPKPGPCIQKPP

SEQ ID NO: 15131 - protein, 81 aa, Canis lupus
DRGLVVFTDVAIHFSQEEWGLLDEAQRSLYHSVMLENFALLSSLGCLHRAQDEGAPSEQGVSAGTSQVRTPKPGPSIQDAQ

SEQ ID NO: 15132 - protein, 81 aa, Muntiacus muntjak
MTFRDVAIDFTQEEWECLDLGQRELYTDVMLETYGNLASLALTHSFPNLESVHCHMSSSHCCFLTCIQMSQEEGTVVWCSH

SEQ ID NO: 15133 - protein, 81 aa, Muntiacus muntjak
GLVTFRDVAIDFSQEEWEFLDPAQRDLYVDVMLENYSNLVSLDLESTYETKNTFSKKDIFEINFSQWKIKERNKTIKLEAS

SEQ ID NO: 15134 - protein, 81 aa, Muntiacus muntjak
EPGPVTFKDVAVDFTQEEWGQLDSPQRALYRDVMLENYQNLLSLGPPVCKPDVISHLERGEEPWQAARDGPAGPGPGWEPR

SEQ ID NO: 15135 - protein, 81 aa, Muntiacus muntjak
MGLLTFQDVTVDFTQEEWECLDLGQQELYRDVMLENHGNLACLGLVVSKPDLVTFLEQMKDPWGVRRMETAIHPGISNVTI

SEQ ID NO: 15136 - protein, 81 aa, Gorilla gorilla
LQISFEDVAVDFTVEEWQLLNPTQKNLYRDVMLENYSNLVFLGKNILIIIIEGITQYEVWLDNPKMWLRDNQDNLKSMERG

SEQ ID NO: 15137 - protein, 81 aa, Sus scrofa
SQALLTLGDVAIEFSQEEWACLDPAQRRALYRDVMLETCRNLLSLGEHRFPPEASVNSVWDECSVFLLPSAVRLCPSRPSC

SEQ ID NO: 15138 - protein, 81 aa, Sus scrofa
MLENINHLASVGCQISKADVISQLEQGKELWRETTGCLQNKSPGSKCPLRQQEMISMLQVKRKHLSTTMPMQVSHAQEDPV

SEQ ID NO: 15139 - protein, 81 aa, Neophocaena asiaeorientalis
ARLTFKDVVIEFSPEEWECLDPAQRALYRDVMVETYRNLISVDLSHVHVIKKLQLKSNTDVGEIFPTVMLGSHGSCEIKHF

SEQ ID NO: 15140 - protein, 81 aa, Neophocaena asiaeorientalis
PLESVTLEDVAINFTQEEWALLDTSQKTLFRNVMLENITHLVSVGYQISKSDVISQLEQGKELWSEATGCLQSQSPDGESL

SEQ ID NO: 15141 - protein, 81 aa, Neophocaena asiaeorientalis
MTFEDVAVDFTQEEWQYLNPPQRNLYRDVMLETYSNLVSVAGQQVTKPDLILKLEVEEPFLPEGKIPIWSFPEEACQVDEQ

SEQ ID NO: 15142 - protein, 81 aa, Bos mutus
KGLVTFSDVAIDFSQEEWACLDSRQRDLYWDVMLENYSNLVSLGNCGDTPAYRESTPVRPQQRLPNRENSYECKECGKAFS

SEQ ID NO: 15143 - protein, 81 aa, Nomascus leucogenys
YQDLVTFDDVAVDFTQEEWTLLDPSQRDLYRDVMLENYENLASVGHDLFKPNVISWLEEEEELRAGRRGVLQEWRLKTKGP

SEQ ID NO: 15144 - protein, 81 aa, Nomascus leucogenys
QGRLTFRDVAIEFSLAEWKFLNPSQRALYREVMLENYRNLEAVDISSKCMMKEVLSTGQGNSEVFYTGTLQRHESHHVGGF

SEQ ID NO: 15145 - protein, 81 aa, Nomascus leucogenys
PQESVAFEDVAVYFTAKEWDIMVPAERALYRDVMLENYEAVAFVVPPTSKPALVSHLEQGKESCFTRPQGVLCRNDWRAGL

SEQ ID NO: 15146 - protein, 81 aa, Nomascus leucogenys
SLGSVTFTDVAIDFSQDEWEWLNLAQRSLYKKVMLENYRNLVSVGLCISKPDVISLLEQEKDPWVIKGEMTRGLCPDLECV

SEQ ID NO: 15147 - protein, 81 aa, Nomascus leucogenys
MSNVTFSDVAIDFSHEEWACLDSAQRDLYKDVMVQNYENLVSVAGLSITKPYVIMLLEDGKEPWTVEKKLSKVYPFPLSHS

SEQ ID NO: 15148 - protein, 81 aa, Nomascus leucogenys
DSVVFEDVAVDFTLEEWALLDSAQRNLYRDVISVARFEMWERTKTDMFTQDMHGQEKSKEQTIPNFTGNNSCAYTLEKNCR

SEQ ID NO: 15149 - protein, 81 aa, Bos indicus
MIDLASLMLPEEDTQKMRKRKEKESGMALSQEQLTFEDVAIDFSLEEWECLDPAQRALYRDVMVETYRNLFSLGFHFCLDS

SEQ ID NO: 15150 - protein, 81 aa, Bos indicus
SQGWLTFQDIAIDFTQEEWECLDLGQRELYRDMMLENYGNLASLGTCVSKPDLVTFLEQRKDSRNIRRVETTPIAPAASSL

SEQ ID NO: 15151 - protein, 81 aa, Bos indicus
EQLTFKDVAVEFSQEEWECLDPAQRAFYMDVMVETLRNLISVDISHIYVVKKLQPIASSDRGDAFQTVTLERQESPEMKYF

SEQ ID NO: 15152 - protein, 81 aa, Canis lupus
FQEPVMFKDVAVVFSEEELGLLDSTQRKLYRDVMLENFRNLVSVGNQFYKPELIFQLEREEKLLMMETETQRDGYIDFIYF

SEQ ID NO: 15153 - protein, 81 aa, Canis lupus
SRMSVTFEDVAVLFTRDEWRKLGPSQRHVYQEVMLENYSNLVSLGLLFSKPKVISLLQRGEDPWKVEKESPGGPSLGWKSS

SEQ ID NO: 15154 - protein, 81 aa, Canis lupus
LKGSVTFKDVTMAFTQKEWEQLDPAQRSLYKDVMLENYSNLASMGYQAPKPDMISKLEKGEEPWLGKGKRLQQGGPGEIAR

SEQ ID NO: 15155 - protein, 81 aa, Canis lupus
SQHLVTFEDVAVDFTQEEWTLLDQAQRDLYRDVMLENYQNLITLAGYESCQPGLNSTMEVAEELRAGGRGVLQGEKQCWSE

SEQ ID NO: 15156 - protein, 81 aa, Canis lupus
SQELVAFEDVLVDFTPEEWQYLNSSQKTLYREVMLETYGNLVSVAGQQDTKPDLILKLELEGPCLAERKISVWSFPEEACQ

SEQ ID NO: 15157 - protein, 81 aa, Canis lupus
PQGPVTFEDVAVYFPQSQWTSLDPMQRALYREVMLENYANITSLAAFPFPKPDLIFQLERGEAPWGLDPWIPIEGEALGGV

SEQ ID NO: 15158 - protein, 81 aa, Canis lupus
PKVPVTFDDVAVYFSEPEWGKLDNWQKELYKHVMRGNYEMLVSLDYAISKPDILTQMERGEEPCPEGPWGQEEGNKREAAC

SEQ ID NO: 15159 - protein, 81 aa, Canis lupus
MLETYGLLVSLGHPVPKPELTHLLECGQELWKGKRGLSHSTCSGDDTKLQIRNPSTSPLVLSEGALLQGSLTQGSSGDSRL

SEQ ID NO: 15160 - protein, 81 aa, Muntiacus muntjak
SLAFEDVAVNFTLDEWVLLDSSQRKLYRDVMRENFRNVVSVEAKQEDHDIEDQDKNQERKLRNPKAERHSEKKDINSSEES

SEQ ID NO: 15161 - protein, 81 aa, Muntiacus muntjak
LGNLITFEDVAINFTQKEWALLNPSQRRLYKDVMLENYRNLASLGYQLSKPPLITHLEQEDEMKIVEQRIHQGTCSCEHQA

SEQ ID NO: 15162 - protein, 81 aa, Muntiacus muntjak
EVGSVSFKDISVDFSREEWQQLDLAQKSLYRDVMLENYFNLISVGCQVPKPEVIFNLEWGEEPFMWNDKTSSQSCLDQDIG

SEQ ID NO: 15163 - protein, 81 aa, Canis lupus
LYLELVILRDVAMDFTLEDWEHLGLDQGDLFWDTALDNYQNLFLLNPSKPKLTSCPDGGEKLEVLVRASTESECPDTAGAK

SEQ ID NO: 15164 - protein, 81 aa, Canis lupus
DEAVMAFRDVAVAFTQKEWKLLSSAQRTLYRDVMLENYSHLVSLGIAFSKPKLITQLEQGDEPWREENECFLDLCPGEWEA

SEQ ID NO: 15165 - protein, 81 aa, Crocuta crocuta
GLVTFRDVAIEFSQEEWKCLEPAQRNLYRDVTLENFSNLVSLGLSISKPDVISLLEQGREPWMIANDMTGPWCPELKSRCE

SEQ ID NO: 15166 - protein, 81 aa, Canis lupus
PLTFKDVAVVFTEEELKLLDPTQRKLYRDVMLENFRNLLSVGDKNEKVLEYIQERELKCLSYRELSYWKIWEQVAGELTGS

SEQ ID NO: 15167 - protein, 81 aa, Sus scrofa
MSPARRTLYRDVMLENYSHLVSSGLKMEHFDASLSTYFRAWLGPRDLRVKGWFLLDNYIPTLVCSILYLLIVWLGPKYMKN

SEQ ID NO: 15168 - protein, 81 aa, Sus scrofa
SMTFEDIAVYFSWEEWRLLDETQRRLYLDVMLDNYALISSLGCCCGAEGSEASFEQIDSLGASEATTPKAALSSQKTHPCG

SEQ ID NO: 15169 - protein, 81 aa, Sus scrofa
FKEAVTFKDVAVAFTEEELGLLDSAQRKLYQEVMVENFRNLVSVGENSQNQSELRAIQDRGSHEELSCRQIWQQIADDLTR

SEQ ID NO: 15170 - protein, 81 aa, Sus scrofa
EVVPLTFQDVAVYFSWEEGRQLGPDQRTLYRDVMLENYGHVASLGLPVSKPELISQLEQGEEWWVLGLLRAEQQEVLSRTD

SEQ ID NO: 15171 - protein, 81 aa, Sus scrofa
MSRTDVAIDFSPEEWECLDLGQRHLYRDVMLEICRHLVSLEYVISKPDLVRLLEQKTDPWDVKGMETVSLNLGRERKKHTG

SEQ ID NO: 15172 - protein, 81 aa, Bos mutus
FQEFVTFEDVAVHLTREEWGCLDPVQRALYREVMLENYGNLVSLGFPIFKPDGISQLEQDLQVFDLETKNREVLRDDCSDG

SEQ ID NO: 15173 - protein, 81 aa, Neophocaena asiaeorientalis
ERLTFEDVAIEFTEEEWECLDPAQRALYRDVMVETYRNLLSLGKGERKQWLMRAHLLTQAREREGYSIHNWDVRGVPLAAE

SEQ ID NO: 15174 - protein, 81 aa, Bos mutus
DSVTFEDMSVKFTTEEWGLLDLTQKKLYRDVMRETFKNLTSVDAVKIKKVISMGKHLARFQIIIKKKETTGIKLYKFSIYG

SEQ ID NO: 15175 - protein, 81 aa, Neophocaena asiaeorientalis
PQKSVTFEDVAVYFTQTEWDGLSPAQRALYRDVMLENYGNVASLGFPLLKPTVISQLEGGGELEGPSPLTSGTGTGHQGLW

SEQ ID NO: 15176 - protein, 81 aa, Neophocaena asiaeorientalis
QGSVTFEDVAVYFSWEEWCLLDEVQMHLYLDVMLENFALVCMLGSWHWVEDEETPSEQSVSAEGVSQIRTSSAGSSPEKTQ

SEQ ID NO: 15177 - protein, 81 aa, Neophocaena asiaeorientalis
RESGKAPVTFDDITVYLLQEEWTLLSQQQEEICGSDELVAPLGPTIANPELFYKFERGPEQWLANVQGQRSLLSLHRGKNK

SEQ ID NO: 15178 - protein, 81 aa, Neophocaena asiaeorientalis
AKDCVTFEDVTIYFSQEEWGLLDEAQRLLYCDVMLENFALIASLGLTSFRSHVVAQLEMGAEPWVPDRVDMTSAMARGAYR

SEQ ID NO: 15179 - protein, 81 aa, Bos mutus
DLGRLMFQDVTIDFTLEEWECLDLDQRELYRNVMLENYGNLASLGLVVSKPDLVTFLEQMKNPWDIRRTDTTATYPSVSSH

SEQ ID NO: 15180 - protein, 81 aa, Bos mutus
VTFEDVFVYFSREEWELLEEAQRLLYRDVMLENFAHVAALVLFTIIVSLLITASPPYLPRPRTDNGPFLTDPGPSSCQRPV

SEQ ID NO: 15181 - protein, 81 aa, Neophocaena asiaeorientalis
AVWGPLSFMDVFVDFTWEEWQLLDPAQKHLYRSVMLENYSNLVSLGYQHTKPNIIFQLEQEELWMMQIPSESHMDEVWEID

SEQ ID NO: 15182 - protein, 81 aa, Nomascus leucogenys
ESVTFQDIAVDFTEKEWPLLDSSQRKLYKDVMLENYSNLTSLDWETPSKTKWSLLMEDIFGKETPRGVTMERARLGEKSAE

SEQ ID NO: 15183 - protein, 81 aa, Nomascus leucogenys
VDFPQEEWTLLDQTQRDFYRDVMLENYKNLIILGKTELRTGVTGVLQELDLQLKTKGSPLLQDISAERSPNGIQLERSNTA

SEQ ID NO: 15184 - protein, 81 aa, Nomascus leucogenys
PKVPVAFDDVSIYFSTPEWEKLEEWQKELYKNIMKGNYESLISMDYAINQPDVLSQIQPEGEHNTEDRAGPEESEIPTDPS

SEQ ID NO: 15185 - protein, 81 aa, Nomascus leucogenys
ESVTFEDVAVEFIQEWALLDSARRSLCRYRMLDQCRTLASRGTPPCKPSCTSQLGPTAEPRATERGIFHATGVAWESQLKP

SEQ ID NO: 15186 - protein, 81 aa, Nomascus leucogenys
QDAVAYEDLSVDYTQKKWKGLPLSQRALQWNMMPENDRSMASLGENMMKGSELTPKQEIFKGSESSNRTSGGLFGVVPGAA

SEQ ID NO: 15187 - protein, 81 aa, Nomascus leucogenys
AEGLVMFEDVTVYFSREEWGLLNVTQKGLYRDVMLENFALVSSLGLAPSRSPVFTQLEDDEQSWVPNWVDVTPVSRAEARR

SEQ ID NO: 15188 - protein, 81 aa, Nomascus leucogenys
IGGDVTFSDVAIDFSHEEWACLDSAQRDLYKDVMVQNYENLVSVGLSITKPYVITLLEVGKEPWRVEKKLSKDNKELSTKK

SEQ ID NO: 15189 - protein, 81 aa, Bos indicus
CEGLVSFEDVTMDFSREEWQQLDPAQRHLYQDVMLEIYSHFFSVGYHIPNPEIIFRIEEGKEPWVRKTELPCQRYHEGEFG

SEQ ID NO: 15190 - protein, 81 aa, Bos indicus
RDQDFRASLLHTASQEQWRHLDSTQKEQYWDLMLETYGKMVSGGAGISSARPDLTDPAGYGVELAGPHLQANEKIPRPTCI

SEQ ID NO: 15191 - protein, 81 aa, Bos indicus
PQGSVTFEDVAVYFSWEEWALLDEAQRCLYHDVMLENFALTSSLGYWHGVEDKEAPSEQSICIGVSQIRTLKVDSSPHKGQ

SEQ ID NO: 15192 - protein, 81 aa, Bos indicus
TQLTVEDVDIKFTPEEWECLDPAQRALYQDVMVETYRNLLSVDVSRIHMTMKLQAKGNNGKGEIFQRVMFGRAKTHEIKDY

SEQ ID NO: 15193 - protein, 81 aa, Canis lupus
MFKEAVTFNDVAVAFTEEELGLLDSAQRKLYQDVMLENFRNLVSVGHQPFKRDKWQIEREEKLWLMKTTTQIERNVGGNNQ

SEQ ID NO: 15194 - protein, 81 aa, Canis lupus
WEETVTFKDVAVIFTEEELGLLDPAQRKLYGDVMLENFRNLLSVGHQPFTPDVILQLERGEKLRMVKMAAWGPSASGDKNL

SEQ ID NO: 15195 - protein, 81 aa, Canis lupus
QGPLLFEDLAVYFSQEECVSLYPAQRSLSRDTTLECFEDMALMGGEGKTEIPQQLNLESTGFEELSPENSIAVPLVYYPEK

SEQ ID NO: 15196 - protein, 81 aa, Canis lupus
LTFRDVAIEFSEEEWECLDPAQRALYRDVMLENYRNLVSLGEDNVPSAVGICPWVSLHFPLFASWEPLPCLIEIEALLMQK

SEQ ID NO: 15197 - protein, 81 aa, Muntiacus muntjak
PCEPVTFEDVAVYFSQNQWASLDSAQRALYREVMLENYATVASLVSPFPRPDLISQLERGEAPWDPNPWEAEDLRGICPGG

SEQ ID NO: 15198 - protein, 81 aa, Muntiacus muntjak
DSLVFEDVAVNFTWEEWVSLDSSQKKLYRDVMLENFRNIVSVEFFDFLPSLAVWYGNQKLVFIQKKIPGEENDNPLQYSCL

SEQ ID NO: 15199 - protein, 81 aa, Gorilla gorilla
EPGAVSFADVAVYFCREEWGCLRPAQRTLYRDVMRETYGHLSALGIGGKKPALISWVEEEAELWGPAAQDPEVAKCPTQTD

SEQ ID NO: 15200 - protein, 81 aa, Sus scrofa
SEDLVTFGDVAVDFSQEEWEWLSPAQRHLYRKVMLENYRSLVSLAGVSASKPDVISLLEQGKEPWMMKKEGTRRACPVMWK

SEQ ID NO: 15201 - protein, 81 aa, Sus scrofa
SLVFEDVAINFTPEEWALLDPAQRRLYRDVMLETFKNLAFVGFCPRVKTTGSSPQWNILENKLCSDEKILRFIRNGSWSVF

SEQ ID NO: 15202 - protein, 81 aa, Sus scrofa
PPKGSLTLEDVAVDFTWEEWQLLTPDQKDLYRDVTLENHRNLVAVGYQALKPDALSRLERGELWPEEDEILGQICPEMRKD

SEQ ID NO: 15203 - protein, 81 aa, Mandrillus leucophaeus
FQDSVAFEDVAVSFTQEEWALLDPSQKNLYRDVMQETFKNLTSVGKTWKIQNMEDKYKNPRRNLSLMREKLFESKESHHCG

SEQ ID NO: 15204 - protein, 81 aa, Sus scrofa
FQDLVMFRDVTVDFSQEEWECLNSNQRNLYRDVILENYSNLVSLGGCSISKPDVITLLEQGKEPWMVVRDEKRRWSLDLES

SEQ ID NO: 15205 - protein, 81 aa, Sus scrofa
TQGLVTFKDVAVCFSQDQWSDLDPTQKEFYGEYVLEEDCGIVVSLSFPIPRLDEIAHIEEEERSTPDIPEPQEPDILSFTY

SEQ ID NO: 15206 - protein, 81 aa, Sus scrofa
FQAPVTFGDLAIYFSQEEWECLSPIQKDLYEDVMLENYQNLVSLGLSFRRPNVITLLEKGKAPWMVEPVKRRRGLDLGSKC

SEQ ID NO: 15207 - protein, 81 aa, Sus scrofa
QAQGTLTFDDVAVDFTWEEWQLLTPAQKDLFRDVMLENYRNLVAVGYQARSADVLSRLDRGEPRPVEADIHAHTRAETCKV

SEQ ID NO: 15208 - protein, 81 aa, Sus scrofa
EMLTFEDVALYFTREEWDTLGWAQKGVYREVMLANYRNMVSLGSTARFEVQEPTAKQNISEDFESCTMSLVKQKTARKPSE

SEQ ID NO: 15209 - protein, 81 aa, Sus scrofa
AGSTVTLKDLFIHFTQEEWEPLDEDQKHLYCNMMPENFALVISLRLTVSRSHIISQPELETYISNPHPSQHKKVHTTVRPV

SEQ ID NO: 15210 - protein, 81 aa, Neophocaena asiaeorientalis
MLENFALIASLGLTSFRSHVVAQLEMGAEPWVPDRVDMTSAMARGAYRGPGSDFCHGTEGEGSPAELSVSVEVSQDMNPKV

SEQ ID NO: 15211 - protein, 81 aa, Neophocaena asiaeorientalis
SRSLENDGVCFSEQEWENLEGWQKELYTNAMKSSYETLVSLKVLGRPEGEAELGTEMLGDLEEEDSRGVHPVEGVMIKQEI

SEQ ID NO: 15212 - protein, 81 aa, Bos mutus
GQSHVTFEDVAVYFSQEEWCLLDEAQIQLYLDVMLENFALVCMLGSWPGVGDEETPFEQSKSAGVSQIGSPRTDSSAEKVQ

SEQ ID NO: 15213 - protein, 81 aa, Neophocaena asiaeorientalis
WSQMPVTFEDVAVYLSREEWGRLDHTQQSFYRDILQKRNGLSLGAVEVGKEELAPSLGALGDMKSFKSRVGRAQGDASRCG

SEQ ID NO: 15214 - protein, 81 aa, Bos mutus
RLTFKDVAIEFTPEEWECLDLAQRALYREVMVETLRNLLSVDTSPKRVLKGSAPKQSSHTGGILQTMLSERHKSHDTKDQG

SEQ ID NO: 15215 - protein, 81 aa, Neophocaena asiaeorientalis
MLENYSSLVSLGYEVMKPGVILKLEHGEEPWTGDGEIPGSDSSEQVLQVNGHITWHKDNQEKLKNMKQDQECDALGKNFNL

SEQ ID NO: 15216 - protein, 81 aa, Bos mutus
QVSVTFDDVAVTFTQEEWGHLDPAQRTLYREVMLETCRLLMSLGCPVPRPELIYRLEHGQELWTVKRDLSRSTCAGRSQAV

SEQ ID NO: 15217 - protein, 81 aa, Neophocaena asiaeorientalis
ALESVTFRDVAVFFSRDEWLHLDSAQRTLYQEVMLENYSTLFSLGILFSKPKVILQLEQGEDPWMVENGVSQSTCLGWESL

SEQ ID NO: 15218 - protein, 81 aa, Bos mutus
MNQNICYSSILGKRVGVVIKKGCPFTKPDVIFKLEQEEEPWVMEEEVLKKHCPGEIWGMDEQLKIQDRLLTQLEDKFTKTL

SEQ ID NO: 15219 - protein, 81 aa, Nomascus leucogenys
MFQDSVAFEDVAVSFTQEEWALLDPSQKNLYRDVMQETFKNLTSVGKTWKVQSIEEYKNPRRNLSLMREKLCESKESHHCG

SEQ ID NO: 15220 - protein, 81 aa, Nomascus leucogenys
EMGPLTFMDVAIEFCLEEWQCLDTAQQNLYRTVMLENYRNLVFLGIAVSKPDLITCLEQEKEPWEPMRRHEMVAKPPVMCS

SEQ ID NO: 15221 - protein, 81 aa, Nomascus leucogenys
VTFADVAVNFTNEEWTLLDPAQRNLYRDVMLENSRNLAFIILPKRTFPEANRVCLTSISSQLSTLREDWRCPKTEEPHRQG

SEQ ID NO: 15222 - protein, 81 aa, Nomascus leucogenys
IMEEAVTFKDVAVVFTEEELGLLDPAQRKLYRDVMLENFRNLLSMGHQPFHRDTFHFLREEKFWMMGTATESEGNPGGKIQ

SEQ ID NO: 15223 - protein, 81 aa, Bos indicus
LQGSFSFEDLSVDFTQKEWQLLDPHQKDLYKDVMLENYSSLVSLGYEVMKPGVILKLEQGEDPWTGDGEIPSSASIDQVFQ

SEQ ID NO: 15224 - protein, 81 aa, Bos indicus
FQDTVTFKDVAIDFTQEEWKQLDPAQRNLYRNVMLENYNNLITVGCPFTKPDVIFKLEQEEEPWVIEEEVLKKHCPGEIWG

SEQ ID NO: 15225 - protein, 81 aa, Bos indicus
MKPMQLTQVLKYFPFTGYCFTKPELIFMLEQGEDPWLLEKEFINRSSPEEFQPDELLEESLENQGKALRQVLFINKSLTME

SEQ ID NO: 15226 - protein, 81 aa, Bos indicus
SLGSDLFRDVAAVFSQEEWEQLAPTQRDLYRDVMLETYSNLVSLGLAISKPDVISFLEQGKEPWTVEEVVTEGLCPVLQSR

SEQ ID NO: 15227 - protein, 81 aa, Bos indicus
SVTFEDVAVYFSWEEWALLDEAQRCLYHDVMLENFALTSSLGCWHGAEDKGAPSEKSISVEGVSQIKTLKADSCPQKGQPF

SEQ ID NO: 15228 - protein, 81 aa, Bos indicus
HQGSVTFEDVAMYFSWEEWCLLDEAQIQLYLDVMLENFALVCMLGSWRGVQDKETPSEEIAPAGVLQFRTPRAGLSPEKTQ

SEQ ID NO: 15229 - protein, 81 aa, Canis lupus
VKDSVTFKDVAIDFTLEEWRLMDPSQRNLHKDVMLENYRNLASLGLAVSKPDMISHLEDGKGPWVVVRELARTPYPELETI

SEQ ID NO: 15230 - protein, 81 aa, Canis lupus
QVLVTFKDVAVTFTREEWGQLDLDQKALYQEVMLETYGLLVSLGDDTKLQIRNPSTSPLVLSEGALLQGSLTQGSSGDSRL

SEQ ID NO: 15231 - protein, 81 aa, Canis lupus
AQGSVMFSDVSIDFSQEEWECLDPGQRDLYRDVMLENYSNLLSMGLYIPKPQVISLLEQGKEPWMVGRELTRGLCSDLESM

SEQ ID NO: 15232 - protein, 81 aa, Canis lupus
MLENYINLISVGYQTAKPSVTHKLEQGEEPWMVEREIPCGSYAEIWQLDDHMERNQENQETLLKHVAFTDQGTMTEEKSNK

SEQ ID NO: 15233 - protein, 81 aa, Muntiacus muntjak
CSELVTFRDVAVDFSQEEWDCLNPSQRHLYSNVMLENYRILVSLGLCFSKPSVILLLEQGKEPWMAKREMTKDLYSDWESM

SEQ ID NO: 15234 - protein, 81 aa, Muntiacus muntjak
SVMFSDVSIDFSLEEWEFLNLEQRDLYRDVMLENYSNLVSLGCFISKPDVISLLEQGKEPWKVVRQGRRQYPDLETNYEIK

SEQ ID NO: 15235 - protein, 81 aa, Ailuropoda melanoleuca
FKEAVTFKDVAVVFTEEELGLLDPAQRKLYGDVMLENFRNLISVGRQPLTPDVILQFERGEKFRMIKTATQGHSPSGDKNL

SEQ ID NO: 15236 - protein, 81 aa, Gorilla gorilla
MGPLQFRDVAIEFSLEEWHCLDTAQRNLYRDVMLENYRNLVFLGIVVSKPDFITCLEQGKKPLTMKKHEMVANPSETGFHH

SEQ ID NO: 15237 - protein, 81 aa, Ailuropoda melanoleuca
FEGSVSFEDVAVDFTRQEWHRLDPAQRTMHKDVMLENYSNLASVGLCVAKPEMIFKLERGEELWILEDESSGHGYPGSLSL

SEQ ID NO: 15238 - protein, 81 aa, Gorilla gorilla
KFQEMVTFKDVAVVFTREELGLLDLAQRKLYQDVMLENFRNLLSVGYQPFKLDVILQLGKEDKLWMMETEIQGDGCSGLTL

SEQ ID NO: 15239 - protein, 81 aa, Nomascus leucogenys
QEPLSFKDVAVVFTEEELELLDSTQRQLYQDVMQENFRNLLSVGERSPLGDKNGKDMEYIQDEELRFFSHKELSSCKIWEE

SEQ ID NO: 15240 - protein, 81 aa, Nomascus leucogenys
SLKKVTFEDVAIDFTQEEWAMMDTSKRKLYRDVMLENISHLVSLGYQMSKSYIILQLEQGKELWREGREFLQGQNPDRESA

SEQ ID NO: 15241 - protein, 81 aa, Nomascus leucogenys
SKGPVMFRDVSIDFSQEEWECLDAGQMNLYKEVMLENFSNLVSVGLSNSKPAVISLLEQGKEPWMVDRELTRGLCSDLESM

SEQ ID NO: 15242 - protein, 81 aa, Nomascus leucogenys
TPFSCLSLLSSWDYSSGFSGFCASPIEESHGALISSCNSRTMTDGLVTFRDVAIDFSQEEWECLDPAQRDFFLHWKLQGYL

SEQ ID NO: 15243 - protein, 81 aa, Bos indicus
QKRKEQESGMALSQAQLTFKDVFIDFTPEEWECLDPAQRTLYKDVMVETLGNLLSVGSSVSDLNIISILVAQGRRPLDCGE

SEQ ID NO: 15244 - protein, 81 aa, Nomascus leucogenys
TEGRVVFEDVAIYFSQEEWGHLDEAQRLLYRDVMLENLALLSSLGSWHGAEDEEAPSQQGFSVGVSEVTTSKPCLSSQKVH

SEQ ID NO: 15245 - protein, 81 aa, Bos indicus
RLTSEDVAIEFTQEEWEFLDPAQRALYRDVMLETYRNLLSVDISPTHVIKHLQPKGNSDKREIFQTLMLGRPESCEIKHFH

SEQ ID NO: 15246 - protein, 81 aa, Bos indicus
PQGLLTFGDVAVHFTQEEGARLDAGQRTLYRDVMLETYRNLVSLGVPESKPDLISQLEQGREPWGSDLLGAQEAETAGNAG

SEQ ID NO: 15247 - protein, 81 aa, Bos indicus
QSQLTLNDVAIHFSPEEWECLDPAQKALYVDVMLDTFRNLLSVDISHLYIWKLQLKSHADRGGVCRTVIWGRNEIPETKHF

SEQ ID NO: 15248 - protein, 81 aa, Bos indicus
PQVSVNFEDVAVTFSWEEWGLLDETQRCLYRDVMLENLALITSLGCCHEVENKKTSFEQNVSFQRMSQIRTPKADLSSKEA

SEQ ID NO: 15249 - protein, 81 aa, Bos indicus
PLESVTFGDVAIDFTQEEWSLLDKSQKNLFRNVMLETVTHLVSAGAQISKSDVVFQLEQGKELWTQAAGGLQGQSPVPFRS

SEQ ID NO: 15250 - protein, 81 aa, Canis lupus
MLENCGLLVSLGCPVPRPELLYQLKHGQELWMVKKDLCQSTYPGDKGKPKTIELTTCEPALNKSPEGPLFQELKQGDPGNF

SEQ ID NO: 15251 - protein, 81 aa, Canis lupus
HQELVTFKDVAVYFTQTEWAGLSPAQKALYRSVMLENYGNLTSLGYPVPRPALVSLLEGGNLPWGLEAQNNPSAERSKGIC

SEQ ID NO: 15252 - protein, 81 aa, Canis lupus
MWENYSNFISLEPSISKPDVITLLDEGKEPWMVVREETKRHYSDLESRYRTNTLSPEKDIYEIYSFQWEIMERIKSYSLQD

SEQ ID NO: 15253 - protein, 81 aa, Canis lupus
MQENYGHLISVGYHVNKPNAVFKLKQGKQPWILEVEFPHWNSPEDLWKIHDLGARYQESRTENSRNGELTKKQQTHAREKI

SEQ ID NO: 15254 - protein, 81 aa, Canis lupus
SQGLLTFRDVAIEFSQEEWGCLNHTQRELYRDVMLENYGHLLFLGLVVWKPDLVIFLEQEKELWDVKRKETIDFHPAVSSS

SEQ ID NO: 15255 - protein, 81 aa, Canis lupus
SRSLENDGVCFSEQEWENLDDWQKELYRNVMKSNYETLVSLKVLGQPEGEAELGAGMLGDLEEEGPGDVNPAEGVLIKQEI

SEQ ID NO: 15256 - protein, 81 aa, Canis lupus
PMLSSSWQGSGTFEDVAVYFSWEEWELLDEAQRHLYCKVMLENLALVASLGKAFPPLPSPPASVLVSVLLLFPGIALSSYS

SEQ ID NO: 15257 - protein, 81 aa, Muntiacus muntjak
TQEPVTFNDVAVDFTQEEWGQLDLVQRTLYRDVMLETYGHLLSVGNQIAKPEVISLLEQGEEPWSMEPAYPLQGTCPEWMK

SEQ ID NO: 15258 - protein, 81 aa, Muntiacus muntjak
LQGGVTFEDVAVALTQEEWQRLSPEQRDLYKDVTLENFRNLVSVGGEEAAKPEVILRLENGEEPWTVETQGLRSCGPAEKD

SEQ ID NO: 15259 - protein, 81 aa, Canis lupus
SEESVTFKDVAVDFTQEEWGQLDSPQRALYRDVMLENYQNLLALGPPVCKPDVISHLERGEEPWWMPGEVPGGACSGGEPG

SEQ ID NO: 15260 - protein, 81 aa, Canis lupus
SVTFKDVIVDFTQEEWKQLDPFQRDLFRDVTLENYTHLVSIDCETRPENSVSVPELDVSEEQPSDEAIVEKHKRDDPCSSN

SEQ ID NO: 15261 - protein, 81 aa, Muntiacus muntjak
QEPVIFKDVAVEFSKEEWGQLDPAVKTLYRHVMLENYRNLNSLQEGDHLLSKPVESSKLESKKESWIMEQEIPRTAVVDRE

SEQ ID NO: 15262 - protein, 81 aa, Ailuropoda melanoleuca
SQESVTFQDVAVDFTEKEWPLLDSSQRKLYKDVMLENYSNLASVGYQVGKPSLISHLEQEEEPRTEERAPHRATSPDWEAP

SEQ ID NO: 15263 - protein, 81 aa, Ailuropoda melanoleuca
QAPVTFEDMAMYLTREEWRPLDPTQRDLYRDVMQENYGNVVSLDFEIRSENEVNPKQEISEDVEFGTASERPVGNTEENPE

SEQ ID NO: 15264 - protein, 81 aa, Gorilla gorilla
PGQHVSFEDVTVDFSREEWQHLDPAQRRLYWDVTLENYSHLLSVGYQVPKSEAAFKLEQGEGPWMLEGEAPHQSCSGEAIG

SEQ ID NO: 15265 - protein, 81 aa, Gorilla gorilla
KKKPVTFEDVAVNFSQEEWDCLDASQRVLYQDVMSETFKNLTSVARIFLHKPELITKLEQEEEQWREFVHLPNTEGLSEGK

SEQ ID NO: 15266 - protein, 81 aa, Gorilla gorilla
EKGPLTFRDVAIEFSLEEWQCLDTAQQDLYRKVMLENYRNLVFLGIAVSKPDLITCLEQGKEPWSMKRHAMVDEPPVIYSH

SEQ ID NO: 15267 - protein, 81 aa, Ailuropoda melanoleuca
LFQMPVTFEDVALYLSREEWGRLDHAQQNFYRDVLQKRNGLSLGFPFSRPFWASQGQGKGETSSSCRQMGDEEKTGAIEVG

SEQ ID NO: 15268 - protein, 81 aa, Gorilla gorilla
MFKEAVTFKDVAVVFTEEELGLLDVSQRKLYRDVMLENFRNLLSVGHQPSHRDTFHFQREEKFWIMETATQREGNSGGKIQ

SEQ ID NO: 15269 - protein, 81 aa, Gorilla gorilla
CEASVSFEDVTVDFSREEWQQLDPAQRCLYRDVMLELYSHLFSVGYHIPNPEVIFRMLKEKEPRVEEAEVSYQRGQERDFG

SEQ ID NO: 15270 - protein, 81 aa, Gorilla gorilla
FQASVSFQDVTVEFTQEEWQHMGPVERTLYRDVMLENYSHLVSVGYCFTKPELIFTLEQGEDPWLLEKEKGFLSRNSPEDS

SEQ ID NO: 15271 - protein, 81 aa, Ailuropoda melanoleuca
FQVPLTFSDVAIDFSQEEWECLNSDQKDLYRDVMLENYTNLVSLDFDFTTETNKLSSEKSSYEVNSYHQETMKRSKIFNPT

SEQ ID NO: 15272 - protein, 81 aa, Ailuropoda melanoleuca
KGLLTFEDVAVFFTQEEWDYLDPAQRSLYKDVMMENYGNLVSLDVLNRDKDEEPTVKQEMEEIEEEVEPQGVIVTRIKSEI

SEQ ID NO: 15273 - protein, 81 aa, Nomascus leucogenys
QGRLTFRDVAIEFSLAEWKFLNPSQRALYREVMLENYRNLEAVDISSKRLKKEVLSTGQGNTEVFHSGTLQRHESYHIGDF

SEQ ID NO: 15274 - protein, 81 aa, Nomascus leucogenys
TFKEGLTFKDVAVVFTEEELGLLDPVQRNLYRDVMLENFRNLLSVGHHPFKHDVFPLEKEKKLHMMKTAAQRKGKSADKIQ

SEQ ID NO: 15275 - protein, 81 aa, Nomascus leucogenys
KEGVNFKIVTVDFTQEEEGTWNPAQRTLDRDVILENDRDLVSWDLATAVGKKDSTSKQRIFDEEPANGVKIERFTRDDPWL

SEQ ID NO: 15276 - protein, 81 aa, Nomascus leucogenys
NIVIVTFDDVAFYFSEQEWEILEKWQKQMYRQEMKTNYETLDSLGYAFSKPDLITWMEQGRMLLISEQGCLDKTRRTISPP

SEQ ID NO: 15277 - protein, 81 aa, Nomascus leucogenys
IWGPLSFMDVFVDFTWEEWLLLDPAQKCLYRSVMLENYSNLVSLGYQHTKPDVIFKLEQGEELCMVQAQVPNQSCPILKAG

SEQ ID NO: 15278 - protein, 81 aa, Nomascus leucogenys
CLTNCYQDSVTFDDVAVDFTQEEWTLLDSTQRSLYSDVMLENYKNLATVGGHIIKPSLISWLEQEESRTVNGGVLQGEGTL

SEQ ID NO: 15279 - protein, 81 aa, Nomascus leucogenys
SYEGSVSFRDVAIDFSREEWRHLDLSQRNLYRDVMLETYSHLLSVGYQVPEAEVVMLEQGKEPWALQGERPRHSCPGEKLW

SEQ ID NO: 15280 - protein, 81 aa, Nomascus leucogenys
AQVSVTFDDVAVTFTKEEWGQLDLAQRTLYQEVMQENCGLLVSLGCPVPRPELIYHLEHGQEPWTRKEDLSQGTCPGDKGK

SEQ ID NO: 15281 - protein, 81 aa, Nomascus leucogenys
AQSSVTFEDVAVNFSMEEWSLLNEAQRCLYRDVMLETLTLISSLGCWHGGEDEAAPSKQSTCIYIYKEQGGHSGERPYECG

SEQ ID NO: 15282 - protein, 81 aa, Bos indicus
MWENYRNLLSVGYQSPKPIEIFKLKQGDKPWIERGNIHDPEVGDPMQQSLEIQYKHKNMERGHELSSLGNIFCLHGNLVTL

SEQ ID NO: 15283 - protein, 81 aa, Bos indicus
SHTLVTFKDILVNFTREEWKLLDTAQQIMYKDVMLENYRNLVSLGHQLPKPDVILRLEKGEEPWLVEREIHQETQPDAETS

SEQ ID NO: 15284 - protein, 81 aa, Bos indicus
EEGQVTFEDVAVYFSWEEWGLLDEAQRLLYCGVMLETFSLMASLGLTPSRTHAMTQLEQRGEPCVPTGGVSTTATPAGCWC

SEQ ID NO: 15285 - protein, 81 aa, Bos indicus
FKGSVTLQDVAVEFTPEEWQLLDCDQRTLYWDVMLENFRNLISVGCPVTETTVIFKVEQGQGPWMVEGENSRWSSPEADCP

SEQ ID NO: 15286 - protein, 81 aa, Bos indicus
PKVPVTFDDISIYFSTPEWEKLEEWQKELYKNIMKGNYESLISMDYAMNQPDVLSQIQPEGDRNTEDQTGPEESGIPTDPS

SEQ ID NO: 15287 - protein, 81 aa, Bos indicus
SQESVTFRDVSIDFSREEWEWLQPAQRDLYRHVMLENYGHLVSLAGLNMSKPDVVSLLEQGKEPWLGNGDVSRELFPASKS

SEQ ID NO: 15288 - protein, 81 aa, Bos indicus
WGSLVAFEEVAMHFSREEWELLDEAQRQLYHAVMLETLELVTSLGCWPVVEDEEVPSEKNASGEVVSQVKTPSVPPSMQKA

SEQ ID NO: 15289 - protein, 81 aa, Bos indicus
ARLSVTFDDVAVTFTQEEWGHLDPAQRTLYQEVMLENCGLLVSLGCPVPRPELIYRLEHGQELWTVARDLSRSTCAGDKGK

SEQ ID NO: 15290 - protein, 81 aa, Bos indicus
LQEPVTFRDVAVDFTQEEWGQLGPAQRTLYRDVMLETFGHLLSVGPELPKPDVISQLEQGAELWVAERGLAQGCRPGQEAA

SEQ ID NO: 15291 - protein, 81 aa, Canis lupus
ELVTFRDVVISFSQEEWEYLDSAQRDLYWDVMMENYSNLVSLDLESKYDTKCLSTGKDVENNGSQGKVTENKFIGLESCIF

SEQ ID NO: 15292 - protein, 81 aa, Muntiacus muntjak
VSVTFEDVAVLFTRDEWRKLAPPQRNLYQDVMLENYSNLVSLGWKNSYKTTKSTQTQGHSFQELIMKRSKRSGPGDFKSEK

SEQ ID NO: 15293 - protein, 81 aa, Canis lupus
KSVGPVSFKDVAVDFTQEEWQQLDPEQKTTYRDVMLENYNHLVSVEVWKADDLVERVQENEGKYSKQAVSFNSKTLIEERG

SEQ ID NO: 15294 - protein, 81 aa, Canis lupus
WSQMPVTFEDVALYLSREEWGRLDHTQQSFYRDVLQKRNGLALGFPFSRPFWTSQGQGKGEASSSCQQMGDEEEEKTGTCR

SEQ ID NO: 15295 - protein, 81 aa, Canis lupus
ENFSIIMRDVAVEFSPEEWRCLNHTQRELYRDVMLENYGHLLFVGLIVSKPDLVSFLEQRKEPWDLKTKKTVAIHPVLFCL

SEQ ID NO: 15296 - protein, 81 aa, Muntiacus muntjak
MGPITFRDVVIEIFLHEWEFLNSLQKKLYRDVMMENYSNLVSLGHSISKPDIIVLLEEGRNPWMVVRKEARSWHTDLYRSP

SEQ ID NO: 15297 - protein, 81 aa, Muntiacus muntjak
SGETLTFRDVFVDFTQEEWQQLDAAQKNLHRDVMLENYSHLVSVEFWKVNDQTDNHKESQDKPLWQAASIDKETLKDKSGQ

SEQ ID NO: 15298 - protein, 80 aa, Muntiacus muntjak
MGRLMFRDVAIDFTQEEWECLDLGQRDLYRDVMLETYGNLASLGLVVSKPDLVTFLEQMKNPWDVRRTVTTATYPENANL

SEQ ID NO: 15299 - protein, 81 aa, Muntiacus muntjak
GSMMFRDVSVNFSQEEWKCLDSGQMNLYKEVMLENFSNLVSVGLSSSKPAVISLLEQGKEPWMIDRELTRGLCSDLESMCE

SEQ ID NO: 15300 - protein, 81 aa, Muntiacus muntjak
IPPLVTFEDVAVYFSWEEWGLLDETQRLLYHGVMLETFSLMASLGLTSFRTHDMTQLEQRGEPCVPAEGVSATATPAGCWC

SEQ ID NO: 15301 - protein, 81 aa, Crocuta crocuta
MAFEDVAVYFSQEEWALLDAAQRALYCHVMLENFALVSSLGLSASRPRVVMRLERGEEPWVVSGTVATAARNAQRKPSPGE

SEQ ID NO: 15302 - protein, 81 aa, Muntiacus muntjak
TAGSVTFNDVTMAFTRKEWEQLDPAQKSLYKDVMLENYSNLASMGYQALKPDMISKLEKGEEPWLGKGKRPKQGGWSEIAR

SEQ ID NO: 15303 - protein, 81 aa, Gorilla gorilla
GLRSVMFSDVSIDFSPEEWEYLDLEQKDLYRDVMLENYSNLVSLGCFISKPDVISSLEQGKDMCLLSYLESRYRTNTLSPE

SEQ ID NO: 15304 - protein, 81 aa, Canis lupus
AQGSLTLEDVAVDFTWEEWQLLAPAEKNLYRDVMLENYRNLVSVGYQARKPDVLSKLEQGEEPWAKQKEVLHGTRPETSKV

SEQ ID NO: 15305 - protein, 81 aa, Gorilla gorilla
MWLSWNTAQKDLYQDVMVENSNHLVSLGYQTSKPDALSKLAHGREPLKTDAKVQNKNCPGIRKVDSHLQEHSPNHMQQCSG

SEQ ID NO: 15306 - protein, 81 aa, Ailuropoda melanoleuca
NRNIVTFEDVCVYFSPEEWELLDESQKRLYCSVILENFLLVTSLGLAISRVENEGASSQQGISVKESQARILSVGPSNQKS

SEQ ID NO: 15307 - protein, 81 aa, Gorilla gorilla
LTFKDVAVVFTEEELGLLDPVQRNLYQDVMLENFRNLLSVGHHPFKHDVFLLEKEKKLDMMKTATQRKGKSADKIQSEVET

SEQ ID NO: 15308 - protein, 81 aa, Ailuropoda melanoleuca
CQESVTFEDVAVIFTDEEWRHLVPIQRDLYKEVMLENYKSIVSLGLPVPRPDVIFQLKRGDEPWVVDLHGSEERECPENVS

SEQ ID NO: 15309 - protein, 81 aa, Ailuropoda melanoleuca
QSLVTFGDVAVDFSREEWEWLNSAQRTLHRDVMLENYRNLVSLGLCVSKPDMISSLEQRKEPWMLKRKLTRGRCPDLKTMQ

SEQ ID NO: 15310 - protein, 81 aa, Sus scrofa
SRSLESDGVCFSEQDWENLEGWQKELYANVMRSNYEALVSLKVLGQPEGEAELGTEMLGDLEEGEGPGGDHPAEGRLMKQE

SEQ ID NO: 15311 - protein, 81 aa, Sus scrofa
MIKSQISFEDVAVDFTLEEWQLLNPTQKNLYRDVMLENYSSLVFLGYQIIKPDTIFKLEQEDPWILDEEILSQSFPEEVWL

SEQ ID NO: 15312 - protein, 81 aa, Sus scrofa
SQESVTFEDVAVDFTQEEWALLNSSQRKLFRDVMLENISHLVSIGNQLHKSDVISHAEQEEQLSREGLGFLQGQSPVISGR

SEQ ID NO: 15313 - protein, 81 aa, Bos mutus
TYPNGVLDADAGRASPPSWTVGRMAARGAPCSRCSPASVEGFQGYGVSVSKPDVISLLEQGKEPWMVKEEGPRGACPGWEY

SEQ ID NO: 15314 - protein, 81 aa, Bos mutus
QAPVTFEDMAMYLTREEWRPLDPTQRDIYRDVMQENYGNVVSLVVQPKECLLERWKHGSTKKKTKQVSCPNKFGNRLNNVY

SEQ ID NO: 15315 - protein, 81 aa, Bos mutus
LQETLTFRDVFVDFTQEEWQQLDAAQKNLHRDVMLENYSHLVSVGYLVAQPNGIFRLGQGEEEARIAAGESVIWSCPGRSP

SEQ ID NO: 15316 - protein, 81 aa, Nomascus leucogenys
RDVTIEFSLEEWEFLKPAQQNLYRKVMLENYRNLVSLGLTVSKPELISCLEQRQEPWNVKRHETIAKPPAISSHYPEDFLP

SEQ ID NO: 15317 - protein, 81 aa, Bos mutus
SQSLLKFEEVAIYFSQEEWELLDPTQKALYNGVMHENYKTVIFLALFVLPKPKVISYLEQEEKPYIQGSPVFKDNPGDLLS

SEQ ID NO: 15318 - protein, 81 aa, Neophocaena asiaeorientalis
VKESVTFKDVAIDFTLEEWRLMDPTQRKLHKDVMLENYRNLVSLGLAVSKPDMISHLEDGKGPWVVVRETSKTPSSELETK

SEQ ID NO: 15319 - protein, 81 aa, Nomascus leucogenys
VHGSVTFRDVAIDFSQEEWECLQPDQRTLYRDVMLENYSHLISLGSSISKPDVITLLEQEKEPWMVVRKETNRRYPDLESK

SEQ ID NO: 15320 - protein, 81 aa, Nomascus leucogenys
VAFEDVAIYFSQEEWELLDEMQRLLYCDVMLENFAVMASLGCWCGAEDEGAPSAESVSVEELSQGRTPKADISTDKSHSCE

SEQ ID NO: 15321 - protein, 81 aa, Bos indicus
VVFEDVAVDFTQEEWALLNLAQRNLYRDVMLENFRNLASLGFEIQLKINESVAPQDAYGKISNEQDVAGFKASDSSLSILH

SEQ ID NO: 15322 - protein, 81 aa, Bos indicus
WSQMPVTFEDMALYLSREEWGRLDHTQQSFYREVLQKRSGLSLGVVEVDKEELAASLGALGDAKSFKSRMARAQGEAPRCG

SEQ ID NO: 15323 - protein, 81 aa, Bos indicus
LQGGVTFEDVAVDFTQEEWQRLSPEQRDLYRDVTLENYRNLVAMGEQDSTKPEVILRLENGEEPWMVGTQELRSCSPAAKD

SEQ ID NO: 15324 - protein, 81 aa, Canis lupus
LQDSVTFKDVAVDLTQEEWTLMDRSQRKLYIDVMLENITHLVSVGCQFFQSDMIAQWEQGGELWKEERGLAQGWGPVISGL

SEQ ID NO: 15325 - protein, 81 aa, Canis lupus
MLENYSNLVFLGYHIIRPDAIFKREQEEPWMVQKEVLSQSFAEEVWLDNSLKMWHQDNQDKLRSMERGHEYDVFRKIFHSS

SEQ ID NO: 15326 - protein, 81 aa, Muntiacus muntjak
GSVSFKDVTVDFSQEEWQHLDPAQKTLYMDVMLENYCHLISVGCHMTKPDVILKLERGEEPWTSFKGHTCLEENWKTEDFL

SEQ ID NO: 15327 - protein, 81 aa, Muntiacus muntjak
LQEPVTFRDVAVDFTQEEWGQLGPAQRTLYRDVMLETFGHLLSVGPELPKPDVISQLEQGAELWVAEGGLAQGCRPGQETG

SEQ ID NO: 15328 - protein, 81 aa, Gorilla gorilla
QGRLTFRDVAIEFSLAEWKFLNPAQRALYREVMLENYRNLESVDISSKRMMKEVLSTGQGNREVIHTGTLQRHESHHIGDF

SEQ ID NO: 15329 - protein, 81 aa, Ailuropoda melanoleuca
SVGPVSFRDVAVDFTQEEWQQLEPEQKTTYRDVMLENYRHLVSVGCHIIKPEVIIKLEQGEEPWIVEGEFLPQSYPGVLVQ

SEQ ID NO: 15330 - protein, 81 aa, Ailuropoda melanoleuca
PKVPVTFDDVAVYFSEPEWGKLDNWQKELYKHVMRGNYEMLVSLDYAISKPDILTRLERGEDPCPEGPWGQEERSKKEAAR

SEQ ID NO: 15331 - protein, 81 aa, Ailuropoda melanoleuca
GCVTFEDMAIYFSQEEWVLLDEAQRHLYHDAMLENFALIASLVCWHGMEDEEAPFEQSVAGEVLLWVRTPKAGLSTQKTRP

SEQ ID NO: 15332 - protein, 81 aa, Ailuropoda melanoleuca
PQAKVTFEDVAVLLSQEEWDRLGPAQRGLYRHVMMETYGNVVSLAGLPGSKPNVISQLERGEEPWVLDGQGAEKTRGLGSG

SEQ ID NO: 15333 - protein, 81 aa, Ailuropoda melanoleuca
PVAFEDVAVNFTLEEWALLDPSQKKLYRDVMQETLRNLASIGKKWKDHSIEDQYKNQGRKLSHVVEALCQSKEGSQCGGNF

SEQ ID NO: 15334 - protein, 81 aa, Bos mutus
MFQESLTFQDVAVDFTREEWDQLYPAQKNLYRDVMLENYRNLVALGHQLYKPEVITQLEQEEQWMMGRVSPLDTHPENTEV

SEQ ID NO: 15335 - protein, 81 aa, Bos mutus
VTFKDVAVDFSMEEWELLDPGQRKLYRDVMLETCGNLASVELVLSRDSIGRHFYDYDLAIASLVSDPFLNHHQMGYPDQRP

SEQ ID NO: 15336 - protein, 81 aa, Neophocaena asiaeorientalis
AQLTFKDVAIEFSQEEWECLDPAQRALYRDVMLETYRNLVSLDISHVHVIKKLQLNANTDRAEVFQTLILGRHEKIKHFYL

SEQ ID NO: 15337 - protein, 81 aa, Nomascus leucogenys
ASAAVSVTFKHVTMAFTQKEWKQLDPAQRNLYNDVMLENYSNQASMAPKPDMISKLEKGEAPWLGKRKRPSQGCSSKIARY

SEQ ID NO: 15338 - protein, 81 aa, Nomascus leucogenys
DSVTFEDVAVDFTQEEWTLLDQTQRNLYRDVMLENYKNLVAVDWESRINTKWSAPQENFLQGKTSSVVEMERNHFGEELFD

SEQ ID NO: 15339 - protein, 81 aa, Nomascus leucogenys
PQASVCFEDVAMAFTQEEWEQLDLAQRTLYREVTLETWEHIVSLGLFLSKSDVISQLEQEEGLCRAEQVAPRGARPSKEQR

SEQ ID NO: 15340 - protein, 81 aa, Nomascus leucogenys
EMGLLTFRDVVIEFSLEEWQFLDHAKQNLYRDVMLENYRNLVSLGIAVSKPDLITCLEQNKEPWNIKRNEMVTKHPVTCSH

SEQ ID NO: 15341 - protein, 81 aa, Nomascus leucogenys
QLTFRDVAIEFSQEEWKCLNSTQRTLYRDVMLENYRNLVSLDLSRNCVIKELAPQWESNTGEVFHTVTLEQHEKHDIEEFC

SEQ ID NO: 15342 - protein, 81 aa, Nomascus leucogenys
PKVPVTFDDVAVYFSELEWGKLEDWQKELYKHVMRGNYETLVSLDYAISKPDILTRLERGEEPCPDRWGQEKGNEVEVGHP

SEQ ID NO: 15343 - protein, 81 aa, Nomascus leucogenys
SQSLLTFRDVAIEFSQEEWKCLDPAQRTLYRDVMLENYRNLVSLGSCCVVEVGLDLLGSRHPPWPPKKLGLQAPTPVPNYW

SEQ ID NO: 15344 - protein, 81 aa, Bos indicus
ELVTFRDVVISFSQEEWEYLDSAQRDLYWDVMMENYSNLVSLDLESKYDTKTLSVDKVILEKNNSQWEVIENSKLVGLQNS

SEQ ID NO: 15345 - protein, 81 aa, Bos indicus
MMKSQISFEDVAVNFTLEEWQLLNPTQKTLYRDVMLENYSNLVLLGYQVIKPEMIFKLEQENPWLLDEEILSQNFSEKVWL

SEQ ID NO: 15346 - protein, 81 aa, Bos indicus
AQVVVTFKDVAVTFTREEWGQLDLGQRTLFREVMLETCGLLVSLGHPIPKPELIHLLEHGQKLWTGTRGLPHSTSPGDRPK

SEQ ID NO: 15347 - protein, 81 aa, Bos indicus
MDSVVFEDVAVNFTLEEWALLDPGQRKLYRDVMLETCRNLASVVKTRSSTQCDILKNELCSEEKKVRFPRNDSWSVFGENW

SEQ ID NO: 15348 - protein, 81 aa, Canis lupus
NQESLTFDDVAVDFTWEEWQLLAPAQKDLYWDMMLENYRNLVSVGFHTSKPDVLSKLDQGEPTWTVENEIPCRTRSEIWKL

SEQ ID NO: 15349 - protein, 81 aa, Muntiacus muntjak
RVSPVTFEDVAVYFSQEEWRLLGEAQKFLYRDVMLETFALVLSLGCCHTAEDEQTPSEQNFSVEVPQRNTKKTDLSSQKIC

SEQ ID NO: 15350 - protein, 81 aa, Muntiacus muntjak
TLSDLVSFKAVTVVFTWEEWQLLDSLQKNLYQDVMLENYINLESVGYHVTKAHAFYQLQQEAPWITGKNPEDWHEVNHGNL

SEQ ID NO: 15351 - protein, 81 aa, Canis lupus
MLENYSHLVSLGLNISKPYVVSLLEQGKGPWLEKGDVRRDLFSESHGEIKEFSPNNVICEDDSSQYLVVERILNQDPDHSS

SEQ ID NO: 15352 - protein, 81 aa, Gorilla gorilla
VHGSVTFRDVAIDFSQEEWECLQPDQRTLYRDVMLENYSHLISLGSCISKPDVVTLLEQEKEPWIVVSKETSRWYPDLESK

SEQ ID NO: 15353 - protein, 81 aa, Gorilla gorilla
VAFEDVAVNFTQEEWALLDISQRKLYREVMLETFRNLTSEGKKWKDQNIEYEYQNPRRNFRSLIEEKVNEIKEDSHCGETF

SEQ ID NO: 15354 - protein, 81 aa, Ailuropoda melanoleuca
QGSVLFEDISVDFTQKEWQLLNPAQRLLYKEVMLENYRQLVSLGHCVTKPELVLKLEQGEEPWAPKRELPSQSRPEIQKAN

SEQ ID NO: 15355 - protein, 81 aa, Gorilla gorilla
MLENYGNVASLGFPLLKPAVISQLEGGGELGGPSPLAAGTGLQGLQTVDIQTDNDLTKEMYEGKENVSFELQRDFSQETDF

SEQ ID NO: 15356 - protein, 81 aa, Ailuropoda melanoleuca
QGCVTFEDVFVYFSREEWELLEEAQRVLYRDVMLENFALVSSLGRWRVTDDEETPSEQSISVGVSRLRTPESGAFIQKAHP

SEQ ID NO: 15357 - protein, 81 aa, Gorilla gorilla
AQEPVTFRDVAIYFSREEWACLEPSQRALYRDVMLDNFSSVAALGFCSPRPDLVSRLEQWEEPWVEDWERPELQAVQRGPR

SEQ ID NO: 15358 - protein, 81 aa, Ailuropoda melanoleuca
IAASEILCNHLVMFRDVAVDFSQEEWECLNSYQRNLYRDVILENYSNLVSVAGCSISKPDVITLLEQGKEPWMVVRDERRR

SEQ ID NO: 15359 - protein, 81 aa, Ailuropoda melanoleuca
QVTFDDVAVDFTQEEWGLLGPAQRTLYHDVMLETLRHLVTVEWEKRPKSQQLPPTEAFSGKELPSSMNLTRSAVDDCWHST

SEQ ID NO: 15360 - protein, 81 aa, Ailuropoda melanoleuca
MFKEAVTFKDVAVAFTEEELGLLDSSQRKLYQDVMLENFRNLVSVGHQPFKRDKWHIEREERLWLMKTATQIERNVGGNNQ

SEQ ID NO: 15361 - protein, 81 aa, Ailuropoda melanoleuca
KKNKSQGSISFEDVTVNFTQEEWGQLDPDQRALYRDVMLENYSIFISLGHCITKPGEILKLEQEAPWVLEKECASQCHPDE

SEQ ID NO: 15362 - protein, 81 aa, Neophocaena asiaeorientalis
WLTFKDVVIEFSQEEWECLDPAQRALYRDVMLETYRNLISVDICPIHVVKQLQPKGNSDPGEVFQRVILGRSKSHEIKHFY

SEQ ID NO: 15363 - protein, 81 aa, Neophocaena asiaeorientalis
EMDSVTIEDVAVDFTLEEWALLGPSQRKLYRDVMQETLRNLAAVGAKREYHDIEDQYKNQGRKLRTFMVERFCKSKDISLC

SEQ ID NO: 15364 - protein, 81 aa, Neophocaena asiaeorientalis
EGSVTFEDVAVNFSLEEWGLLDEAQRCLYHDVMLENLALTTSPGCWHGEEDEEALSEQTISDQGSSQIRIVKAGLSPQKAN

SEQ ID NO: 15365 - protein, 81 aa, Neophocaena asiaeorientalis
SQGLLSFNDVAVDFTWEEWQLLDIVQKNLYRDVMLENYSNLMSLGYQVTKPEPVMHLEKGEEKEKAVVEREFPSQCGPERP

SEQ ID NO: 15366 - protein, 81 aa, Neophocaena asiaeorientalis
SQGPVSFEDVAVDFTQEEWQQLDPAQRTLYRDVMLENYSHLVSVGYPVSKPGVISKLEQGEEPWIMKRDISNWIYPDRETR

SEQ ID NO: 15367 - protein, 81 aa, Neophocaena asiaeorientalis
MFQVTFSDVAIDFSHEEWGWLDPTQRNLYKDVMVQNYENLVSLAGLSIPKPYVIALLEDGKEPWMVEKKLSKSLFPDWKSR

SEQ ID NO: 15368 - protein, 81 aa, Bos mutus
KSWGPLSFMDVFVDFTWEEWQLLDSAQKHLYRSVMLENFRNLVSLGYQYTKPSIIFQLEQEELWMMHSPSQGHSDEVWEID

SEQ ID NO: 15369 - protein, 81 aa, Bos mutus
LTIEDVDIKFTPEDWECLDPAQRALYRDVMVETYRNLLSVGEDHFPVKLDSDVSRIDMTMKLQAKGNSGKGEIFQRVIFGR

SEQ ID NO: 15370 - protein, 81 aa, Nomascus leucogenys
MIQAQVMMENYSNLVAVGYQPSKPDALFKLEQGEQPWTTEDGIHSGACSDIWKVDDHVLERLQSESLVDRRKRCHEHDAFE

SEQ ID NO: 15371 - protein, 81 aa, Nomascus leucogenys
SVAFEDVAVTFTQEEWALLDPSQKNLYRDVMQETFKNLASIGKKWKAQNIYVEYKNLRRNLRIVGERLFESKEGHQHGEIL

SEQ ID NO: 15372 - protein, 81 aa, Nomascus leucogenys
FQEMVTFKDVAVVFTEEELELLDSVQRKLYRDVMLENFRNLLLVAHQPFKPDLISQLEREEKLLMVETEAPRDGCSGRKNQ

SEQ ID NO: 15373 - protein, 81 aa, Bos indicus
EELPVVFEDVAVYFTREEWGALDKWQKELYRDVMQMNYELLASLGPAAAKPDLISKLERRAAPWIRDPHGPKLGKGRPPPG

SEQ ID NO: 15374 - protein, 81 aa, Canis lupus
SQGPVSFRDVAVDFTQEEWQQLEPNEKTIYRDVMLENYSHLVSVGYDSTKPKVILKLEQGEEPWVAEGELPCQSHLEVWKV

SEQ ID NO: 15375 - protein, 81 aa, Canis lupus
SRTLVTFKDILVNFTREEWKLLDSSQQIMYKDVMLENYKNLISLGHQLPKPDVILQLEKGEEPWLVERVIHRETHPDLETA

SEQ ID NO: 15376 - protein, 81 aa, Muntiacus muntjak
PVTFDDVAVYFSQEEWRLLGEAQRLLYHDVMLENFTLVASLGCWHTAENVSVEVPQRNTKKTDLSSQKICPWEMGNLALEG

SEQ ID NO: 15377 - protein, 81 aa, Ailuropoda melanoleuca
RPRAVKFADVAVYFSPEEWGCLRPAQRALYRDVMRETYGHLGALGCAGPKPALISWLERNTDEWEPAALDPRECPRGVTVQ

SEQ ID NO: 15378 - protein, 81 aa, Ailuropoda melanoleuca
AVTFKDVAVVFTEEELGLLDPAQRKLYGDVMLENFRNLISVRDRHQKEMETLHEAGIRCLSLGELSCWQIKRHVVSKLTKN

SEQ ID NO: 15379 - protein, 81 aa, Ailuropoda melanoleuca
VTFEDVAVDFTKEEWALLDTSQRKLFRDVMLENIRHLVSLGYQHCKSDVIFQLEQGEELWREGPGFLRGPSPGQESALKEQ

SEQ ID NO: 15380 - protein, 81 aa, Ailuropoda melanoleuca
QGLVTFRDVAIEFSQEEWKCLEPAQRDLYRDVTLENFSNLVSLGLSISKPDVISLLEQGREPWMITNDMTGPWCPGERGVI

SEQ ID NO: 15381 - protein, 81 aa, Gorilla gorilla
AQTLLTFRDVAIEFSLEEWKCLDLAQQNLYRDVMLENYRNLFSVGLTVSKPGLITCLEQRKEPWNVKRQEAADGHPAMSSC

SEQ ID NO: 15382 - protein, 81 aa, Ailuropoda melanoleuca
VLLTFRDVAIEFSPEEWECLDPAQRALYRDVMLENYRNLVSLGEDNVPLNLSDISVRSMIKELSPKEDINKEELFQTLMLE

SEQ ID NO: 15383 - protein, 81 aa, Nomascus leucogenys
VALEDVAVNFTREEWALLGPCQKNLYKDVMQETIRNLDCVGMKWKDQNIEDQYRYPRKNLRCRMLERFVVSKGGSQCGETS

SEQ ID NO: 15384 - protein, 81 aa, Nomascus leucogenys
PQGHLTFRDVAIEFSQAEWKCLDPAQRALYKDVMLENYRNLVSLGISLPDLNINSVLEQRREPWSGQSEVKIAKNSDGRER

SEQ ID NO: 15385 - protein, 81 aa, Bos indicus
SQGPVTFEDVAVYFSQEEWRLIDEVQRLLYHDVMLENAALVASLGCWHAAEDEQTPSEQNVSVEVPQRNTKKTDLSSQKVC

SEQ ID NO: 15386 - protein, 81 aa, Bos indicus
SQAPVTFEDMAMYLTREEWRPLDPTQRDIYRDVMQENYGNVVSLDFEIRSENEVNPKQEISEDVEFETASERPVGNTEENP

SEQ ID NO: 15387 - protein, 81 aa, Bos indicus
AQGPVTFEDVAVYFSLEEWGLLNLTQKSLYRDVMLENFGLIGSLGFAPSRSSKVAQMEGEGEAWVPNMVDSVVSRAEARKG

SEQ ID NO: 15388 - protein, 81 aa, Bos indicus
QEQLTFEDVAIDFSLEEWECLDPAQRALYRDVMVETYRNLFSLVVPQFLQRESKVFVKIHNSHHLAPVNWSLLEFEEHNVG

SEQ ID NO: 15389 - protein, 81 aa, Canis lupus
APALVSFKDVAVTFTGEEWRHLDLAQRTLYREVMLETCGLLVSLGHPVPKPELIYLLEHGQELWSVNRGLSKSTHTGEKAK

SEQ ID NO: 15390 - protein, 81 aa, Muntiacus muntjak
MGWLTFQDVVIGFTQEEWECLDLSQRDLYREVMLENYRNLASLGFVVSGLNLVTFLEQLNDPRSIRRIETTAIYPLHDAYS

SEQ ID NO: 15391 - protein, 81 aa, Muntiacus muntjak
PKVPVTFDDVAVYFSELEWGKLDEWQKELYKHVMRGNYEMLVSLDYAISKPDILTRMERGEEPCPEGPWGQEEGNEREEAC

SEQ ID NO: 15392 - protein, 81 aa, Muntiacus muntjak
GSVSFTDVTVDFTQEEWEQLDPSQRILYMDVMLENYSNLLSVEVWKADDQMEADHRSPDEQARPFVIFKDQTTIEERDNNL

SEQ ID NO: 15393 - protein, 81 aa, Muntiacus muntjak
EQVSFKDVCVDFTQEEWYLLDPAQKILYRDVILENYSHLVSVGNCTTKPEVVFKIEQGEEPWILEERCPKRCRSEDWKVDD

SEQ ID NO: 15394 - protein, 81 aa, Muntiacus muntjak
MLENYVNITSLAFPLPKPDLIFWLERGEEPGHLDPWTLVGGEDLRGICRGGKAKTENRGQTTELSISKGPESHKLITEVPL

SEQ ID NO: 15395 - protein, 81 aa, Gorilla gorilla
VAFKDVAVNFTQEEWALLDISQRKLYREVMLETFRNLTSIGKSWKDQNIEYEYQNPRRNFRSLIEEKVNEIKDDSHCGETF

SEQ ID NO: 15396 - protein, 81 aa, Ailuropoda melanoleuca
SRSLENDGVCFSEQEWENLEDWQKELYRNVMKSNYETLVSLKVLGQPEGEAELGAGMLGDLEEEGPGDVHPAEGVMIKQEI

SEQ ID NO: 15397 - protein, 81 aa, Gorilla gorilla
KVPVTFVDIAVYFSEDEWKNLDEWQKELYNNLVKENYKTLISLDAEGSVPKPDAPVQAEPREEPCVWEQRHPEEREIPMDP

SEQ ID NO: 15398 - protein, 81 aa, Ailuropoda melanoleuca
LQEQVSFKDVCVDFTQEEWYLLDPAQKILYRDVILENYSHFVSVGYCITKPEVVFKIEQGEEPWILEAGFPSHCNQEDWKV

SEQ ID NO: 15399 - protein, 81 aa, Ailuropoda melanoleuca
KMGPVTFKDVIVEFSREEWQLLNAAQRTLYREVMQENCGLLISVGYRVNKPNAVFKLKQGKEPWILEVEFPHRNYPGENGE

SEQ ID NO: 15400 - protein, 81 aa, Ailuropoda melanoleuca
ELGLLTFRDVAIEFSQEEWRCLSHTQWELYRDVLLENYGHLLFSGLIVSKPDLVSFLEQTKELWDVKRWKTIVFDPVQCGS

SEQ ID NO: 15401 - protein, 81 aa, Gorilla gorilla
QVTFSDVAIDFSHEEWGWLNSAQRDLYKDVMVQNYENLVSVAGLSVTKPYVITLLEDGKEPWMMEKKLSKAISVITPASSV

SEQ ID NO: 15402 - protein, 81 aa, Gorilla gorilla
PQGLLTFSDVAIEFSQEEWKCLDPAQRTLYRDVMLENYRNLVSLEFRSVTQAKVQWCHLSSLQPPLPRFKQFSCLSLPSSW

SEQ ID NO: 15403 - protein, 81 aa, Ailuropoda melanoleuca
VTFEDVTVIFTWEEWKFLDSSQKKLYREVMWENYTNVMSVGKKIEQDISQDTITSQIQISTHNQFCVVLNLFSLQDSNWRL

SEQ ID NO: 15404 - protein, 81 aa, Ailuropoda melanoleuca
SLESVTFKDVAIDLTQEEWTLMDRSQRKLYIDVMLENITHLVSVGCQFFQSDVISQWEQGGELWREDRGFAQGWNPGLENS

SEQ ID NO: 15405 - protein, 81 aa, Ailuropoda melanoleuca
KQGLLTFGDVAIEFSQEEWRCLSHMQRELYRDVMLENYGHLLFLGLIVSNPDLVIFLEQKRELWDVRRKETVYIHPGRNPR

SEQ ID NO: 15406 - protein, 81 aa, Lynx canadensis
RCLTNYSHDLVILEDVAVEFTQEEWTLLDPTQRNLYRDVMLENHKNLVAVDWEICLNTKWSAPQQNILQGKTPNVEMNSRQ

SEQ ID NO: 15407 - protein, 81 aa, Lynx canadensis
AAGSVTFKDVTMAFTQKEWEQLDPAQRNLYKDVMLENYSNLASMGYQAPKPDMISKLEKGEEPWLGKGKKPRQGGPSEIAR

SEQ ID NO: 15408 - protein, 81 aa, Nomascus leucogenys
PQASVCFEDVAMAFTQEEWEQLDLAQRTLYREVTLETWEHIVSLGLFLSKSDVISQLEQEEGLCRAEQVAPREKGMLPGTF

SEQ ID NO: 15409 - protein, 81 aa, Nomascus leucogenys
EMGVLTFRDVAIEFSLEEWQCLDITQQNLYRNVMLENYRNLVFVGIAASKPDLITCLEQGKEPWNVKRHEMVAEPPVVCSY

SEQ ID NO: 15410 - protein, 81 aa, Bos indicus
AQEILSFKDVAVEFTWEEWQLLTPAQKTLYRDVMLENYSNLVSVGYRVSKSDVLFKLEQGEERWMTEDEIHSHTWPETGNI

SEQ ID NO: 15411 - protein, 81 aa, Muntiacus muntjak
LQGLMTFEDVAVDFTQEEWQYLNPPQRTLYRDVMLETYSNLVSVGHHITKPDLILKLEVEERCLLEGKIPTWSFPDMGPQT

SEQ ID NO: 15412 - protein, 81 aa, Muntiacus muntjak
QAEVTFEDVAVLLSQEEWGLLGPSQKGLYREVMLETYRNLLSLGAGLADPKPEVIVQLERGDELWVLDMHGAEQPSVDGSA

SEQ ID NO: 15413 - protein, 81 aa, Muntiacus muntjak
QILESLTFQDVAVDFTREEWDQLYPAQKNLYRDVMLENYRNLVALGHQLYKPEVITQLEQEERWMMGRVSPPDTHPDGENR

SEQ ID NO: 15414 - protein, 81 aa, Muntiacus muntjak
TFRDVAFHFSQQEWECLNPVQKNLYQDVMMKNYDNLVSLGHSISKPDVISLLEQGKEPWMVVGEETRRWCTVEACELLVKA

SEQ ID NO: 15415 - protein, 81 aa, Canis lupus
AHQLMVFRDVAIDFSQEEWECLDLEQRHLYRDVMLENYSNMILLGLCIYQPDVFSLLEKGKEPWMVLQDETRGPCPDMQSS

SEQ ID NO: 15416 - protein, 81 aa, Canis lupus
RPQVTYEFLSVDYTERKWKGPAVGQRAVYRSIMPGNYCSVASLGDTRMRCSELPVKLAVSKGPESSDGTSRGLCAVVSGEP

SEQ ID NO: 15417 - protein, 81 aa, Muntiacus muntjak
PQDLMTFEDVAVEFTWWEWGQLDPAQKDLYREVMLENFKNLASLDWERRPQAKEAMLSQGLSKEELLQRASEEKHLRDELR

SEQ ID NO: 15418 - protein, 81 aa, Muntiacus muntjak
VSFEDVTVDFSQEEWQHLDPVQRCLYRDVTLETYSHLCAVGYQVPKPEVIFRLEQGEESWTLEKETPHHSCSDEDIGQTQQ

SEQ ID NO: 15419 - protein, 81 aa, Canis lupus
WQKSLKFKDVAVKFSKDEWKQLVPAQRALYREVMLENYQDFVSLGLLVPKPDVIFQLKRGEEPWNFDFQEDEEREVPANTF

SEQ ID NO: 15420 - protein, 81 aa, Gorilla gorilla
ELLTFRDVAIEFSPEEWKCLDPAQQNLYRDVMLENYRNLVSLAVYSYYNQGILPEQGIEDSFKKATLGRYGSCGLENICLW

SEQ ID NO: 15421 - protein, 81 aa, Ailuropoda melanoleuca
PGGHCEFEDVAVYFSWEEWGLLDEAQRCLYHDVMLENLALITSLGCWCGVEDKAVSSEQCVSARVLSPKAGMSPQKAHFCE

SEQ ID NO: 15422 - protein, 81 aa, Gorilla gorilla
KSMVTFEDVAVYFSQEEWELLDAAQRHLYHSVMLENLELVTSLGCWHGVEGEEAHPEQNVSVEVLQVRIPNADPSTKKANS

SEQ ID NO: 15423 - protein, 81 aa, Gorilla gorilla
MAFTQLTFRDVAIEFSQDEWKCLNSTQRTLYRDVMLENYRNLVSLEYYPMWEHRKEPWTIESQVQIARKPKGWEWIKGVKT

SEQ ID NO: 15424 - protein, 81 aa, Gorilla gorilla
RVTFKDVAVVFTKEELALLDKAQINLYQDVMLENFRNLMSVRDGIKNNILNLQAKGLSYLSQEVLHCWQIWKQRIRDLTVS

SEQ ID NO: 15425 - protein, 81 aa, Gorilla gorilla
MALVTFRDVAIDFSQKEWECLDTTQRKLYRDVMLENYNNLVSLGYSGSKPDVITLLEQGKEPCVAARDVTGRQCPGLLSRH

SEQ ID NO: 15426 - protein, 81 aa, Gorilla gorilla
MLENYRILVSLGLCFSKPSVILLLEQGKAPWMVKRELTKGLCSGWEPICETEELTPKQDFYEEHQSQKIIETLTSYNLEYS

SEQ ID NO: 15427 - protein, 81 aa, Ailuropoda melanoleuca
FQESVKLRDVAVIFSPDQWAYLSSEEKQLYKDVMLESCDYLVSLGHWTYKAEVISALREGEDLWMVENEVTSAPCPGSSLS

SEQ ID NO: 15428 - protein, 81 aa, Lynx canadensis
FTLLTFRDVAIEFSQEEWGCLNHSQRELYRDVMLETYGHLLFLACFDYLSPLPLPLHCLHDLSLTVSSQCTQNFLPKPCLE

SEQ ID NO: 15429 - protein, 81 aa, Lynx canadensis
SQVLLTFRDVTIDFSQEEWECLDPAQRALYREVMLENYRNLVSLGVDKVRPDVGICPNISVRSVIKELSTKEDINKEELFQ

SEQ ID NO: 15430 - protein, 81 aa, Lynx canadensis
MLENYRNLVSVGHQASKPDVLAKLERGEEPWAIEEEVRSGTSPETGKVDNHLQGHWEDERMLKGMELYPEYNAFGNIVPQS

SEQ ID NO: 15431 - protein, 81 aa, Lynx canadensis
LLQESLTLEDVAVDFTQEEWRLLAPAQKDLYRDVMLENFRNLVSVGYVASMPAALSRLERGGRWMTEDETRRGICPEIKKD

SEQ ID NO: 15432 - protein, 81 aa, Lynx canadensis
LPHSVTFEDVAVEFTQEEWALLDPSQRTLYRDVMQENCRNLASLGNQVGKPGVVSKLEQKDKVVTKETGILPGSFPGERQL

SEQ ID NO: 15433 - protein, 81 aa, Lynx canadensis
APGLLTFRDVAIEFSQEEWGFLNQSQRELYRDVMLETYGHLLFLGLIVSKPHLVIFLEQKRELWDVKRKKTVASPTQWVRD

SEQ ID NO: 15434 - protein, 81 aa, Lynx canadensis
PCEVSVSFEDVTMDFSREEWEQLGPAQRCLYWDVMLEICSHLLSLGTLIRPEMIFRMEKEQESWIREAQLPHQWRPEGEFG

SEQ ID NO: 15435 - protein, 81 aa, Neophocaena asiaeorientalis
LQEPVTFRDVAVDFTQEEWGQLGPAQRTLYRDVMLETFGHLLSVGPELPKPEVISQLEQGAELWVAERGISQGRCPGWESG

SEQ ID NO: 15436 - protein, 81 aa, Nomascus leucogenys
VTFKDVAVVFSREELRLLDLTQRKLYRDVMVENFKNLVAVGFLPWPKLFTALISKYCLFFLIGSKHQNKMETLQKFALKYL

SEQ ID NO: 15437 - protein, 81 aa, Bos mutus
TQLTVEDVDIKFTPEEWECLDPAQRALYQDVMVETYKNLLSVDVSRIHMTMKLQAKGNNGKGEIFQRVMFGRAKTHEIKDY

SEQ ID NO: 15438 - protein, 81 aa, Nomascus leucogenys
GPVTFEDVAVLFTEAEWKRLSLEQRNLYKEVMLENLRNLVLLESKPEVHTCSSCPLAFGSQQFLSQDELHNHPIPGFHAGN

SEQ ID NO: 15439 - protein, 81 aa, Nomascus leucogenys
KERPVSFQDLTVNFTQEEWQQLDPAQRLLYRDVMLENYSNLVSVGYHVSKPDVIFKLEQGEEPWIMEKFSNQNYPEVDDAL

SEQ ID NO: 15440 - protein, 81 aa, Nomascus leucogenys
AAVILPPTGLVTFEDFTQEEWALLDPAQRTLLRQENCLNPGGGGNQVDKPSLISQLEQEDKVMTEERGILSGTCPGEHQER

SEQ ID NO: 15441 - protein, 81 aa, Nomascus leucogenys
EMGLLTFRDVAIEFSLVEWQCLDRAQQNLYRDVMLENYRNLVSLGIAVSKPDLITRLEQNKEPWNIKRNEMLAKHPVMCSH

SEQ ID NO: 15442 - protein, 81 aa, Nomascus leucogenys
TVTFEDVAVNFSQEEWCLLSEAQRCLYRDVMLENLALISSLGCWCGSKDEEAPCKQIISVQRESQSRTPRAGVSPKKAHPC

SEQ ID NO: 15443 - protein, 81 aa, Nomascus leucogenys
SQGLVTFGDVAIDFSQEEWEWLNPIQRNLYRKVMLENYRNLASLGLCVSKPDVISSLEQGKEPWTVKRKMTRAWCPDLKAV

SEQ ID NO: 15444 - protein, 81 aa, Nomascus leucogenys
PLTFRDVAIEFSQEEWKSLDPVQKALYWDVMLENYRNLVFLGILPKCMTKELPPVGNSNTGEKFQTVMLERHECYDVENFY

SEQ ID NO: 15445 - protein, 81 aa, Nomascus leucogenys
GSLTFRDVAIELSLEEWQCLDTAQQNLYRNVMLENYRNLVFLGIAAFKPDLIIFLEQGKEPWNMKRHEMVEEPPGMVGSSG

SEQ ID NO: 15446 - protein, 81 aa, Nomascus leucogenys
VTFEDVAVYFIRKEWKRLEPAQRDLYRDVMLENYGNVFSLDWIHVSLTTQKVMLAWLTGTLSVGKGLCSSELESVELPDTF

SEQ ID NO: 15447 - protein, 81 aa, Bos indicus
FQGSLSFEDVTVGATQEEWQKLDPAQRTLYRDVMLENYSHLISVGYCIPKPELIFKLEQGEHPWVLEAESPSQSYPVCRIV

SEQ ID NO: 15448 - protein, 81 aa, Bos indicus
QESVTFKDVAVDFTLEEWGRLGPGQRELYRDVMLENYQNLLSLGAGFPGAKPDVISRLERGEEPRTERRETQQVTCPDLET

SEQ ID NO: 15449 - protein, 81 aa, Bos indicus
PLESVTFGDVAADFTQEEWALLDKSQKNLFRNVMLETVTHLVSVGYQISKSDVVFQLEQGKELWTQAAGGFQGQSPGSEAL

SEQ ID NO: 15450 - protein, 81 aa, Canis lupus
FQGSVTFQDVAVDFTPDEWQLLDCDQRTLYWDVMLENFRNLISVGDPVTKTKVIFKAEQGQEPWMAEREQPCWHYPEADYM

SEQ ID NO: 15451 - protein, 81 aa, Muntiacus muntjak
QAQETLTFDDVAVAFTWEEWQLLAPAQKVLYRDVMLENHSNLVSVGFQASTPEVLSKLDQGEPWTMDDEVHCRTRSEVWKV

SEQ ID NO: 15452 - protein, 81 aa, Muntiacus muntjak
ECLDLGQRELYRDVMLENYGNLACLGLHHLLKHTCSLKGNVENRESHLVSTANTHSNLYSEHRCLLNIHSNISGNQKLKHE

SEQ ID NO: 15453 - protein, 81 aa, Muntiacus muntjak
RSGSVTFEDVAVNFSWEEWGLLDESQKHLYHDVMLENLALISSLGCWPGEEDKEAFSEQSISDQGCSQMRIAKADLSPQKA

SEQ ID NO: 15454 - protein, 81 aa, Muntiacus muntjak
RAETLSFKDVAVDFTWEEWQLLAPAQKTLYRDVMLENYSNLVSMGYQVSKSDVLSKFEQGEEQWMTEDEIHSHTWPETGSV

SEQ ID NO: 15455 - protein, 81 aa, Muntiacus muntjak
MGRLMFQDVAIDFTQEEWECLDLGQRDLYRDVLLETYGNLASLGLVVSKPDLITFLEQMKNPWGVRRTDTTATYPVWNIFH

SEQ ID NO: 15456 - protein, 81 aa, Canis lupus
PLTSLTFEDVAVRFSSPEWRCLNRMQRLLYTDVMLENYRNMLAVGSAFPKPPLISQLEQGAEPCLPDQGFLSCFPVSPDKS

SEQ ID NO: 15457 - protein, 81 aa, Muntiacus muntjak
WLQGPMSFKDVAVEFTQEEWMMLDSAQRSMYRDVMLENYINLTLVEYQLCKPVISLLGQEDIRTVKSRIPQGTCPDWEIQL

SEQ ID NO: 15458 - protein, 81 aa, Gorilla gorilla
AQESITLEDVAVDFTWEEWQLLGAAQKDLYRDVMLENYSNLVAVGYQASKPDALFKLEQGEQPWTIEDGIHSGACSDIWKV

SEQ ID NO: 15459 - protein, 81 aa, Ailuropoda melanoleuca
FQESVTFEDVAVDFTQEEWALLDRSQRRLFRDVMLENISHLVSIVMYVYIPSLVQQKKKKKRPWRLGGTVRICLSFSLPLP

SEQ ID NO: 15460 - protein, 81 aa, Gorilla gorilla
GWLTNYSQDSVTFEDVAVDFTQEEWTLLDQTQRNLYRDVMLENYKNLVAVDWESHINTKWSAPQQNFLQGKTSSVVEMNSE

SEQ ID NO: 15461 - protein, 81 aa, Ailuropoda melanoleuca
AQESVTFRDVAVFFSQDEWLRLDSAQRTLYREVMLENYGTLVSLGILFSKPKVIFQLQQGEDPWMAENGVSQGPCVGWERL

SEQ ID NO: 15462 - protein, 81 aa, Ailuropoda melanoleuca
YKELVTFKDVVVDFSPEELTYLSAAQKNLYREVMLENYRNLVSLGYQFSKPDIISQLEEEESRVREEDSNAEICQGESSPN

SEQ ID NO: 15463 - protein, 81 aa, Ailuropoda melanoleuca
TARSQASVTFKDVAMDFTPEEWGKLDPTQREVMLENYRNLVSLWLPVSRPENYNLENGKEPLMLERKAPKSSCSDLETKPE

SEQ ID NO: 15464 - protein, 81 aa, Ailuropoda melanoleuca
SDEAFSFEDLSVDFTQKEWQLLNPGQKDLYKDVMLENYSSLVSLGYEIMKPDVIFKLEQGEEPWIGDGEVPSSGCPADMSY

SEQ ID NO: 15465 - protein, 81 aa, Gorilla gorilla
FQESVTFQDVAVDFTAEEWQLLDCAERTLYWDVMLENYRNLISVGCPITKTKVILKVEQGQEPWMVEGVNPHESSPESRSV

SEQ ID NO: 15466 - protein, 81 aa, Ailuropoda melanoleuca
LQGSVSFKDVTVDFTQEEWQHLDPAQKALYRDVMLENYCHLISVGLHMTKPDMIRKLEQGEELWTTERMFPSQSYLEEDGK

SEQ ID NO: 15467 - protein, 81 aa, Sus scrofa
VQESVTFKDVAVLFTQDEWAQLSPAQRALYRDVMLENYSHLVSLGLLGPKPDMFSQLGKGEEWMLEDSLGGFCLDWMTMPV

SEQ ID NO: 15468 - protein, 81 aa, Sus scrofa
ALESVTFRDVAVFFSQDEWLCLDSAQRTLYREVMLENYSTLFSLGILFSKPKVIFQLEQGEDPWMVENEVSQSTCLGWESL

SEQ ID NO: 15469 - protein, 81 aa, Sus scrofa
LRGLLTFEDVAIDFSPEEWECLDLGQRHLYRDVMLEICRHLVSLEYVISKPDLVRLLEQKTDPWDVKGMETGSSIFNQQIF

SEQ ID NO: 15470 - protein, 81 aa, Nomascus leucogenys
PQGSLTFRDVAVEFSQEEWKSLDPVQKALYRDVMLENYRNLGFLGLCLPDLNIISMLEQGKEPWTVVSQVKIAKNPNCGEC

SEQ ID NO: 15471 - protein, 81 aa, Nomascus leucogenys
VAFEDVDVNFTQDEWALLDPSQKNLYRDVMQETFRNLASVGKWKDQKIEDEYKNPRRNLRGLMGERLLEGKKDHQHGEILA

SEQ ID NO: 15472 - protein, 81 aa, Bos indicus
MVQNYENLVSLAGLSIPKPYVIALLEDGKEPCMVEEKLSKDTFPDCKTRWENKELSMKEDIYDEDLPQMVLKEKTIQQNHE

SEQ ID NO: 15473 - protein, 81 aa, Bos indicus
AQESVMFSDVSIDFSQEEWEFLNDDQRDLYRDVMLENYSNLVSMAGHSISKPDVISFLEQGKEPWLVDRELTRDQWPVLES

SEQ ID NO: 15474 - protein, 81 aa, Bos indicus
RESGKAPVTFDDITVYLLQEEWVLLSQQQKDICGSDKLVAPLGSTIASPELFYKFEQGPEPWLASVQGQRSHLSPNPGKTK

SEQ ID NO: 15475 - protein, 81 aa, Bos indicus
VFQGRMTFQDVAIDFTQEKWECLDLDQRELYRDVMLQNYGNLASLGLVSTLDLVAFLEQLKDPRNTRMETTTIYPGAVVAE

SEQ ID NO: 15476 - protein, 81 aa, Bos indicus
MITLQEEWQHLDPAQRMLYRDVMLENYSHLISVELINNSRKKFDFNKGRKWSHDDKHERIHYGEKSYEYNKNENGLCLNED

SEQ ID NO: 15477 - protein, 81 aa, Bos indicus
MVQNYENLVSLGLSIPKPYVIALLEDGKEPCMVEEKLSKDTFPDCKTRWENKELSMKEDIYDEDLPQMVLKEKTIQQNHEF

SEQ ID NO: 15478 - protein, 81 aa, Bos indicus
ERLTCEDVAIEFTHEEWVFLDPAQRALYRDVMLETYRNLLSVDISPTHVIKHLQLEANSDKLETFQTLMLGRPESCEIKHF

SEQ ID NO: 15479 - protein, 81 aa, Canis lupus
VPVTMTFDDVALYFSEQEWEILEKWQKEMYQQVMKNNYETLDSLGRVFSKPDLIIWIEQGRMLLIRDQGPLEKRMACSPST

SEQ ID NO: 15480 - protein, 81 aa, Canis lupus
KSQGFVSFKDVTVDFTWEEWQQLDCAQRNLYRDVMLENYSNLVSVGCQYLKSDVMLLNQGEPWMEEEEISSWAYSDFDIIT

SEQ ID NO: 15481 - protein, 81 aa, Canis lupus
SKGSMMFRDVSVNFSQEEWECLDSGQMNLYKEVMLENFSNLVSVGLSNSKPAVISLLEQGKEPWMVERELTRGLCSDLESM

SEQ ID NO: 15482 - protein, 81 aa, Canis lupus
ESVTFRDVAIDFSQEEWEWLQPAQRDLYRHVMLENYSHLVSLESHGEIKEFSPNNVICEDDSSQYLVVERILNQDPDHSSF

SEQ ID NO: 15483 - protein, 81 aa, Muntiacus muntjak
RGSVTFEDVAVYFSWEEWALLDEAQRCLYHDVMLENFALTSSLGCWHGVEDKGAPSEKSISVEGVSQIKTLKADSSPQKDR

SEQ ID NO: 15484 - protein, 81 aa, Muntiacus muntjak
LGLLTFEDVAVHFTQEEGARLDAGQRTLYRDVMLETYRILISLGEPFPPPHPQSPSELRWDLGGARLAVTLGPEVGHSAPR

SEQ ID NO: 15485 - protein, 81 aa, Muntiacus muntjak
SVNFEDVAVTFSWEEWGLLDESQRCLYRDVMLENLALITSLGCCHEVENEKTSFEQNVYFQRMSQIRTPKADLSSRKAHPC

SEQ ID NO: 15486 - protein, 81 aa, Canis lupus
MDSVVFEDVAVYFTPEEWALLDRGQRRLYRDVMLETCRNLAAVDCCTQVKPCGSRTQLNILESELSSEEKIVRFTRNDSWA

SEQ ID NO: 15487 - protein, 81 aa, Gorilla gorilla
SLKKVTFEDVAIDFTQEEWAMMDTSKRKLYRDVTLENISHLVSLGYQISKSYIILQLEQGKELWQEGREFLQDQNPDRESA

SEQ ID NO: 15488 - protein, 81 aa, Gorilla gorilla
VTLRDVVINFSQEEWEYLDSAQRNLYWDVMMENYSNLLSLDLESRNETKQLSVGKDIIQNTGSQWEVMESSKLCGLEGSIF

SEQ ID NO: 15489 - protein, 81 aa, Ailuropoda melanoleuca
QGLVTFRDVALDFSQEEWEWLDTSQKDLYRDVMLENYRNLVWLGLSISKPNMISLLEQGKEPWMVEKEMSDGQYADWESWY

SEQ ID NO: 15490 - protein, 81 aa, Gorilla gorilla
FQEPVTFEDVAVYFTQNEWASLHPTQRALYREVMLENYANVTSLSAFPFPKPDLIFQLEQGEAAWGPDPWTLAGGEALRGM

SEQ ID NO: 15491 - protein, 81 aa, Ailuropoda melanoleuca
MAFRDVAVDFSQEEWLLLSPAQRSLYREVMLENYSNLVSLGIPFSKPKLISQLEQGKETWREERACPPATCPAEPKPELHL

SEQ ID NO: 15492 - protein, 81 aa, Gorilla gorilla
CYQDSVTFDDVAVDFTQEEWTLLDSTQRSLYSDVMLENYKNLATVGGQIIKPSLISWLEQEESRTVQGGVLRGWEMRLETQ

SEQ ID NO: 15493 - protein, 81 aa, Ailuropoda melanoleuca
FGGSVTFRDVAIDFSQEEWEFLDSAQRDLYRDVMWENYSNFISLEPSISKPDVITLLDEGKEPWMVVKEGTRRHYSDLESR

SEQ ID NO: 15494 - protein, 81 aa, Gorilla gorilla
PQGLLTFRDVAIEFSQEEWKCLDPAQRTLYRDVMLENYRNLVSLDISSKCIMKEFSSIGKGNTEVIHTGTLQRLASHHIGE

SEQ ID NO: 15495 - protein, 81 aa, Gorilla gorilla
SQESLTFKDVFVDFTLEEWQQLDSAQKNLYRDVMLENYSHLVSVGYLVEKPDVIFRLGPGEESWMADGGTPVRTCAGTVLQ

SEQ ID NO: 15496 - protein, 81 aa, Ailuropoda melanoleuca
SQGLVTFEDVAVYFSLEEWERLDVDQRDLYKDVMQENYGILVSLGYPIPKPDLIFRLEQGEEPWVPDSPRPEEGDIVTGVY

SEQ ID NO: 15497 - protein, 81 aa, Gorilla gorilla
MGPLTFRDVAIEFSLKEWQCLDTAQRNLYRNVMLENYRNLVFLVTCSYFAQDLWPEQNIKNSFQKVIPRRYGKCGDENLPL

SEQ ID NO: 15498 - protein, 81 aa, Ailuropoda melanoleuca
PKVPVTFDDISIYFSTPEWEKLEEWQKELYKNIMKGNYESLISMDYAMNQPDVLSQIQPEGEHNTEEQTGPEESEIPADPS

SEQ ID NO: 15499 - protein, 81 aa, Gorilla gorilla
LLTFRDVAIEFSQEEWKCLDPAQRTLYRDVMLENYRNLVSLGIFSKCEIKELPPKKESNTGEIFQTVMLERHESRDIQDFC

SEQ ID NO: 15500 - protein, 81 aa, Gorilla gorilla
EMGLLTFRDVAIEFSPEEWQCLDTAQQNLYRNVMLENYRNLAFLGIALSKPDLITCLEQGKEPWNMKQHEMVDEPTDGVLL

SEQ ID NO: 15501 - protein, 81 aa, Lynx canadensis
SEGGVTFEDIAIYFSWKEWRLLDEAQRRLYYDVMLENFTLISSLGCCCGAEDAEAPLEQSVSVGVSQAGTPKAALSSRKTH

SEQ ID NO: 15502 - protein, 81 aa, Lynx canadensis
SQVSLTFEDVAVLFTRDEWRKLGPFQRNLYQDVMLENYSNLVSLGLLFSKPKVISLLQQGEDPWKVEKESPGGPSLGWKGS

SEQ ID NO: 15503 - protein, 81 aa, Bos indicus
DPDQVTFEDVVVDFTQEEWGHLEPAQRTLYRDVMLETFGLLVSVGHWLPKPDVISLLEQEAELWAADKGGPRAVCPDLETR

SEQ ID NO: 15504 - protein, 81 aa, Bos indicus
AQEPVTFNDVAVDFTQEEWGQLDLVQRTLYRDVMLETYGHLLSVGNQITKPEVISLLEQGEEPWSMEPAYPLQGTCPAPEI

SEQ ID NO: 15505 - protein, 81 aa, Bos indicus
HSEGRLTFQDVAIDFTQEEWECLDPGQRKLYRDVMVENYRNLASLGLVSKVDLVTFLELLKDPRNIRRMKTTAIYPAVSPQ

SEQ ID NO: 15506 - protein, 81 aa, Bos indicus
VFQGRMTFQDVAIDFTQEEWECLDLSQRELYRDVMLQNYGNLASLGLVSTLDLVAFLEQLKDPRNTRMETTTIYPAMSPQD

SEQ ID NO: 15507 - protein, 81 aa, Canis lupus
AEGHVTFEDVAVYFSWEEWGLLDEAQRLLYRDVMLENFSLMASLGLASSRTHEVSRLEWWREPFLPPCGVMTAAMPGGWWH

SEQ ID NO: 15508 - protein, 81 aa, Canis lupus
SLDSMTFTDVAIDFSQDEWEWLNLAQRILYKRVMLENYRNLVSLGLCISKPDIISLLEQGKEPWMMKGEMTRDLYPDLKYV

SEQ ID NO: 15509 - protein, 81 aa, Muntiacus muntjak
GLESVTFKDVAVDFTLEEWGRLGPGQRELYRDVMLENYQNLLSLGFPGAKPDVISRLEQGEEPRMERRETQQLTCPDLATS

SEQ ID NO: 15510 - protein, 81 aa, Muntiacus muntjak
PKVPVTFDDISIYFSTPEWEKLEEWQKELYKNIMKGNYESLISMDYAMNQPDVLSQIQPEGDRNTEDQAGPEESGIPSDPS

SEQ ID NO: 15511 - protein, 81 aa, Muntiacus muntjak
CQDPVTFEDVAIVFTDEEWRHLVPTQRDLYKEVMLENYKSIVSLGLPIPGPDVIFQLKRGDEPWLVEFHGFEGKEGAENVS

SEQ ID NO: 15512 - protein, 81 aa, Muntiacus muntjak
EPVTFEDVAVYFSQNQWASLDSAQRALYREVMLENYANVASLVSPFPRPDLISQLERGEAPWDPNPWEAEDLRGICPGGER

SEQ ID NO: 15513 - protein, 81 aa, Muntiacus muntjak
AQVCVTFDDVAVTFTQEEWGHLDPAQRTLYQEVMLETCGLLMSLGCPVPRPELIYQLEHGQELWTVKRDLSGSTCPVDKGK

SEQ ID NO: 15514 - protein, 81 aa, Canis lupus
QGLVTFEDVAVYFSREEWGLLNLTQRSLYRDVMLENFALIGSLGFAPSRSHVVAQLENEEELCVPNVVDLTLISRAEARRG

SEQ ID NO: 15515 - protein, 81 aa, Canis lupus
DHGLLTFRDVAVEFSPEEWRCLNHTQRELYRDVMLENYGHLLFVGLMVSKPDLVSFLEQRKEPWDLKTKKTVAIHPGRWEY

SEQ ID NO: 15516 - protein, 81 aa, Canis lupus
VQEPVTFKDVAVDFTQEEWGQLDPVQRTLYRDVMLETYGHLLSVGNQIAKPEVISLLEQGEEPWSVEQAYPQSTCSEWMRN

SEQ ID NO: 15517 - protein, 81 aa, Muntiacus muntjak
ELVTFRDVVISFSQEEWEYLDSAQRDLYWDVMMENYCNLVSLDLESRYDTKTLSVEKDILEKNNSQWEVIENSKLVGLQNS

SEQ ID NO: 15518 - protein, 81 aa, Gorilla gorilla
YQDSVTFDDVAVEFTPEEWALLDTTEKCLYRDVMLENYVNLASVEWEIQPRTKRSSLQQGFLKNQIFTGIQMQTRSYSGWK

SEQ ID NO: 15519 - protein, 81 aa, Gorilla gorilla
MEPLTFRDVAIEFSPEEWKCLDPAQQNLYRDVMLENYRNLVSLVSSLVSSCRVISHGLSRGRNRATEKNDLLTTEEPVVKH

SEQ ID NO: 15520 - protein, 81 aa, Ailuropoda melanoleuca
QLPLTFEDVAIYFSEQEWQNLEVWQKELYKHVMRTNYKILVSLDDGLPKPELISWIEQGREFFKNWGESQKSGNIICSSAD

SEQ ID NO: 15521 - protein, 81 aa, Ailuropoda melanoleuca
AQDSMTFEDVAVCFSGGEWQCLTHAQRHLYADVMLENYGNMISVGFAVPKPPLISHLEQGAKPCIQDLQDWGFLTCSFPVS

SEQ ID NO: 15522 - protein, 81 aa, Ailuropoda melanoleuca
AQISVTFDDVAVTFTQEEWGQLDPAQRTLYQEVMLENCGLLVSLGCPVPRPELIYQLEHGQELWTVKRDLSQSAYPGDKGK

SEQ ID NO: 15523 - protein, 81 aa, Ailuropoda melanoleuca
FREPVTFEDVTLGFTSDEWGLLDLEQKSLYREVMLENYRNLVSVEHQLSKPDVVSQLEEEEALWSVERGIPQDTFSEYPTA

SEQ ID NO: 15524 - protein, 81 aa, Ailuropoda melanoleuca
ELVTYKDVAVDFTQEEWQHLDPAQKTLHRDVMLETYSHLVSVGCSGIKPGIIFKLEREEDPWIIKSELSTWIHSDREKSLD

SEQ ID NO: 15525 - protein, 81 aa, Gorilla gorilla
PQGLLTFRDVAIEFSQEEWKCLGPAQRTLYRDVMLENYRNLVSLDISSKCMMRTLSSTGQGNTEVIHTGTLQRQASYHIGA

SEQ ID NO: 15526 - protein, 81 aa, Gorilla gorilla
TQGQVTFRDVAIEFSQEEWTCLDPAQRTLYRDVMLENYRNLASLGISCFDLSIISMLEQGKEPFTVESQVQTARNPDGWEW

SEQ ID NO: 15527 - protein, 81 aa, Lynx canadensis
PKVPVTFDDVAVYFSEPEWGKLDEWQKELYKHVMRGNYEMLVSLDYAISKPDILTQMERGEEPCPESLWGHEEGSKREAAH

SEQ ID NO: 15528 - protein, 81 aa, Lynx canadensis
SQESVTFEDVAVDFTQEEWTLLDWSQRKLFRDVMLENISHLVSVGKQLYKLDTIFHLEQGEQLSTEGIGLLQCQSLDREDD

SEQ ID NO: 15529 - protein, 81 aa, Lynx canadensis
MAHLMMFRDIAVDFSQEEWECLDLEQRHLYRDVMLENYSNMISLGLCIYQPDVFSLLEKGKEPWIFLQDETRGHCPDMPFR

SEQ ID NO: 15530 - protein, 81 aa, Lynx canadensis
LILHRNVWILLRCKTGHSIRQPPRQHLGLRDLKGVQPVPACLHSSLTGYDSTKPKVILKLEQGEEPWVVEGDLPCRSRPEV

SEQ ID NO: 15531 - protein, 81 aa, Lynx canadensis
ESVTFQDVAVDFTEKEWPLLDSSQRKLYKDVMLENYSNLASVDWETPSKSKWSILMEDIFGKETPRGVTVERTRLGEKPAE

SEQ ID NO: 15532 - protein, 81 aa, Lynx canadensis
FQEAVTFGDVAVHFSREEWQCLDPGQRALYKEVMLENHSSVAGLAGFLVFKPELISRLEQGQEPWVLDLKGVEGREVARTS

SEQ ID NO: 15533 - protein, 81 aa, Lynx canadensis
WSQMPVTFEDVALYLSREEWGRLDHTQQNFYRDVLQKRNGLSLGFPFSRPFWASQGQGKGEASGSCRQMGDEEKTGAIEVG

SEQ ID NO: 15534 - protein, 81 aa, Lynx canadensis
SQESVTFQDVAVDFTEKEWPLLDSSQRKLYKDVMLENYSNLASVGYQVGKPSLISHLEQEEELRTEERGLHRATSPDWETP

SEQ ID NO: 15535 - protein, 81 aa, Phyllostomus discolor
PQALVSFKDVTVEFTQEEWQQMGPLQRTLYRDVMLENYNNLVSVGNCIFKPEVIFKLEQGEEPWFLEEEFSNQSHHEYYRD

SEQ ID NO: 15536 - protein, 81 aa, Desmodus rotundus
EAVPLTFQDVAVYFSQEEGQQLGPDQRALYRDVMLENYGHVASLGLPVPKPELISQLEQGEELWVLDLMGAEEPEPLSSCS

SEQ ID NO: 15537 - protein, 81 aa, Desmodus rotundus
SQGPLTFRDVLVDFSQEEWDCLDPAQRKLYMDVMLENYRNLVSLGCVFPKPVLVTIVEEMKEYWDVCRKKTISAPQAMSSE

SEQ ID NO: 15538 - protein, 81 aa, Macaca fascicularis
KPRTVSFADVAVYFSREEWGCLRPAQRALYRDVMRETYGHLGALGVGGSKPALISWVEEEAELWDPAARDPEVTKCPTETD

SEQ ID NO: 15539 - protein, 81 aa, Macaca fascicularis
LQGPVSFKDVAVDFTQEEWQQLDPDEKITYRDVMLENYSHLVSVGYDITKPNVIIKLEQGEEPWIMEGEFPCQHSPEVWKF

SEQ ID NO: 15540 - protein, 81 aa, Macaca fascicularis
GVAISNPDLVTFLEQRKEPYNVKIHETVAKHPAMCSHFTQDFLPVQEIEDSFHKLILRRYEKCGHENLQLRKGCKKKVQKA

SEQ ID NO: 15541 - protein, 81 aa, Macaca fascicularis
GMEPLQFRDVAIEFSLEEWHCLDTAQQNLYRDVMLENYGNLVFLGIVVSKPDLITRLEQGENPLTVKRHKMTANPSGPGMV

SEQ ID NO: 15542 - protein, 81 aa, Macaca fascicularis
VRLTFRDVAIEFSQEEWKCLDPAQRTLYRDVMLENYWNLVSLGLCHFDMNIISMLEEGKEPWTVKNCVKIARKPRMRECVK

SEQ ID NO: 15543 - protein, 81 aa, Macaca fascicularis
SYQDSVTFDDVAVDFTPEEWALLDTAEKYYRDVMLENYMNLASVEWEIQPRTKRSSLQQGFLKNPIFNGIQMQTRNYSGWK

SEQ ID NO: 15544 - protein, 81 aa, Macaca fascicularis
MVSFEDVAVLLSQEEWDCLIPAQRGLYRDVMLETYGNLVSLGLQASKPDVISRLEQGDKPWTPHILRTQISWSWRHKRECY

SEQ ID NO: 15545 - protein, 81 aa, Macaca fascicularis
SQESVAFEDVAVYFTTKEWAIMVPAERALYRDVMLENYEAVAFVVPPTSKPALVSHLEQGKESCFIRPQGVLSRSDWRAGL

SEQ ID NO: 15546 - protein, 81 aa, Macaca fascicularis
KVTFEDVAIDFTQEEWAMMDTSKRKLSRDVMLENVSHLVSLGYRISKSYITLQLEQGKELWREGREFLQGQNLDKESALKK

SEQ ID NO: 15547 - protein, 81 aa, Macaca fascicularis
MLETYSSLVSLGHCITKPEVIFKLEQGAEPWLGEEWANQCLSGVQTVDIIERSQEIHHRRIWQVAVTNSKTSTKETVELGK

SEQ ID NO: 15548 - protein, 81 aa, Phascolarctos cinereus
FQESVTFQDVAVEFTREEWEHLRPAQRELYRDVMLENYRNLVSLGLPFSKPEMIFHLEQVEALWNAEKEVLTRIHTGEKPY

SEQ ID NO: 15549 - protein, 81 aa, Phascolarctos cinereus
RAGLVTFEDVSVDFSRSEWKQLKPAQRDLYKDVMLENYKNLVSLGEEHCFLGLRICLPFGMDVFYTRRATPVGGRKRRGNS

SEQ ID NO: 15550 - protein, 81 aa, Phascolarctos cinereus
PQELVTFSDVAVYLSKEEWGQLDPSQRALYKDVMLENYGNVVSLGLSLCKPEMISQLEQGKMPWVPDLQGTEDDQTTWPDD

SEQ ID NO: 15551 - protein, 81 aa, Phascolarctos cinereus
SRVSVTFKDVAVDFTKEEWQELEPSQKDLYREVMLENYKNLISLGVPISKPDVIYQLEQGEAPWMLERRVPRGSSPDGEKL

SEQ ID NO: 15552 - protein, 81 aa, Phascolarctos cinereus
GWVPALFDEVAIYFSDEEWEVLTEQQKALYREVMRMNYETVLSLEFPFPKPDVISQLEVEESPWVPYPQNSEDWKLQGGSF

SEQ ID NO: 15553 - protein, 81 aa, Phascolarctos cinereus
YQESVTFEDVSVDFTQEEWSHLGPTQRALYREVMLETFENLTSLGLPGLKPEVISCLERGEAPWMLEGEVPRDPYPGSFHE

SEQ ID NO: 15554 - protein, 81 aa, Phascolarctos cinereus
MLENYRNLIFLGFSVFTPVVISRLEGGEEPWTVEREIPGSPGADWETNPEARELAPKLSMPVEELSLQSFTRISSQGYRLG

SEQ ID NO: 15555 - protein, 81 aa, Phascolarctos cinereus
PQESVTFKDIAVEFTRTEWRHLTSCQKELYRDVMLENYGNLVCLGLAVSKPDVISQLERREAPWTPGGIQRSSCPAFLSNF

SEQ ID NO: 15556 - protein, 81 aa, Phascolarctos cinereus
MLENYRNLVSLGAECQSAKPKLISQLEQSRESWLLEEDPHGLCPGGCPKPETLNSVPYQGVSEKPSSREERLEGLGRDDSL

SEQ ID NO: 15557 - protein, 81 aa, Phascolarctos cinereus
FQASVTFKDVAVDFTQEEWGHLDPTQRALYRDVMLENYRNLVSLGCQVFKPDVISQLEQGKEPWMVKAKILRGSCPDFKIR

SEQ ID NO: 15558 - protein, 81 aa, Phascolarctos cinereus
ARDPVSFADVAVYFSPEEWGRLRPAQRALYRDVMRETYGHLGALGFPGPKPALISWVEQEPEVWGPDARDPEEEKESPREE

SEQ ID NO: 15559 - protein, 81 aa, Phascolarctos cinereus
GNESVTFKDVAVEFTQEEWVQLDPSQKKLYWDVMLENYRNLVSLESREFAGDKPLECNGYGNAFWSKEHLAVCQIIHTGDN

SEQ ID NO: 15560 - protein, 81 aa, Myotis lucifugus
DAVTFPDVAIDFSRDEWECLNLAQRTLYRKVMLENYRTLVSVGLCVSKPDVISLLEQGEEPWVTDGEMAGGLCPHSECVWM

SEQ ID NO: 15561 - protein, 81 aa, Myotis lucifugus
SKDMNFEDVVIAFSQEEWGLLDEVQRHLYCNVMLEMFALVASVGCWHKMNNEEAYSDQSVSVQGESRVRASKTAPATQKSH

SEQ ID NO: 15562 - protein, 81 aa, Puma concolor
SEESVTFKDVAVDFTQEEWGQLDSPQRALYRDVMLENYQNLLALGPPVCKPDVISHLERGEEPWWMPREAPGGAWPEGEPG

SEQ ID NO: 15563 - protein, 81 aa, Puma concolor
MLLDDSQRLLYQDVMLENFALLASLGIAPSTSRLVAQPKQREDPWVPDQVDVTPATEREAPKGPGPGCWCAVEDNDTSSVS

SEQ ID NO: 15564 - protein, 81 aa, Puma concolor
AEGGVTFEDVAVYFSQEEWKLLDEAQKRLYHDVMLETFALISSLGCCCGAEDAEAPLEQSISVGVSQASVPKAALSSRKTH

SEQ ID NO: 15565 - protein, 81 aa, Puma concolor
MASPSPPPEPKEWDYLDPAQRSLYKDVMMENYGNLVSLDVLNRDKDEEPTVKQEIEEIEEEVEPQGVIVTRIKSEIDQDPI

SEQ ID NO: 15566 - protein, 81 aa, Sapajus apella
FQEAVTFKDVAVAFTEEELGLLDSSQRKLYRDVMLENFRNLVSVGRQSFKPDMISQLEREEKLWMKEFQNQRGDRNQNEMA

SEQ ID NO: 15567 - protein, 81 aa, Sapajus apella
MGPLTFRDVAIEFSLEEWQCLDTAQQNLYRHVMLENYRNLVFLAGIAVSKPDLITCLEQGKEPWNMKRHAMVAKPPVVCSQ

SEQ ID NO: 15568 - protein, 81 aa, Sapajus apella
MGVLTFRDVAIEFSPEEWECLDSAQQHLYRDVMLENYRNLVSLAGSFLFTAEILPEHDIKDSFQKVILRKYRSCDLNNLHL

SEQ ID NO: 15569 - protein, 81 aa, Sapajus apella
RSQESLTFQDVAVDFTREEWDQLYPAQKDLYRDVMLENYRNLVALGHQLYKPEVITQLELEEEWVIEGDSLLDTCPDGENR

SEQ ID NO: 15570 - protein, 81 aa, Sapajus apella
MFKEAVTFKDVAVVFTEEELGLLDPAQRKLYRDVMLENFRNLLSVGQQAFDRDTFQFLREEKVWMMKTATQREGNSGSKIQ

SEQ ID NO: 15571 - protein, 81 aa, Sapajus apella
NFWILRLPPGSKGEAPKEWGKLEDWQKELYKHVMRGNYETLVSLDYAISKPEVLSQIEQGKEPCSWRRPGPKIPDVPVDPS

SEQ ID NO: 15572 - protein, 81 aa, Sapajus apella
MLYRDVILENYSNLVSVGYCITKPEVIFKIEQGEEPWILEKGFPSQCNPERKWKVDDVLKGSQENEDDHFWELLFHNNKTV

SEQ ID NO: 15573 - protein, 81 aa, Sapajus apella
MSVESVSFKDVTVDFSRDEWQQLNTAQKSLYRDVMLENYFNLISVGCQVPKPEVIFNLEQEEPCMLNGGISSQSCPDGKIG

SEQ ID NO: 15574 - protein, 81 aa, Sapajus apella
EEKGNEMLTFRDVAKGFCPEEWECLDSSQQHLYRDVMLENYRNLVSLGLGDSKPELITHLEQGKDPWNVKRQETVVKHSGR

SEQ ID NO: 15575 - protein, 81 aa, Oryctolagus cuniculus
NFWILRLPPGSKGEVPKEWGKLEDWQKELYKHVMRGNYETLVSLDYAISKPEVLSQIEQGKEPCTWRRTGPKIPDVPVDPS

SEQ ID NO: 15576 - protein, 81 aa, Oryctolagus cuniculus
QGSVTFEDVSVNFTQEEWQWLTPRQRRLHRDVMLENYSNVVSLAQHEEASKPEVILRLERGEEPWTVGGEGLSSSGRGNQG

SEQ ID NO: 15577 - protein, 81 aa, Pteropus alecto
VKESVTFKDVAIDFTLEEWRLMDPTQRDLHKDVMLENYRNLVSLGLAVSKPDMIAHLEDGQGPWVVVREISRTSNPELETK

SEQ ID NO: 15578 - protein, 81 aa, Oryctolagus cuniculus
MAFEDLAVYFTWEEWQNMNKAQKILYRDEMLETYSSLLFLGHCITKPDLIFKLEQGAEPWMVSEFLNQNLPVKPYECNNCG

SEQ ID NO: 15579 - protein, 81 aa, Oryctolagus cuniculus
HFPLQAPVTFDDITVYLLQEEWMLLSQQQKEICGSDKLVAPLGPTVANPELFYKFGQGPEPWLGDVQGQRSLLDHHPGKKQ

SEQ ID NO: 15580 - protein, 81 aa, Oryctolagus cuniculus
VLVMIGFEDLAVYFTWKEWQNMNNAQKILYRDVMLETYSILFSLGHCMTKPDLILKLEQGAEPWMGEECLHQSLPVAVKSD

SEQ ID NO: 15581 - protein, 81 aa, Oryctolagus cuniculus
FQEAVTFGDVAVHFSREEWQCLDSGQRALYREVMLENHSSVAGLAGFLVFKPELISRLEQGQEPWVLDLQGAEKTEASRSP

SEQ ID NO: 15582 - protein, 81 aa, Pteropus alecto
DPVTFQDVTVEFTQEEWEHLGTAQRALYCENSYWRKNHYKCSECGKAFYQSTCLTQHQRIHTGEKPYECSQCGKAFSQSSH

SEQ ID NO: 15583 - protein, 81 aa, Gorilla gorilla
ALALVSFEDVVVTFTGEEWGHLDLAQRTLYQEVMLETCRLLVSLGHPVPKPELIYLLEHGQELWTVKRGLSQSTCTGEKAK

SEQ ID NO: 15584 - protein, 81 aa, Gorilla gorilla
MGPLQFKDVAIEFSLEEWHCLDTAQRNLYRNVMLENYSNLVFLGIVVSKPDLIARLEQGKKPLTMKRHEMVANPSGARLLF

SEQ ID NO: 15585 - protein, 81 aa, Gorilla gorilla
SQGRVTFEDVTVNFTQGEWQWLNPEQRNLYRDVMLENYSNLVSVGQEETTKPDVILRLEQGKEPWSVEEEVLGSGRAEKNG

SEQ ID NO: 15586 - protein, 81 aa, Gorilla gorilla
EDVAVDFTLEEWALLDSAQRDLYRDVISVARCEMWERTKTDMFTDMYGQEKSKEQTIPNFTGNNSCAYTLEKNCEGYGTED

SEQ ID NO: 15587 - protein, 81 aa, Ailuropoda melanoleuca
ASLLPSLPTEHWRHLDSTQKEQYWDLMLETYGKMVSGAGISNSKCDLTNSTEYGEELAGLHLHVGEKISRPTCIGDRQEND

SEQ ID NO: 15588 - protein, 81 aa, Gorilla gorilla
PPTGDILIQGTVTFEDVAVNFTWEEWNLLSEAQRCLYRDVTLENLALISSLDPALDGSADNTQTGNLGQSVLPSHPEQKTA

SEQ ID NO: 15589 - protein, 81 aa, Ailuropoda melanoleuca
LQGLVTFEDVAVDFTPEEWQYLNPPQKTLYREVMLETYSNVVSVGPQATKPDLVLKLEVEEPRPAETKISYFLLEAACQID

SEQ ID NO: 15590 - protein, 81 aa, Ailuropoda melanoleuca
QGSVSFRDVAIDFSQEEWEWLQPAQRDLYRHVMLENYGHLVSLGLNISKPYVVSLLEQGREPWLEKAEVRRDLFSGKLITT

SEQ ID NO: 15591 - protein, 81 aa, Phyllostomus discolor
VTFADIALYFSKKEWYLLDEDQRRLYLDVMLENFELISSLGCCCGAEGVKASNEENVSIEVSQAKKSNIPFSPWHCHPCES

SEQ ID NO: 15592 - protein, 81 aa, Phyllostomus discolor
KVPVTFVDIAVYFSEDEWKNLDEWQKELYNNLVKENYKTLMSLDAEGPGPKPEAPSQAEPREEPCVWEQRDPEEREILMDP

SEQ ID NO: 15593 - protein, 81 aa, Desmodus rotundus
AQVSVTFDDVAVTFTQEEWGQLDPAQRTLYQEVMVETCRLLVSLGCPVPRHELIHQLEHGQELRMVKKDLSQSTYPGEKGK

SEQ ID NO: 15594 - protein, 81 aa, Macaca fascicularis
PLTFKDVAIEFSQEEWKCLEPVQKALYKDVMLENYRNLVFLGISPKCVIKELPPTENSNTGERFQTVALERHQSCDIENLY

SEQ ID NO: 15595 - protein, 81 aa, Macaca fascicularis
ESVTLEDVAVEFIQEWALLDSARRSLCRYGMLDQCRTLTSRGTPPCKPSRVSQLAPRAEPRATERGILHATGVAWESQLKP

SEQ ID NO: 15596 - protein, 81 aa, Macaca fascicularis
QESVTFQDVAVDFTEKEWPLLDSSQRKLYKDVMLENYSNLTSLDWETPSKTKWSLLMEDIFGKETPSGVTMERAGLAEKST

SEQ ID NO: 15597 - protein, 81 aa, Macaca fascicularis
QGRLTFRDVAIEFSQEEWKCLDPAQRALYRDVMLENYRNLVSLAISSKCMMKEFSSTAQGNREVLHTGTLQRHESHHIGDF

SEQ ID NO: 15598 - protein, 81 aa, Macaca fascicularis
TTFKEAVTFKDVAVFFTEEELGLLDPAQRKLYQDVMLENFTNLLSVGYQPFHPFHFLREEKFWMMETATQREGSSGGRTVV

SEQ ID NO: 15599 - protein, 81 aa, Phascolarctos cinereus
YQESVTFRDVAVNFSREEWGQLNPAQRDLYKDVMLENYRNLVSLGLPISKPDVIFQLEQGKEPWLLGLPRAEERELPNNSS

SEQ ID NO: 15600 - protein, 81 aa, Phascolarctos cinereus
AQELVTFQDVAVDFTQEEWGLLDHPQKELYKEVMLENARNALSLGLPVPREGLISHFGQREAPWMMELEDPRTSYPVSQKL

SEQ ID NO: 15601 - protein, 81 aa, Macaca fascicularis
EELPVVFEDVAVYFTRKEWGMLDKRQKELYRDVMRMNYELLASLGPAAAKPDLISKLERRAAPWIKDPNGPKWGKGRPPGN

SEQ ID NO: 15602 - protein, 81 aa, Macaca fascicularis
AQGSVSFNDVTVDFTQEEWQHLDHAQKTLYMDVMLENYCHLISVGCHMTKPDVILKLERGEEPWTSFSGHTCLEENWKAED

SEQ ID NO: 15603 - protein, 81 aa, Phascolarctos cinereus
SQESVTFRDVTVDFSPEEWRQLGPSQKELYKEVMLENYRNLVCLGLAASKPRVICQLEQGEAPWMPGSDVAQRSSCPDWRT

SEQ ID NO: 15604 - protein, 81 aa, Phascolarctos cinereus
MWLWNSLRKSGYNLNPSQKKLYRDVMLENYRNLVFLGFAASRPNDSDQLERKEVSSLPEADIPRSSCPESREFAGDKPLEC

SEQ ID NO: 15605 - protein, 81 aa, Phascolarctos cinereus
RLRESVTFKDVAVNFTWEEWRYLEPAQRALYRDVMLENYKNLVSLGLPVSKLDVISLLERKVQWMPEGEVSRGSCTGKNLS

SEQ ID NO: 15606 - protein, 81 aa, Phascolarctos cinereus
MWENYRNLASVAGFPFPKPELISSLERGEEPWLPDVLGSSERRRILFFCIAGDEPGTPLRLQKGLEEVGVLKGHISRAWRD

SEQ ID NO: 15607 - protein, 81 aa, Phascolarctos cinereus
PQESVTFREVAIDFSLEEWGWLTPAQKELYQEVMLENYRNLVCLGLAISKPDVICQLERGEAPWVPEGDVSQSSCADSEVI

SEQ ID NO: 15608 - protein, 81 aa, Phascolarctos cinereus
SQESLMFKDSSVSFTEDEWGHFDSAQKGLYRDVMLENYRNLASMGHPVSKPDVISQLKHGKDPWTKKEIPKSHRLDSKDPE

SEQ ID NO: 15609 - protein, 81 aa, Phascolarctos cinereus
RQELVTFKDVAVDFSWEEWGHLERSQKELYREVMLENYRNLVCLGLEESKPDVIEQLEQQGAPGIQGGSALASACPDWENR

SEQ ID NO: 15610 - protein, 81 aa, Phascolarctos cinereus
WSAVTFQDVTIDLSPDQWKGLGPTQRQLYRDVMLENYRNLVSLGPESPGSRPQIISWLEQGEGREFPGSIPSDSKTQTEAR

SEQ ID NO: 15611 - protein, 81 aa, Phascolarctos cinereus
IQESVTFRDVAVDFTWEEWSRLDPAQRDLYRKVMLENCENLVSVGIPVSTTDMISLLEKRGAPWMPEGEAVSGSCPDSLSE

SEQ ID NO: 15612 - protein, 81 aa, Phascolarctos cinereus
GEEAVTFRDVALDFTWEEWGCLSAAQRELYKDVMLENYRNLVSLAGLPGPKPGLISWLEGEEEPHPWDSLVHAARSTSLSK

SEQ ID NO: 15613 - protein, 81 aa, Phascolarctos cinereus
MLENYRNLVSLGFAVSKPDVICQLERKETSWMPEADILRSSCSGSKEFTGEKCYECRECGKAFKSKKQLTVHQRIHTGAKH

SEQ ID NO: 15614 - protein, 81 aa, Phascolarctos cinereus
MRTGILKDSRVGDWSEEEWTHLDPAQRELYGDVMLENYGNLVSLGLPVFKPDVISQLKLGGESWVLNDPGIKEKEIFRGVS

SEQ ID NO: 15615 - protein, 81 aa, Phascolarctos cinereus
LQESLTFKDVAVDFTPEKWGCLDPFEKELYRNVMLENYGHLIYLGLAVSKPDVICHLERGDPPWKPVIEVPRTSFPESHLL

SEQ ID NO: 15616 - protein, 81 aa, Phascolarctos cinereus
SQESLMFKDSSVSFTEDEWGHFDSAQKGLYRDVMLENYRNLASMGHPVSKPDVISQLKHGKDPWTKKEIPKSHRLGTSLAK

SEQ ID NO: 15617 - protein, 81 aa, Phascolarctos cinereus
REAVTFQDVAVDFTWEEWARLAPSQKELYKDVMLENYRNLVCLGWKNRSDTEELAPDVEAWECKARLLKQERNEDKHSRLD

SEQ ID NO: 15618 - protein, 81 aa, Myotis lucifugus
AQEPLTFHDVAVDFTWEEWQLLDPEQKDLYRDVMLETYSHLVSVGYEASKPDILSKLDHGEAPWTVAGEIHCGTHSEIWKR

SEQ ID NO: 15619 - protein, 81 aa, Myotis lucifugus
LQGSDLFRDVAVVFSREEWEWLAPAQRDLYRDVMLETYSNLRSLDLAISKPDVIAFLEQGKEPWRAVEAAAGGLCPALEAR

SEQ ID NO: 15620 - protein, 81 aa, Myotis lucifugus
TVSNMDFEDVAIVFSEEEWGLLDEAQRLLYCDVMLEVFALVSSAGCWHNTDDEETCFEQSVSVQGESQVRSCKTEPATQRT

SEQ ID NO: 15621 - protein, 81 aa, Myotis lucifugus
GDMDFEDVAIAFSQEEWGLLDEAQRLLYCDVMLEVFALVSCADCWHKMDDEEVGPVPFVSIQGESQVRASKTAPATQRTHL

SEQ ID NO: 15622 - protein, 81 aa, Myotis lucifugus
WDMNFEDVAIVFSQEEWRLLDEAQRLLYYDVMLKVFALVSSVGCWHKMDDKEACSSQSVSIQGESQVRASKTAAATQKTLL

SEQ ID NO: 15623 - protein, 81 aa, Puma concolor
EMDSVVFEDVVVDFTQEEWALLKPAQKKLYKDVMLETFRNLVTVGKENWEDQCIEDKHNDQGRHLRNHMVERLCDSSKGNT

SEQ ID NO: 15624 - protein, 81 aa, Puma concolor
LQGSVLFEDVSVDFTLKEWRLLDPAQRLLCRDVILENYGHLVSLGRCVARPELIFKLEQGEEPWVPRRELPSQSPPGELTK

SEQ ID NO: 15625 - protein, 81 aa, Puma concolor
FQPPVSFKDVAVTFTREEWGQLDPAQRTLYRNVTLETCSHLAFLGLLLSKPAVICWLEQGQDPWRAEHGPPRDWKNTLEKE

SEQ ID NO: 15626 - protein, 81 aa, Puma concolor
FQASVVFEDVAVKFTPEEWALLDRGQRKLYRDVMLETCRNLSSVEKQKFHSNGDLTRMQEGLLRSPLVESVCERIEGDQCG

SEQ ID NO: 15627 - protein, 81 aa, Puma concolor
FKEAVTFKDVAVVFTEEELGLLDPAQKKLYGDVMLENFRNLLSLGHQPFTPDAVPQFKRGGRLWMIKAATQSHGSSGDRNL

SEQ ID NO: 15628 - protein, 81 aa, Puma concolor
MAFRDVAVDFSQEEWMLLSPAQRSLYREVMLENYSNLVSLGIPVTKPKLITQLEQGKETWREERKCSPATCPAEPKPELHL

SEQ ID NO: 15629 - protein, 81 aa, Puma concolor
SVGPVSFRDVAVDFTQEEWQYLDPEQKTTYRDVMLENYSHLVSVGCHIIKPEVIIKLEQGEEPWIVEGEFLPHSYPEEVWK

SEQ ID NO: 15630 - protein, 81 aa, Puma concolor
AQVSVTFDDVAVTFTQEEWGQLDPAQRTLYQEVMLENCGLLVSLGCPVPRPELICQLERGQEPWTAKRGLSQNTYPGDKDK

SEQ ID NO: 15631 - protein, 81 aa, Sapajus apella
KEAFAAFRDVAVDFTQEEWRLLSPAQRTLHREVMLETYNHLVSLEIACSKPKLIAQLERGEEPWREERKCSLDLRPGSKPE

SEQ ID NO: 15632 - protein, 81 aa, Sapajus apella
YQDSVTFDDVAVDFTQEEWTLLDPSQRDLYRDVMLENCENLASVGRHLFKPSVICWLEEEGQLRAGQRGVLQEWQLESKGS

SEQ ID NO: 15633 - protein, 81 aa, Sapajus apella
MVTFKDVAVVFTEEELGLLDSVQRKLYRDVMLENFSNLLLVAHQPFKPDLISQLEREEKLLMVETETPRDGCSGRKNQQKM

SEQ ID NO: 15634 - protein, 81 aa, Gorilla gorilla
EMGPLTFRDVAIEFSLEEWQCLDTAQQDLYRKVMLENYRNLAFLAGIAVSMPDLVTCLQQGKDPWNVKRQSTVVKPPVQTG

SEQ ID NO: 15635 - protein, 81 aa, Ailuropoda melanoleuca
QEAVVFADVAVDFTPEEWALLDGGQRRLYRDVMLETCRNLASLDCYTQVKPCGSRSQLNILENELSSEEKIVRFIRNDSWA

SEQ ID NO: 15636 - protein, 81 aa, Ailuropoda melanoleuca
GSLSFRDVAISFFQEEWECLDPAQRALYRDVMLETYSNLVSVGSSISKPDVIALLEQDKEPWVVLRRETSGWYSDLESSYG

SEQ ID NO: 15637 - protein, 81 aa, Gorilla gorilla
QGYVTFEDVAVYFSQEEWRLLDDTQRLLYRNVMLENFTLLASLGLASSKTHEITQLESWEEPFMPAWEVVTSAILRVWLRN

SEQ ID NO: 15638 - protein, 81 aa, Ailuropoda melanoleuca
SQESLTFQDVAVNFTREEWDQLYPAQKNLYRDVMLENYRNLVALGIGHQLYKPEVISQLEQEEQWVMERGRALDTHADGES

SEQ ID NO: 15639 - protein, 81 aa, Ailuropoda melanoleuca
RESLTLEDVAVDFTWEEWQLLAPTQKNLYRDVMLENYRNLVSVGTGYVASKPDALSRLEQEEPWTTEDEIHSRFHPGERKP

SEQ ID NO: 15640 - protein, 81 aa, Ailuropoda melanoleuca
QGSVSFRDVAVDFSREEWQHLDLAQRSLYRDVMLETYSHLLSVGFEVPQPEVFMLEQGKEPWALQGESPHQNCPGEKLWDY

SEQ ID NO: 15641 - protein, 81 aa, Lynx canadensis
MLFVSRTELPNPCPILYLSPCTGHQLPKPDVILRLEKGEEPWLVERGTHRETHPDLDTAVEIKSSVSSESISKDKQSYGIK

SEQ ID NO: 15642 - protein, 81 aa, Lynx canadensis
AHRSLMFSDVSIVFSQEEWEYLDLEQRDLYRDVMLENYSNLVSLGCFISKPDVISLLEQGKEPWKVVRKGRRRYADLETRY

SEQ ID NO: 15643 - protein, 81 aa, Lynx canadensis
DEALMAFRDVAVAFTQKEWRLLSPAQRTLYRDVMLENYSHLVSLEPGTEFQPCVHSCPVAFSSPQFLQQYVLCGHLPQIFP

SEQ ID NO: 15644 - protein, 81 aa, Phyllostomus discolor
AQAPVTFKDVSVTFTREEWELLAPAQRTLYHEVMLETCRILVSLGHPVPRPELVHLLEHGQELWTVKRGSPRHTCPGDGAK

SEQ ID NO: 15645 - protein, 81 aa, Phyllostomus discolor
GPVTFKDVIVEFTQEEWQLLDTAQRTLYREVMQENYGHLVSVDLWNIHDRGGRYQKSQAENSRTGEPMDQKIHTRAKIYTC

SEQ ID NO: 15646 - protein, 81 aa, Phyllostomus discolor
FQEAVTFKDVAVVFTEEELGLLDPSQRKLYQDVMVENFRNLVSVGHQSFTADVIPQLERRGKLWVVRTAPQSQSSSGDKTL

SEQ ID NO: 15647 - protein, 81 aa, Phyllostomus discolor
AQALLSFEDVAVGFTWEEWRLLDPAQKDLYRDVMLENYSNLLSVGYQSSNSDSLFWLEQGGPRWIAEEAAHSPACPDHSVV

SEQ ID NO: 15648 - protein, 81 aa, Phyllostomus discolor
PQKLVTFEDVAVYFTPTEWDGLSPAQRALYRDVMLENYGNVASLGFPILKPAVISQLEGGGELGIPSLLAAGVGSDPPGLW

SEQ ID NO: 15649 - protein, 81 aa, Phyllostomus discolor
NFWVLRLPPGSKGEAPKEWGKLDEWQKELYKHVMRGNYETLVSLDYAISKPEVLSQGEQGKEPCGWRRTAPKVPDAPVDPS

SEQ ID NO: 15650 - protein, 81 aa, Phyllostomus discolor
PKVPVTFDDVAVHFSEQEWGNLSEWQKELYKNVMRGNYESLVSMDYAISKPDLMSQMERGERPTMQEQEDSEEGEPPADPS

SEQ ID NO: 15651 - protein, 81 aa, Phyllostomus discolor
CQGSLSFSDVAVGFTRKEWQQLDPTQRTLYRDVMLETYSHLVSVGCQVTKPAVISKLELGQEAWMEEEEIRRWGVPDPSGG

SEQ ID NO: 15652 - protein, 81 aa, Phyllostomus discolor
SRSLDSDGVCFSEQEWENLEDWQKELYRNVMMSNYETLVSLKVLGQPEGEAELGTEMLGDLEEEGLGGVHPAGGVMIKQEI

SEQ ID NO: 15653 - protein, 81 aa, Phyllostomus discolor
KPRAMKFADVAVYFSPEEWECLRPAQRALYRDVMQETYRHLGALGCAGPKPALISWLERNTDDWEPAALDPQECPRGLTVQ

SEQ ID NO: 15654 - protein, 81 aa, Phyllostomus discolor
AKAFVTFEDVAVHLSKKEWLLLDESQRRLYLDVMLDNYGLISSLGCCCGTEDEETPNEQNITVRVSKAMNLKTALSSQKSH

SEQ ID NO: 15655 - protein, 81 aa, Phyllostomus discolor
QDSVVFADVAVDFTLEEWALLDSAQRNLYRDVMLENFQNLASVDNETLFTARGPIIQQDMHEEKISNKQEIAKFTRSNSCI

SEQ ID NO: 15656 - protein, 81 aa, Phyllostomus discolor
MEPVTFGDVTLNFTKEEWSLLDLKQRRLYRDVMLENFRNLACIDQAIQPKTKDSVSQQDILAKKTLHTANRVSLTSNSAAL

SEQ ID NO: 15657 - protein, 81 aa, Phyllostomus discolor
AHDSVTFGDVAIDFSQEEWEFLDAAQRDLYRNVMWENFSNFISLGLFISNLDVITLLDEGKEPGRVLRERTRRLYLDLESR

SEQ ID NO: 15658 - protein, 81 aa, Myotis lucifugus
RIMNMNFEDVAIVFSEEEWGLLDEAQRLLYCNVMLEVFALVSSAGCWHKSDDEEACSERSLSVQVKSQVRASKTEPATQRT

SEQ ID NO: 15659 - protein, 81 aa, Myotis lucifugus
ISFEDVAVDFTLEEWQLLNPIQKNLYRDVMLENYSNLVFLGHEIIKPDAVWKLEQEEPWKINEEILNHNFSEELWLDNNLK

SEQ ID NO: 15660 - protein, 81 aa, Sapajus apella
PQDLMTFEDVAVEFTQWEWGQLNPAQKNLYREVMLENFRNLTLLGLLVSKPYVICQLEEGGEPFMVKREISIGAHSDWERR

SEQ ID NO: 15661 - protein, 81 aa, Sapajus apella
WQGQVNFEDVFVYFSQEEWVLLDEAQRLLYRDVMLENFALMASLGCWPGMKDEEIPFEQSFSIGLSQIRIPKGSPFTQKAY

SEQ ID NO: 15662 - protein, 81 aa, Sapajus apella
MPGRPGSLEMGPLTFRDVAIEFSLEEWQCLNTDQQDLYRKVMLENYRNLVFLGRSDHLSAGRKRSLEYEETQYGSQAPRGR

SEQ ID NO: 15663 - protein, 81 aa, Sapajus apella
CYQDSVTFDDVAVDFTQEEWTLLDPTQRSLYSDVMLENYKNLATVGGQIIKPSLISWLEKEESRTVQGGVLQGWELQLETQ

SEQ ID NO: 15664 - protein, 81 aa, Sapajus apella
AQGTVTFEDVAVKFSQEEWSLLSEAQRCLYHDVMLENLALISSLGCWYGAKDETPSKQTLSIQQQSPLRSHWTGGHDVTLK

SEQ ID NO: 15665 - protein, 81 aa, Sapajus apella
PGASVSFQDVAVEFTQEEWQHLGPVEWTLYRDVMLENYSHLVSVGYCITKPKVISQLEQGEEPWSLEDEFLNQRYPGHFKV

SEQ ID NO: 15666 - protein, 81 aa, Sapajus apella
LPFQVTFSDVAIHFSHEEWGWLDSAQRDLYKDVMVQNYKILVSLAGLSITKPYVITLLEDGKEPWMMEEKLSKGVTPGESW

SEQ ID NO: 15667 - protein, 81 aa, Sapajus apella
KQGSVTFRDVAIDFSQEEWEFLDPAQRDLYRDVMWENYSNFISLDLDSRYRTNTLSPEKDLYEIYSFQWDIMERIKSYSLQ

SEQ ID NO: 15668 - protein, 81 aa, Oryctolagus cuniculus
SQEPLSFKDVSVDFSQEEWGQLAPVHQNLYREVMLENYRNLVSVGYQLSKPSVISQLEKGEEPWMAEREDLGDPSSDLRSK

SEQ ID NO: 15669 - protein, 81 aa, Oryctolagus cuniculus
SLGPVSFKDVAVGFTQEEWRQLEPAQRRTYREVMLENYSHLVAVGCHFIKPDVITKLERGEEPWIEGGFLPQGCADEVWQA

SEQ ID NO: 15670 - protein, 81 aa, Oryctolagus cuniculus
QVQGSVTFRDVAVFFSQDEWLHLDSAQRRLYREVMLENYSNLLSLGILFSKPKVISQLEQADHWLVKKEVPRGTRLGWESL

SEQ ID NO: 15671 - protein, 81 aa, Oryctolagus cuniculus
LGHGDGCRGEEELRLLDTAQRALYRAVMLENFRNLLSGPSTWAILHCTPWPQQRAGSEEKQPGLEPQIWEHAAGDSTRLQD

SEQ ID NO: 15672 - protein, 81 aa, Oryctolagus cuniculus
RPRALKFVDVAVYFSEEEWGCLRPAQRALYRDVMRENYGHLGALGCAGPKPALISWLERNTEDWEPAALDPQEYPRGLTAQ

SEQ ID NO: 15673 - protein, 81 aa, Oryctolagus cuniculus
MTAFEDLAVYFTWEEWQKMNNAQKILYRDVMLETYSSLFSLGHCITKPDLIFKLERGEEPWIVDECLNLSLSVVMKRDDLI

SEQ ID NO: 15674 - protein, 81 aa, Pteropus alecto
SVAFEDVAVNFTPEEWALLDPSQKKLYRDVMRETFENLASVGKGMEDYDTEDQYKNQGRKLRSHIEERICESEASSECEEN

SEQ ID NO: 15675 - protein, 81 aa, Oryctolagus cuniculus
KPGAVRFADVAVYFSSEEWGCLRPAQRALYRDVMRENYGHLGALGFPGPKPALISWMERESEAWSPAAQDPDEGQSPGGAL

SEQ ID NO: 15676 - protein, 81 aa, Pteropus alecto
SRESVTFKDVAVDFTQEEWRHVDPAQRRLYRDVMLENYSNLVSLGYQVSKPEVIFKLEQGEEPWLSEGEIQRPFFPDESTL

SEQ ID NO: 15677 - protein, 81 aa, Oryctolagus cuniculus
MKSVGCPVPRPELICQLERVQEPWTLKNDLSQSSRSGPKGRLKNTEPAACEPALRDGASGDSQLVQARHQDRSSEMQEGYL

SEQ ID NO: 15678 - protein, 81 aa, Desmodus rotundus
SQSLVTFGDVAVDFSQEEWEQLTCAQRALYRDVMLENYRNLVSLGLCFSKPDMISSLEQREEPWMAKRKLTRGPCPDWRAV

SEQ ID NO: 15679 - protein, 81 aa, Desmodus rotundus
AQDCVVFEDVAIHFSQEEWGLLDEAQRHLYHSVMLENLALLSSVGCWSGAQVEEAPLEQGDSGGGSQVRTPKSALSTQKAQ

SEQ ID NO: 15680 - protein, 81 aa, Macaca fascicularis
SQEQVSFKDVCVDFTQEEWYLLDPAQKILYRDVILENYSNLVSVGYCITKPEVVFKIEQGEEPWILEKGFPSQCHPERKWK

SEQ ID NO: 15681 - protein, 81 aa, Macaca fascicularis
MAMYLTREEWRPLDPAQRDLYRDVMQENYGNVVSLDFEIRSENEVNPKQEISEDVQFGTSERPAENAEENPESEEGFESGD

SEQ ID NO: 15682 - protein, 81 aa, Macaca fascicularis
LTFKVVAIEFSAEEWKCRDPAQQNLYRDVMLQNYRNLGVAICNPDMVTCLEQRKEPYNMKIYETVAKPPDIHQWGIFCLIL

SEQ ID NO: 15683 - protein, 81 aa, Macaca fascicularis
VKESVTFKDVAIDFTLEEWRLMDPTQRNLHKDVMLENYRNLVSLGLAVSKPDMISHLENGKGPWPKPATKNATRTKDISED

SEQ ID NO: 15684 - protein, 81 aa, Macaca fascicularis
FQGPLTFRDVTVEFSLEEWQCLDTVQQNLYRDVMLENYRTLVFLAGIAVSKPDLITCLEQGKEPWNMNRHEMVATPPVFSL

SEQ ID NO: 15685 - protein, 81 aa, Macaca fascicularis
AQVSVTFEDVAVTFTQEEWGQLDAAQRTLYQEVMLETYGLLVSLGCPLFEPELIYQLDRREELWIVKKDLSQSSYPGDNTK

SEQ ID NO: 15686 - protein, 81 aa, Macaca fascicularis
AKGLPSNDTDWPQEKEGKAQIVVPVTFRDVAVIFTEAEWKRLSPEQRNLYKEVMLENYRNLLSLGQGIETILANMVKPHLY

SEQ ID NO: 15687 - protein, 81 aa, Phascolarctos cinereus
IQGLVTFEDVSVDFSRSEWKQLKPAQRDLYKDVMLENYKNLVSLGLQSFKPEVISRLEQGEVPWILADHVPKEFALERIRG

SEQ ID NO: 15688 - protein, 81 aa, Phascolarctos cinereus
WKTPSQQSVTYEDVAVDFTQEEWYLLDLSQKALYRDVMLETYQHLLSLGLPVPKDRGEAPWILEEYQRKSCLDEGTIPQTK

SEQ ID NO: 15689 - protein, 81 aa, Macaca fascicularis
MFKEAVTFNDVAVAFTEEELGLLGPAQRKLYRDVMVENFRNLLSVGHQPFKQDVSPIERNEQLWIVTTATQRQRNLGEKNQ

SEQ ID NO: 15690 - protein, 81 aa, Macaca fascicularis
GLTFRDVAVEFSQEEWKCLDSTQRTLYRDVMLENYRNLVSLDLSRNCMIKELAPQRESNREEVFHTVTLEQHEKHDIEEFC

SEQ ID NO: 15691 - protein, 81 aa, Phascolarctos cinereus
WQESLTFKDVAVDFTQEEWGLLDHSQKRLYKEVMLENSQNLLSLGIPPLREDLISHLEEGEASWILDRKGPRKSCPDAETR

SEQ ID NO: 15692 - protein, 81 aa, Phascolarctos cinereus
QHLVTFRDVAVDFSLEEWRCLSPTQRALYRDVMLEIYDNLVSVGAGLPVSKADVISLLERGAAPQKPKGKVPRGTCPDFGK

SEQ ID NO: 15693 - protein, 81 aa, Phascolarctos cinereus
PSQEAVTFKDVAVDFTQEEWCLLDTSQKALYKDVMLETSQNLLSLGLPVAKADLISHLNQEETWMLKEDDPRNSSIGGETR

SEQ ID NO: 15694 - protein, 81 aa, Phascolarctos cinereus
EELPVVFEDVAVYFTREEWAMLDKRQKELYRDVMRMNYELLASLGPAAAKPELISKLERRAAPWIKDPNGPKWGKGRPPGK

SEQ ID NO: 15695 - protein, 81 aa, Phascolarctos cinereus
AQGLLTFEDVAVIFSQEEWRHLDCVQRALYKDVMWENYRNLASVAGFPFPKPELISSLERGEEPWLPDVLGSSERRRILFF

SEQ ID NO: 15696 - protein, 81 aa, Phascolarctos cinereus
GKESVTFKDVAVEFTQEEWVQLNSSQKKLYKDMMLENYRNLVSLGFAISKPDVIYQLERKEASWMPEADIPRSSCPERRGF

SEQ ID NO: 15697 - protein, 81 aa, Phascolarctos cinereus
GRESVTFKDVAVEFSLEEWVYLNPSQKKLYGDVMLENYRNLVSLGFAVSKPDVIYQMERKEASWMPETDIPRNSCPESKEF

SEQ ID NO: 15698 - protein, 81 aa, Phascolarctos cinereus
PQALVTFKDVAVDFTPEEWRHLDPSQKRLYWDVMLENYRNLVYLGLEGSRPEAVYLLEGGEARWTPEGDVLRSTCPDWKTK

SEQ ID NO: 15699 - protein, 81 aa, Phascolarctos cinereus
GARGPVSFADVAVYFSPEEWGRLSPAQRALYRDVMRETYGHLGALGFPGPKPALISWMEQEAWDSDAKSPEGEWEKAVTCG

SEQ ID NO: 15700 - protein, 81 aa, Phascolarctos cinereus
PKVPLTFDDVAVYFSEQEWGKLDEWQKDLYKHVMRGNYETLVSLDYAISKPEVLSRIEQGKEPCGWRRAGPKNPDIHTDPN

SEQ ID NO: 15701 - protein, 81 aa, Phascolarctos cinereus
SQETVMFDDVAVYFTRKEWMCLDSPQRALYRDVMLENYGNLVCLAGFPVSKPDLIFQLEQGEEPWDLELQGTEEREDTWES

SEQ ID NO: 15702 - protein, 81 aa, Myotis lucifugus
PKVPVTFDDISIYFSTPEWEKLEEWQKELYKNIMKGNYESLISMDYAMNQPDVLSQIQPEGEHNTEDHAGPEESEIPTDPS

SEQ ID NO: 15703 - protein, 81 aa, Puma concolor
QASVVFEDVAVYFTPEEWALLDRGQRKLYRDVMLETCRNLAAVENPVFHNIGDQSQSQERRLRSPLVESVCERIEGDPCGE

SEQ ID NO: 15704 - protein, 81 aa, Puma concolor
TQDSVTFEDVAMYFSWEEWGLLDEAQRWLFHNVMLENFALVTSLGCWHGAGDGEAPSEQSAFVGASQVRTHQASPDPQKAH

SEQ ID NO: 15705 - protein, 81 aa, Puma concolor
PQASVSFKDITVEFTQEEWRQMDSAQRTLYRDVMLENYSHLVSVGYCFTKPELIFTLEQGEDPWLFKKEFLRKGSPEEYQP

SEQ ID NO: 15706 - protein, 81 aa, Puma concolor
PQVSVSFEDVAVLLSWEEWGCLGPAQKGLYRDVMLETYRNLVSLGLQRSKPDVISRLEKGEEPWAPHSLRIEESWIRNHRS

SEQ ID NO: 15707 - protein, 81 aa, Sapajus apella
WLGPLTFMDVAIEFCLEEWQCLDTAQQNLYRNVMLENYRNLVFLGIAVSKPDLITCLEQEKEPWNMKRHEMVAKSSVTCSH

SEQ ID NO: 15708 - protein, 81 aa, Sapajus apella
EKDSVAFEDVSVNFSQEEWALLAPSQKKLYRDVMQETFKNLASIGKKWEDQNVEDQHKNQGKNLRSHMVERLCESKEGSQC

SEQ ID NO: 15709 - protein, 81 aa, Sapajus apella
EMTKFQKAVTFKDVAVVFSSEELRLLDLTQRTLYRDVMVENFKNLVAVDMVSQLEAEEKLWMMEAETQRSRYSGENPAAIL

SEQ ID NO: 15710 - protein, 81 aa, Sapajus apella
AQGLVTFRDVAIEFSLEEWKCLEPAQRDLYREVTLENFGHLVSLGLSIPKPDVISLLEQGKEPWMIANDVTGPWCPDLESR

SEQ ID NO: 15711 - protein, 81 aa, Sapajus apella
PKVPVTFDDVAVYFSEQEWGKLEDWQKELYKHVMRGNYETLVSLDYAISKPEVLSQIEQGKEPCSWRRPGPKIPDVPVDPS

SEQ ID NO: 15712 - protein, 81 aa, Sapajus apella
RGSLLTFEEVAMYFSQEEWELLDPTQKALYNDVMQENYETVISLALFVLPKPKVISCLEQGEEPWVQVSPEFKDSARGSST

SEQ ID NO: 15713 - protein, 81 aa, Sapajus apella
PLTFRDVTIEFSQEEWKCLDPMQKALYKDVMLENYRNLVFLGISPKCMIKELPPTENSNIRERFQTVTLERHQSYNLENLY

SEQ ID NO: 15714 - protein, 81 aa, Sapajus apella
TSKEAVTFKDVAVVFTEEELGLLDPVQRRLYQDVMLENFRNLLSVGHQPFNRDTFYFLREEKFWMMDIATQREGSSGGKIQ

SEQ ID NO: 15715 - protein, 81 aa, Sapajus apella
VHGSVTFRDVAIDFSQEEWECLQPAQKTLYRDVMLENYSHLISLGSSISKPDVITLLEQEKEPWMVRRKETNRWYPDLESK

SEQ ID NO: 15716 - protein, 81 aa, Oryctolagus cuniculus
RLTFRDVAIDFSQEEWKCLDPDQRALYRDVMLENYKNLVSLDICAKIGIKEFLPEDTHHSPLHGSHTGRGSLRTAGVWETR

SEQ ID NO: 15717 - protein, 81 aa, Oryctolagus cuniculus
QVTFRDVTIEFSQEEWDCLDPTQRALYRDVMLENYRTLLSLDIFSKYVTKELPPERNSNLEEIFQTVVLEAQESHEIEEFH

SEQ ID NO: 15718 - protein, 81 aa, Oryctolagus cuniculus
MTFDDVALYFSEQEWEILQKWQKEMYQQVMKANYETLDSLGCIWSKPVLITSIEQGRTLLIRDQGSLDKTRKTTGSCTDDL

SEQ ID NO: 15719 - protein, 81 aa, Pteropus alecto
EEEEVAALRLTARSQASVTFKDVAMDFTPEEWGKLDPAQRDTMLENYRNLVSLYPHLKETDPVWASYTKQQRIQGTQSRKG

SEQ ID NO: 15720 - protein, 81 aa, Oryctolagus cuniculus
RVKNSVHGCLVYSDDALNFRDIYVQSHRFLWEALGCLDPAQRALYRDVVLEHHRTLPSLPEFLTPSIPSAYTALCGSLWFS

SEQ ID NO: 15721 - protein, 81 aa, Phyllostomus discolor
RQLFCESLTFKDVSVDFSWEEWECLDPAQRKLYSDVMLENYSNLVSLGLVVSKPVLVTFLEQMQEIWDVSRKKSISTAPGR

SEQ ID NO: 15722 - protein, 81 aa, Macaca fascicularis
KSKEPVTFKDVAVVFSEEELRLLNLAQRKLYRDVMLENFRNVVSVGHQSTPDGLPQLEREEKLWMMKMATQRDNSSGGKNL

SEQ ID NO: 15723 - protein, 81 aa, Macaca fascicularis
EAVTFKCVAVFFTEEELGLLDPAQRKLYQDVMLENFTNLLSVGHQPFHPFHFLREEKFWMMETATQREGSSGGRTVVEAGP

SEQ ID NO: 15724 - protein, 81 aa, Macaca fascicularis
MLENYGAVASLAAFPFPKPALISQLERGEAPWCSVPWGALDGEDPRSISSGYPFLKPAGISHLEQVEEPLNLKLQEEGPSL

SEQ ID NO: 15725 - protein, 81 aa, Macaca fascicularis
CYQDSVTFDDVAVDFTQEEWTLLDPTQRSLYSDVMLENYKNLATVGGQIIKPSLISWLEQEESRTVRGGVLQGRKTQWRGT

SEQ ID NO: 15726 - protein, 81 aa, Macaca fascicularis
MTFEDIVVDFTREEWALLDTSQRKLFQDVMLENISHLVSIGKRLCKSVVLSHLQHVEKLSTQGMSLLQGREGDIKHQEIPF

SEQ ID NO: 15727 - protein, 81 aa, Macaca fascicularis
PQASVCFEDVAMAFTQEEWEQLDLAQRTLYREVTLETWEHIVSLGLFLSKSDVISQLEQEEDLCRAEQVAPRGARSSKEQR

SEQ ID NO: 15728 - protein, 81 aa, Macaca fascicularis
EMGPLTFMDVAIEFCLEEWQCLDTAQQNLYRNVMLENYRNLVFLGIAVSKPDLITCLEQEKEPWEPMRRHEMVAKPSVMCS

SEQ ID NO: 15729 - protein, 81 aa, Macaca fascicularis
FQGSVSFEDVTVGFSQEEWQHLDPSQRALYRDVMLENYSNLVSVGYCVHKPEVIFRLEQGEEPWRLEEEFPSQSFPEVWTA

SEQ ID NO: 15730 - protein, 81 aa, Macaca fascicularis
RREQVTFEDVVVDFSQEEWGQLKPAQRTLYRDVMLDTFRLLVSVGHWLPKPNVISLLEQEAEPRAVDSGVPPGVYPDLETR

SEQ ID NO: 15731 - protein, 81 aa, Macaca fascicularis
MALVTFRDVAIDFSQKEWECLDTTQRKLYRDVMLENYSNLVSLGYSGSKPDVITLLEQGKEPCVAVRDVTGRQYPGLLSRH

SEQ ID NO: 15732 - protein, 81 aa, Macaca fascicularis
AQESVTFEDVAVNFTNREWQSLTYAQRHLYKHVMLENYGNMVSLGFPFPKPPLISHLERGVEPCVQDPQDRESLSCSYPVS

SEQ ID NO: 15733 - protein, 81 aa, Macaca fascicularis
PQASVCFEDVAMAFTQEEWEQLDLAQRTLYREVTLETWEHIVSLGLFLSKSDVISQLEQEEDLCRAEQVAPRDWKTTLEEN

SEQ ID NO: 15734 - protein, 81 aa, Phascolarctos cinereus
MLENFGNLVCMGLAGSKPDVIHQLEQGEVAWRPREGLSRSSGPDWETRLENKEFISALGTFIEESSREKLRVDRPCVLKLR

SEQ ID NO: 15735 - protein, 81 aa, Phascolarctos cinereus
AKESVTFKDVSVDFTREEWGQLDPAQKNLYRDVMLENYRNLVSLGLQVFKPDVIARLERTEVPWTLENKVLRPSCLDWKRQ

SEQ ID NO: 15736 - protein, 81 aa, Phascolarctos cinereus
PQESVTFGDVAVDFTWEEWGRLGSSQKKLYREVMLENYRNLACLGLAFSKPPLISQLEQGEAAWMPGEESQRAVCADWKSK

SEQ ID NO: 15737 - protein, 81 aa, Phascolarctos cinereus
CQEPVTFRDVVVDFTPEEWGRLGPSQRQLYQDVMLETYRNLVSLGIPVPDCDTLCHLEQVDMLRVGEEADGKPGPEASRPK

SEQ ID NO: 15738 - protein, 81 aa, Phascolarctos cinereus
SFIPLTFQDVAVDFTWEEWGLLEPSQKDMYWDVMLENYENFVSLGGVPVSLPDVISRMERIEAPWMAEGGVLVTTFLDSLS

SEQ ID NO: 15739 - protein, 81 aa, Phascolarctos cinereus
AQELVTYKDVAVDFTPEEWGLLDHAQKELYKTVMLENAQTLLSLGLPVPREDLISHFEQGGLRNCCPDTENRLDVKEMSAH

SEQ ID NO: 15740 - protein, 81 aa, Phascolarctos cinereus
IRAFLTFDDVAVYFSEKEWGNLEEWQKETYKHVMRTNYETLTSLDHAVPKPDLISWIEQGKEPFIKDLVDLKRRETVVTCG

SEQ ID NO: 15741 - protein, 81 aa, Phascolarctos cinereus
GGEAVTFEDVALHFTRKEWTHLDPSQKALYRDVMLENYGNMVWLGFPVSKPDLIHQLEQGEELWALDLQGSEDREETLRTS

SEQ ID NO: 15742 - protein, 81 aa, Phascolarctos cinereus
GKELVTFKDVAVEFTPEEWVQLNPSQKKLYRDVMLENYRNLVSLGFAVSKPDVIYQLERKEASWMPKADIPRSSCPESREF

SEQ ID NO: 15743 - protein, 81 aa, Phascolarctos cinereus
VGHPVTFRDVAVDFSLEEWRCLSPAQRALYRDVMLENYENLVSVGLPVSKPTVISLLEKGEAPWMPQAGAPRGPCPDYLSW

SEQ ID NO: 15744 - protein, 81 aa, Phascolarctos cinereus
LYESVTFQDVAVEFTWEEWVRLNPSQKTLYKDVMLENYRNLVSLGFAVSKPDVIYQLEHKEASWMSEPDFPSSSCPGSKEF

SEQ ID NO: 15745 - protein, 81 aa, Phascolarctos cinereus
AQELVTFQDVAVDFTEEEWGLLDHSQKELYKEVMLENAQNLLSLGLPVTREDLISFFQKGEAPWILEPKGPWNFCPDAVTR

SEQ ID NO: 15746 - protein, 81 aa, Myotis lucifugus
VTFGDLAIYFSQEEWEGLSPQQRGLYKGVMLENYQTLVSLGLCGRKPSMIALLEKGQAPWMERFVRLPCGLGEWSKCETNK

SEQ ID NO: 15747 - protein, 81 aa, Myotis lucifugus
QDMNFEDVAIAFSQEEWGLLNNAQRLLYCDVLLEVFALVSFIGHCHKIDDVEAYSEHSVSVGESQVRASKTAVATQRTHLC

SEQ ID NO: 15748 - protein, 81 aa, Puma concolor
LLFQVTFSDVAIDFSHEEWGWLDSAQRDLYKDVMVQNYENLVSLGLSIPKPYVISLLEDGKEPWMVDKKLSKDWESRWENK

SEQ ID NO: 15749 - protein, 81 aa, Puma concolor
AEGSVTFEDVALYFSWEEWDLLDEDQRCLYHDVMLENFALTSSLGLLLGSSRSLTQLGLGEESSVLPRMDIAPVSMRWAQR

SEQ ID NO: 15750 - protein, 81 aa, Puma concolor
VVTQERLTFRDVAIEFSQEEWVCLDPCLREGTSLENYRNLVSLGKENVPPEVGICPNSSATFVIKELLRKKDINNGELYQS

SEQ ID NO: 15751 - protein, 81 aa, Sapajus apella
PRLPLTFEDVAIYFSEQEWQDLQAWQKEIYKHVMRSNYETLRSLDDGLPKPELIYWIEQGEEPFRNWRESQKSGNIICSSV

SEQ ID NO: 15752 - protein, 81 aa, Sapajus apella
VVFEDVAVDFTLEEWALLDSAQRDLYRDVMLETFRNLASVDDETPCKADRSVSQQDMYRGKISQEQTILNFTRSNSCAYAL

SEQ ID NO: 15753 - protein, 81 aa, Oryctolagus cuniculus
SQSLVEFGDVAIDFSQEEWEWLNPAQRTLYRKVMLENYRNLASLGLCGSKPAVISSLEQGKEPWAVKRKVARGWSPDLKTV

SEQ ID NO: 15754 - protein, 81 aa, Oryctolagus cuniculus
AAGSVTFKDVTMAFTQKEWEQLDPAQRKLYKDVMLENYSNLTSMGYEASKPDMISKLEKGEELWLGKGRRPSQSRLNKVER

SEQ ID NO: 15755 - protein, 81 aa, Oryctolagus cuniculus
SPVLLSFEDVAVYFTWEEWQKLDNTQRTLYRDVMLEIYSNLLSLGYYLTKPEVISKLEQGAEPWNTEESPNQSLPVVQRMD

SEQ ID NO: 15756 - protein, 81 aa, Pteropus alecto
QEGPVTFKDVAVNFSRGEWKKLEPFQKQLYKEVLLENFRNLEFLGFPVSKLDLISQLKWIELPWLLEKEVSKGSKPECNSR

SEQ ID NO: 15757 - protein, 81 aa, Pteropus alecto
MEFTWEEWQLLDPTQRYLYREVILENYRNLVSVGYHGTKPDLIFKLEQGEEPWILSARISHESCAGWKEWYQKNQDELQSI

SEQ ID NO: 15758 - protein, 81 aa, Pteropus alecto
HGSMPFSNVTVAFTHEQWRHLVPAPRDKFKEGIPDKSRNLVLLDRKIVSQSPPEQDISEESCQDTSVEVSPGKSNHRNSDL

SEQ ID NO: 15759 - protein, 81 aa, Pteropus alecto
LLTFEDVAISFSEEEWKLMDPAQKMLYSDVMQENYEAVISLGLKLKKDTGNDQPISTSTLEIQASGCKVLRKARMKVAQKT

SEQ ID NO: 15760 - protein, 81 aa, Oryctolagus cuniculus
MRPGTVWVEGSAVLGTLTQGLRFSQTGGDISKPRVIVKLEQGEEPWVPEGELPCRSRAEEAWKAGAPAERVRAAGGARSAR

SEQ ID NO: 15761 - protein, 81 aa, Muntiacus muntjak
LRLSVTFDDVAVTFTQEEWGHLDPAQRTLYQEVMLENCGLLVSLGCPVPRPELIYQLEHGQELWTVKRDLSRSTCPGDNGK

SEQ ID NO: 15762 - protein, 81 aa, Muntiacus muntjak
MGRLMFQDVAIDLTQEEWECLDLGQRDLYRDVMLETYGNLTSLGLVVSKPDLVTFLEQMKNPWDVRRTDTTATYLGPRSSE

SEQ ID NO: 15763 - protein, 81 aa, Muntiacus muntjak
APVTFGDLAIYFSQEEWEWLSPIQKDLYEDVMLENYQNLVSLGLCFRRPNVITLLERGKAPWMVDPVKRRRGLDLGSKGET

SEQ ID NO: 15764 - protein, 81 aa, Canis lupus
SFEGSVSFRDVAVDFSREEWQHLDLAQRNLYRDVMLETYSHLLSVGYEVPQPEVFMLEQGKEPWALQGESPHQNCPEDLWQ

SEQ ID NO: 15765 - protein, 80 aa, Muntiacus muntjak
MGRLMFQDVAIDFTQEEWECLDLGQRDLYRDVMLETYGNLASLGLVVSKPDLVTFLEQMKNPWNVRRTDTTATYPENANL

SEQ ID NO: 15766 - protein, 81 aa, Canis lupus
RSQESLTFQDVAVNFTREEWDQLYPAQKNLYRDVMLENYRNLVALGHQLYKPEVISQLEQEEQWVMERDSPLESHADGENR

SEQ ID NO: 15767 - protein, 81 aa, Muntiacus muntjak
DLVTFKDVAVDFSQEEWQWLSPAQRGLYRSMMLENYQSLVSLGLCISKPYVISLLEQGKEPWMMMENEMRSPFPDWESIHE

SEQ ID NO: 15768 - protein, 81 aa, Muntiacus muntjak
GQGLVTFRDVALNFSQEEWEWLDSSQKDLYRDVMLENYRNLVWLGLSISKPNMISLLEQGKEPWMVEREMSDGQHADWESW

SEQ ID NO: 15769 - protein, 81 aa, Canis lupus
PVIFRDVAMYFTQNEWQLLEPAQKDLYRDVMLENYGHLASLDKKRRLVLKTFPKPGISMRPSPGKAKEVVQRGSRTERILE

SEQ ID NO: 15770 - protein, 81 aa, Ailuropoda melanoleuca
EFVPLGDAAMDFTLEDWEHLGLDQADLFWDTALDNYQNLFLLNPFKPNLTFHPDGAEEPKVLVRESPESAGPGTAEVKNCL

SEQ ID NO: 15771 - protein, 81 aa, Ailuropoda melanoleuca
LQASLSFEDVAVGFSWEEWQLLAPSQKDLYRDVMLENYRNLVSVGYQASKLDSLFQSEQGGPPWTVEGAAQSHTCPEEIWE

SEQ ID NO: 15772 - protein, 81 aa, Ailuropoda melanoleuca
QGCVTFEDVFVYFSREEWELLEEAQRVLYRDVMLENFALVSSLGKALPMWWEAQLERGRKSWVSDRAFLTLATVRETQRRS

SEQ ID NO: 15773 - protein, 81 aa, Ailuropoda melanoleuca
LQSPVTFEDVAVYFSKEEWGLLDASQRHLYHNVMLENFELMTSLGCWHRVEDEGAHSKQNTSVEGMSQVRIPSANPSTQKA

SEQ ID NO: 15774 - protein, 81 aa, Ailuropoda melanoleuca
QALMAFRDVAVAFTQKEWKLLSPAQRTLYRDVMLENYSHLVSLGKAFSKPRLITQLEQGDEPWREESECLLDLCPGEWTEF

SEQ ID NO: 15775 - protein, 81 aa, Gorilla gorilla
QDTVAYEDLSVDYTQKKWKGLTLSQRALQWNMMPENHYSMASLGENVMKGSELTPKQEIFKGSESSNRTSGGLFGVVPGAA

SEQ ID NO: 15776 - protein, 81 aa, Lynx canadensis
SRGPLSFVDVFVDFTWEEWRLLDPAQKHLYRSVMLENYSHLVSLGYQDTKPDIIFKLEQGEELWMLQAQIPSQGHPEKVLE

SEQ ID NO: 15777 - protein, 81 aa, Lynx canadensis
KPQGLVTFEDVAVDFTHEEWQYLNPSQKSLYREVMLETYSNLVSVGQQVTKPDLILKLEVEEPCLAETKISIWDFPEAYQV

SEQ ID NO: 15778 - protein, 81 aa, Lynx canadensis
YQGPVTFKDVIVEFTREEWQLLDAAQRTLYKEVMRENYGHLVSVGYCVNKPNAVFKLKQGKEPWILEVEFPRRNYPEDLWK

SEQ ID NO: 15779 - protein, 81 aa, Lynx canadensis
KEAFVAFRDVAVDFTREEWSLLSPAQRTLHREVMLETYNHLVSLEIPFSKPKLISQLEQGEEPWIEEKRCPLVLCPGSKLE

SEQ ID NO: 15780 - protein, 81 aa, Lynx canadensis
QKESVTFRDVAVFFSQDEWLRLDSAQRTLYREVMLENYGTLVSLGILFSKPKVIFQLQQGEDPWMVENGVSQDPRVGWESL

SEQ ID NO: 15781 - protein, 81 aa, Lynx canadensis
FHESVTFKDVIVDFTQEEWKQLDPVQRDLFRDVTLENYTHLVSIGLQVSKPDVISQLEQGTEPWVVESGVPGATGGDRDIG

SEQ ID NO: 15782 - protein, 81 aa, Lynx canadensis
VPSGSAHILCDFPSTGYHGTKPDLIFKLEQGEEPWIINAKVSRQSCPEDWKEWYQKNPDDLENVERTYACSAFGKLNLSRT

SEQ ID NO: 15783 - protein, 81 aa, Lynx canadensis
MGLAQLTCRFPFTGCCVPKPDVIFRLEQGQQPWLVEEESLDQIWPEVCRVDNQLEQNQEIQHRHFWQAPFINNKTLTVHRG

SEQ ID NO: 15784 - protein, 81 aa, Lynx canadensis
MLENYRNLVSVGYLASKPDALSKLEGGELWTAEDEIDSRICPEIRKVDDPLQCRLQNRSIQKSVEQCCEHNTFASIFNQSE

SEQ ID NO: 15785 - protein, 81 aa, Phyllostomus discolor
SEVSVSFEDVTVDFSREEWQHLDPVQRCLYRDVTLENYNHLLSVGYQVPKPEVIFKLEQGEGLWTLEGETPHQSCSDEDIG

SEQ ID NO: 15786 - protein, 81 aa, Phyllostomus discolor
IKWLVTFRDVAIDFSQEEWNYLDPAQRDLYREVMMENYSNLVLLGLSISKPDVISLLEQGKEPWMQRNMAGGWCPGLELGC

SEQ ID NO: 15787 - protein, 81 aa, Phyllostomus discolor
MEAVTFGDVAVHFSREEWQCLDPGQRALYKEVMLENHSSVAGLGFLLFKPELISRLEQGEEPWVLDLQGTEGRELPRTPQT

SEQ ID NO: 15788 - protein, 81 aa, Phyllostomus discolor
TVQEPVTLRDVAVLFTQEEWAQLSPVQRRLYQDVMLENCSHLASLGLLGPKPDLFAQLGKGEEWTSEVASGGFCLDWMPLP

SEQ ID NO: 15789 - protein, 81 aa, Phascolarctos cinereus
RTTAVTFKDVAVDFTQEEWGQLDPAQRNLYRDVMLENYENLVSLGLPVSKPDVISQLEKGKVPWVQDGESLKDICPDSVIQ

SEQ ID NO: 15790 - protein, 81 aa, Myotis lucifugus
GSVTFKDVIVEFTKEEWQLLDEAQRALYKEVMQENYRHLVSVGYFVNKSNAVLKLKQGKEPWILEVEFPRQNYTDLWKIHE

SEQ ID NO: 15791 - protein, 81 aa, Myotis lucifugus
EDMNFEDVAIAFSSEEWAILDEAQRLLYCEVMLEVFALGSSVGCWHQKYDDDACSEQSVSVGGESQVMFSRRAPATQKTHL

SEQ ID NO: 15792 - protein, 81 aa, Oryctolagus cuniculus
AQGSVTFEDVTVHFSWEEWRLLDEAQRCLYRDVMLENLALISSLGCLRGVEDEEVPSEQSASLEGVSQIRTSKATCTEESN

SEQ ID NO: 15793 - protein, 81 aa, Oryctolagus cuniculus
ILQVMIAFEDLAVYFTWEEWQKMNNAQKILYRDVMLETYSSLFSLVVMKRDDLIRINQESHDKNLNQDFMKNNKTSALKRV

SEQ ID NO: 15794 - protein, 81 aa, Oryctolagus cuniculus
QSRASPFKDMILCFSEEDWSLLDPGQTGFYGEFIIGEDCGVSVTPNDPAALPGPFQGEERELLPELLELQGKEAPQASPTD

SEQ ID NO: 15795 - protein, 81 aa, Oryctolagus cuniculus
LQVLVSFEDLAVDFTQEEWQDLDNAQKTLYKDVMLETYSSLLSLGHCIIKPDLIYKLEQGAEPWIVEKSLKQSLPGQSTHI

SEQ ID NO: 15796 - protein, 81 aa, Oryctolagus cuniculus
KTQELLTLEDVAVEFTWEEWQLLSPAQKALYRDVMLENYSSLVAVGYQASKPDALSKLERGEPWTVEDDIHSHIRREIKTV

SEQ ID NO: 15797 - protein, 81 aa, Oryctolagus cuniculus
MITFEDLAVYFTWEEWQNMNKAQKILYKDVMLETYSSLFSLGQCISKPDLIVKLEQGAEPWMMEECLNQSPPVSIKRDGLP

SEQ ID NO: 15798 - protein, 81 aa, Pteropus alecto
AQDLVTFEEVVVDFSQEEWALLDPAQKMLYRDVMLENLRNLASVGAGYHLCKHSLITEVEQEELRTEDRSLRGARSVTIMY

SEQ ID NO: 15799 - protein, 81 aa, Ailuropoda melanoleuca
QVSVTFEDVAVLFTRDEWRKLGPSQRNVYQEVMLENYTNLVSLGLLFSKPKVISLLQQGEDPWKVEKESPGGPSLGWKSSH

SEQ ID NO: 15800 - protein, 81 aa, Ailuropoda melanoleuca
FQESVMFSDVSIDFSEEEWECLNDDQRDLYRDVMLENYSHLVSMAGHSVSKPDVISFLEQGKEPWLVDRELTRDHWPVLES

SEQ ID NO: 15801 - protein, 81 aa, Gorilla gorilla
LFQVTFSDVAIDFSHEEWGWLNSAQRDLYKDVMVQNYENLVSVGLSVTKPYVITLLEDGKEPWMMEKKLSKGMIPGWESRW

SEQ ID NO: 15802 - protein, 81 aa, Ailuropoda melanoleuca
QRESVTFKDVAVDFTQEEWHHVDPAQRRLYRDVMLENYSHLVSLDWKTRPEAKSSHLQQSVSAGSRSTDGLSHATLESTWV

SEQ ID NO: 15803 - protein, 81 aa, Ailuropoda melanoleuca
QVHLTFEDVAVYFSQEEWGLLDEAQRHLYHTVMLENLALIASLGWWHGVKAEEALSEQCVFVERVSQANTPDPGLSIPKAH

SEQ ID NO: 15804 - protein, 81 aa, Gorilla gorilla
LFQVTFSDVAIDFSHEEDLYKDVMVQNYENLVSVGLSVTKPYVITLLEDGKEPWMMEKKLSKGMIPGWESRWENKELSTKK

SEQ ID NO: 15805 - protein, 81 aa, Gorilla gorilla
FQGVLTFRDVAIEFSLEEWHCLDTLENTLQGIIQENFPNLASKWSNRLFLFLAVVYSYFAQDFWPKQGIKNCFQKVILRRY

SEQ ID NO: 15806 - protein, 81 aa, Ailuropoda melanoleuca
AKELLTLEDVAVDFTWEEWQLLGPAQKDLYRDVMLENYSNLVSVGCQATKPDALSKFEHRDELWLTEDEIQNRTHPGFGNF

SEQ ID NO: 15807 - protein, 81 aa, Ailuropoda melanoleuca
YREVMLENYGNLVSVGYQLSKPSVISQLEKGQEPWMTEKEGPGDPRSDLKNKTETDASAAKNDILQEHLYHGIMMEGFLRD

SEQ ID NO: 15808 - protein, 81 aa, Desmodus rotundus
KPRAMKFADVAVYFSPEEWGCLRPAQRALYRDVMKETYGHLGALGCAGPKPALISWLERNTDDWEPAALDPQECPSGLTVQ

SEQ ID NO: 15809 - protein, 81 aa, Desmodus rotundus
SPTLVTFKDIHVNFTREEWKLLDAAQQIMYKDVMLENYKNLVSLGHQLPKPAVILQLEKGEEPWLVEREIRQDTHPDWDTA

SEQ ID NO: 15810 - protein, 81 aa, Macaca fascicularis
DTVVFEDVVVGFTLEEWALLNPAQRNLYREVMLETFKHLASVDNEAQPKTNGSISQQDTSGEKLSLKQKIEKFTRKHTWAS

SEQ ID NO: 15811 - protein, 81 aa, Macaca fascicularis
IQDSVVFEDVAVDFTQEEWALLDLAQRNLYREVMLENFQNLASLGYLLHTPHLICQWEQEEDLQRVKRELIQVIFMGEHQE

SEQ ID NO: 15812 - protein, 81 aa, Macaca fascicularis
EKGPLTFRDVAIEFSLEEWQCLDTAQQDLYRKVMLENYRNLVFLAGIAVSNPDLITCLEQGKEPWNMKRHVMADEPPGWSA

SEQ ID NO: 15813 - protein, 81 aa, Macaca fascicularis
LKGLVTFEDVAVEFTQEEWALLDPAQRTLYRDVMLENFRNVASLGDQVDKPGLITQLEQEDEVMTEERGILPGTCSDVENP

SEQ ID NO: 15814 - protein, 81 aa, Macaca fascicularis
SQTLVTFKDVFVDFTREEWKLLDTAQQIVYRNVMLENYKNLVSLGYQLTKPDVILRLEKGEEPWLVERGIHQEAHPDSETA

SEQ ID NO: 15815 - protein, 81 aa, Macaca fascicularis
MAFEDVAVYFSQEEWGLLDTAQRALYRHVMLENFTLVTSLGLSTSRPHVVIQLERGEEPWVPSGKDMTLARNTYRRLNAGE

SEQ ID NO: 15816 - protein, 81 aa, Macaca fascicularis
RPESVTFEDVAVYFSENEWIGLGPAQRALYRDVMLENYGAVASLAFPFPKPALISQLERGEAPWCSVPWGALDGEDPRSIS

SEQ ID NO: 15817 - protein, 81 aa, Macaca fascicularis
PKVPVTFDDVAVYFSELEWGKLEDWQKELYKHVMRGNYETLVSLDYAISKPDILTRIERGEEPCLDGWGQEKQNEVEVGHP

SEQ ID NO: 15818 - protein, 81 aa, Phascolarctos cinereus
AQELVTFKEVAVDFTQEEWGLLDHPQKELYKEVMLENAQNLLSLGLPVPRQELISYFEEKEAPWLLEQEGLRSCCPEKEIR

SEQ ID NO: 15819 - protein, 81 aa, Phascolarctos cinereus
AQGLVTFKDVVVDFTPEEWGLLDHSQKELYKEVMGENARNLLSLGLPVPREDSISHLGQGEAPWMLEIEDPRTSCPGGKMG

SEQ ID NO: 15820 - protein, 81 aa, Myotis lucifugus
MNFEDVAIDFSEEEWGLLDEAQRLLYCNVMLDVFALVSSAGCWHITDDEEACSEQSISVQGQSQVTVSKTEPATQKTHLCK

SEQ ID NO: 15821 - protein, 81 aa, Myotis lucifugus
LPSSKVPTFSNKDSLGDEMLAAALLKAKSQELVTFEDVAVYFIRKEWKRLEPAQRDLYRDVMLENYGNVFSLGLPFLYFDI

SEQ ID NO: 15822 - protein, 81 aa, Puma concolor
GWVPALFDEVAIYFSDEEWEVLTEQQKALYREVMRMNYETVLSLEFPFPKPDMITRLEGDEESQNSDEWQLQGGTLAENEE

SEQ ID NO: 15823 - protein, 81 aa, Puma concolor
CEVSVSFEDVTMDFSREEWEQLGPTQRCLYWDVMLEICSHLLSLGYPIPRPEMIFRMEKEEEPWIREAQLPHQWRPEGEFG

SEQ ID NO: 15824 - protein, 81 aa, Puma concolor
PKVPVTFDDISIYFSTPEWEKLEEWQKELYKNIMKGNYESLISMDYAMNQPDVLSQIQPEGEHNTEEQAGPEDSEIPTDPS

SEQ ID NO: 15825 - protein, 81 aa, Puma concolor
RTCAEGPERLLRPSRKRALSFLRPWRHLLRNQPSGLGDFGLIDHVGLSIPKPEVILKLEQGEEPWILESPGQSDPELINSS

SEQ ID NO: 15826 - protein, 81 aa, Puma concolor
LQVSVSFEDVTVNFSREEWQHLDPAQRRLYRDVTLENYSHLRSVGYQVPKPEVIFKLEQGEGPWTLEGETPHQSCSGEDIG

SEQ ID NO: 15827 - protein, 81 aa, Sapajus apella
CQESVTFEDVAVVFTDEEWSHLVPIQKDLYKEVMLENYKSVVSLGLPVPQPDMIFQLKRGDEPWMVDLHGSEETEWPKSVS

SEQ ID NO: 15828 - protein, 81 aa, Sapajus apella
QVSITFKDLAVRFSEEEWRLLEEGQREFYRDVMRENYETLVSVGTAELLPLSAFLSPPEPGGAVGGGSRTDEGQEPAGCGG

SEQ ID NO: 15829 - protein, 81 aa, Sapajus apella
RRGPLTFRDVAIEFSQEEWRCLDPAQRTLYRDVMLENYRNLVSLGICLPDLSIISMMKQRTEPWTVESEMKVAKNPGRWEG

SEQ ID NO: 15830 - protein, 81 aa, Sapajus apella
MGPLTFRDVAIEFSLEEWQCLDTAQQDLYRKVMLENYRNVAFLAGIAVSKPDLITCLEQGKEPWNMKRYEMVDEPPATCSY

SEQ ID NO: 15831 - protein, 81 aa, Sapajus apella
QDSMTFEDIVVDFTREEWALLDTSQRKLFRDVMLENISHLVSIGNQFCKSVVFSQGIRLPQGKEGDIKHQEIPFIQHIDQK

SEQ ID NO: 15832 - protein, 81 aa, Sapajus apella
CVYVFQGVLTFMDVAIEFSLEEWQCLNTAQQNLYRNVMLENYRNLVFLDLITCLEQGKEPWNVTRHEMVAEPPGSLSAVIK

SEQ ID NO: 15833 - protein, 81 aa, Sapajus apella
FQAKLTFEDVAVLLSQDEWDRLGPAQRGLYRNVMMETYGNVVSLGLPISKPDLISQLERGEDPWVLDGKGAKESQGLWSGH

SEQ ID NO: 15834 - protein, 81 aa, Sapajus apella
AQSSVTFEDVAVNFSLEEWNLLNEAQRYLYRDVMLETLTLISSLGCWHGGEEEAASSKQSTCIHVYKDQRVHNGEGPYECG

SEQ ID NO: 15835 - protein, 81 aa, Sapajus apella
GPVTFKDVAVVFTEAEWKRLSLEQRNVYKDVMLENLRNLVSLESKPEVHTCPSCPVVFGSQQFLSQDELHNHPIPGFYAGN

SEQ ID NO: 15836 - protein, 81 aa, Sapajus apella
ESFMAFGDVTVDFTQKEWRLLSPAQRALYREVTLENYSHLISLGIYAECVLPPKNLGLAHQRQHQLQFSDQSCQSDTAEGQ

SEQ ID NO: 15837 - protein, 81 aa, Sapajus apella
ASETLTFRDVAIEFSLEEWQCLNPAQQNLYRNVMLENYRNLVFLAGIAVSKQNPVTCLEHGKEPWNMKRYEIMAKPTAMCS

SEQ ID NO: 15838 - protein, 81 aa, Sapajus apella
QGHLTFSDVAIEFSLVEWKCLTPAQRALYRDVMLENYRNLESVDISSKCMRKMVSSTGQGNTEMFHTRTLETHESHHTGDF

SEQ ID NO: 15839 - protein, 81 aa, Sapajus apella
MDSVASEDVAVNFTLEEWALLDPSQKKLYRDVMRETFRNLACVGKKWEDQSIEDWYKNQGRILSNHAGVGLSESKEHDQCG

SEQ ID NO: 15840 - protein, 81 aa, Sapajus apella
ACIFQGALTFRDVAIEFSRKEWQCLDTAQQNLYRTVMLENYRNLVFLGIAASKPDLITCLEQGKEPWKVKRHEMVAESPGR

SEQ ID NO: 15841 - protein, 81 aa, Sapajus apella
MLENYRNLVCLGLAISKPDLITFLEQRKEPWNVKSAETVAIQPDMFSHYNKDLLTEHCTEASFQKVIPRTHESCDLENLHI

SEQ ID NO: 15842 - protein, 81 aa, Sapajus apella
MGPLTFMDVAVEFSLEEWQCLDTAQRHLYRNVMLENYRNLVFLGIAVSKPDLITCLEKEKEPWNMKRHGMVDKPPVTFFHF

SEQ ID NO: 15843 - protein, 81 aa, Oryctolagus cuniculus
LQEVVTFQDVAVVFSEEELRLLDTAQRALYRAVMLENFRNLLSVGEDGRARILGVTLCSDLVCPGIKALESHLGEKSHTRC

SEQ ID NO: 15844 - protein, 81 aa, Oryctolagus cuniculus
PQESVTFKDVAVDFTREEWHHVDSAQRTLYKDVMLENYSHLVALGYQVSKPEVIFKLEQGEEPWISEGEIQRRFCADWKTR

SEQ ID NO: 15845 - protein, 81 aa, Oryctolagus cuniculus
MTKPDLIFKLEQGAEPWMGKECLHHSLPVAMKRDDLISKNQKSQDKNLNQNVMKNNKTSTPKIIELRKTLRLSSNHIPKLS

SEQ ID NO: 15846 - protein, 81 aa, Oryctolagus cuniculus
MHQCWFLNVLMTFKLLAMTFTWEEWRQLDQDQKHLYQEVMMETCRHLVSLGRAHLSLPPFLSHSGLEKAFWSQASHAGVWS

SEQ ID NO: 15847 - protein, 81 aa, Canis lupus
CWGLLSFKDISMEFTWEEWQLLDSAQKYLYRDVILENYSHLVSLGYHGTKPDLIFKLEQGEEPWMINAKVSRQSYPELRED

SEQ ID NO: 15848 - protein, 81 aa, Canis lupus
VMFNDVSIVFSQEEWEYLDLEQKDLYRDVMLENYSNLVSLDLENRYETKKLSSENDVYEINLPQWKIMERIKNHGLKGLIL

SEQ ID NO: 15849 - protein, 81 aa, Canis lupus
SQDLVTFKDVAIDFSQDEWEWLNPVQRNLYKNMMLENYQNLVSLGLCISKPYVISLLEQGKEPWEMKTEMTRSPFPDLGST

SEQ ID NO: 15850 - protein, 81 aa, Canis lupus
RPGAVSFADVAVYFSPEEWGCLRPAQRALYRDVMRETYGHLGALGCAGPKPALISWLERNTDDWEPAALDPQECPRRVTVQ

SEQ ID NO: 15851 - protein, 81 aa, Ailuropoda melanoleuca
GSVSFTDVTVDFTQEEWEQLDPSQRILYMDVMLENYSNLLSVEVWKADDQMERDHRNPDEQARPFIIFKNQTPMEERGNLF

SEQ ID NO: 15852 - protein, 81 aa, Gorilla gorilla
DPEQVTFEDVVVDFSQEEWGQLKPAQRTLYHDVMLDTFRLLVSVGHWLPKPNVISLLEQEAELWAVDSGLPQGVYPEIKGH

SEQ ID NO: 15853 - protein, 81 aa, Ailuropoda melanoleuca
QGCVTFEDVTIYFSQEEWGLLDEAQRLLYCDVMLENFALIASLGLTAFRSHIVAQLQMGAEPWVPDRVDMTSAMARGVYSG

SEQ ID NO: 15854 - protein, 81 aa, Phyllostomus discolor
NMGSVSFEDVAVDFTRQEWQQLDPAQRTMHKDVMLENYSNLASVGLCVAKPEMIFKLEQGEELWVLEEESSGHGYPGSLSL

SEQ ID NO: 15855 - protein, 81 aa, Phyllostomus discolor
CWGLLSFKDISMDFTWEEWQLLDSAQKYLYRDVILENYRNLVSVGYHGTKPDLIFKLEQGEEPWIRNAKISRPRCSEGWKE

SEQ ID NO: 15856 - protein, 81 aa, Phyllostomus discolor
FQEPVSFRDVAVDFTQEEWQQLDPVEKTTYRDVMLENYSHLVSVGYDSTKPHVIVRLEQGEEPWVAEGDFPCQSCPEGTWK

SEQ ID NO: 15857 - protein, 81 aa, Phyllostomus discolor
MASPSPSLEPKEEWDYLDPAQRSLYKDVMMENYGNLVSLDVLNRDKDEEPTVKQEIEEIEEEVESKGIIVTRIKSETDQDP

SEQ ID NO: 15858 - protein, 81 aa, Phyllostomus discolor
LVEPVSFKDVYVDFTKEEWYLLDPAQKILYRDMMLENYSHLVSVGYCITKPEVIIKIEQGEEPWILKQGFPSQCHPENWKV

SEQ ID NO: 15859 - protein, 81 aa, Puma concolor
PRSLENDGGCFSEQEWENLEDWQKELYRNVMKSNYEALVSLKVLGPPEEEAELGTGMLGDLEEEGPGDVHPAEGVMIKQEI

SEQ ID NO: 15860 - protein, 81 aa, Puma concolor
TVTFKDVAVVFTEEELVLLDKAQIHLYQDVMLENFRNIVSVGDRIKDNISHLQGKGLSYLSPEGLYRWPIWKQRISELTGS

SEQ ID NO: 15861 - protein, 81 aa, Puma concolor
FQDLVTFGDVAVDFSQEEWEWLNPAQRNLYRKVMLENYRSLVSLGVSVSKPDVISLLEQGKEPWMVKKEGTRGTYPDWEYA

SEQ ID NO: 15862 - protein, 81 aa, Puma concolor
MIKSQISFEDVAVDFTLEEWRLLNPTQKNLYRDVMLENYSNLVFLGYQIIKPHGIFKLEQEEPWIIDEVLSQNFSEVWLDN

SEQ ID NO: 15863 - protein, 81 aa, Puma concolor
SQESVTFEDVAVDFTQEEWTLLDWSQRKLFRDVMLENISHLVSVGKQLYKLDTIFHLEQGEQLSTEGIGLLQFQSLGREDD

SEQ ID NO: 15864 - protein, 81 aa, Puma concolor
AHRSVTFRDVAIHFSQQEWEYLDSVQKNLYRDVMMENYDNLVSLEHSISKPDVITLLEQRKEPWMVVREDTKRWCTDLESK

SEQ ID NO: 15865 - protein, 81 aa, Puma concolor
ARELVTYEDVAVDFTQEEWQHLDPAQKILHRDVMLEIYSHLVSVGCSGISPGIIFKLEHEEDPWIMKSELSRWIHSDREKS

SEQ ID NO: 15866 - protein, 81 aa, Sapajus apella
MLLDPTQRNLYRDVMLENYKNLATVGCQLLKPSLISWLEQEESRTVQRGDFYEWKVQLKTKELALQQDFLGEPTSSGIQMM

SEQ ID NO: 15867 - protein, 81 aa, Sapajus apella
FQGQLTFNDVTIEFTLEEWQCLDKTQQNLYREVMLENYRNLVFLGIAVSKPDLITCLKQGKEPWNIRRHEMVTKPPAMCSH

SEQ ID NO: 15868 - protein, 81 aa, Sapajus apella
EMGPLTFRDVAIEFSLEEWQCLNTDQQDLYRKVMLENYRNLVFLAGIAVSKADLITCLQEEKDPWNMKRHSMVAKPPVIYS

SEQ ID NO: 15869 - protein, 81 aa, Sapajus apella
MQENYETVISLALFVLPKPKVISCLEQGEEPWVQVSPEFKDSARGSSTGLKLKNDTENHQPVSLSDLEIQAPADIISKKAK

SEQ ID NO: 15870 - protein, 81 aa, Sapajus apella
MLENYGNVASLGFPLLKPAVISQLEGGGELGAPSPLAAGTGLHGLRTDIQTDSDFTKEMYYGKEDVSFELQRDFSQETGFL

SEQ ID NO: 15871 - protein, 81 aa, Sapajus apella
SQESVSFKDVTIEFTQEEWQQMAPVERNLYRDVMLENYSHLVSVGYCLFKPEVIFKLERGAEPWFSEEEFSNKSHPKDYRG

SEQ ID NO: 15872 - protein, 81 aa, Sapajus apella
MLENYRNLVCLGLAVSKPDLITFLEQRKEPWNAKSAETVAIQPDMFSHYNKDLLTEHCTEASFQKVIPRTHESCDLENLHI

SEQ ID NO: 15873 - protein, 81 aa, Sapajus apella
MGPLQFRDVAIEFSLEEWHCLDTTQRNLYTDVMLENYRNLVFLGIVVSKPDLITCLEQGKKPLTVKKREMIATPPVMCSHL

SEQ ID NO: 15874 - protein, 81 aa, Sapajus apella
MELLTFRDVAVEFSSEEWKCLDPAQQNLYRDVMLENYRNLVSLGVVISNPDLVTYLEQRKEPYNLKIHETAAKPPATCSPF

SEQ ID NO: 15875 - protein, 81 aa, Sapajus apella
ACVFQGLLTFRDVAIEFSLEEWQCLDTAQRNLYKNVILENYRNLVFLGIAVSKPDLITCLEQEKEPLIMKKDEMADEPPGK

SEQ ID NO: 15876 - protein, 81 aa, Sapajus apella
QASVALEDVAVNFTREEWALLGPCQKNLYKDVMQETIRNLDCVGMKWKDQNIEDQYRYPRKNLRCYMLERFGESKDGSQCG

SEQ ID NO: 15877 - protein, 81 aa, Sapajus apella
TQGQVTFRDVAIEFSQEEWTCLDPAQRSLYRDVMLENYRNLASLAGISCFDLSIISMLEQRKEPFTLESQVQIAGNPDGWE

SEQ ID NO: 15878 - protein, 81 aa, Sapajus apella
RVTFKDVAVVFTKEELALLDKTQINLYQDVMLENFRNLISVGDRIENNILNLQEKGLSYLSQEVLHCWQIWKQRIWDLTVS

SEQ ID NO: 15879 - protein, 81 aa, Oryctolagus cuniculus
AQVSRPLPACLGVRTQEEWRQLEPAQRRTYREVMLENYSHLVAVGGDISKPRVIVKLEQGEEPWVPEGELPCRSRAEEAWK

SEQ ID NO: 15880 - protein, 81 aa, Oryctolagus cuniculus
EAVTFKDVAVAFTEEELGLLDPAQRKLYQDVMVENFWNLLSVGHRPCQQGIPHVLSEREAKLWGMKTAVHRGRNLDIFVVK

SEQ ID NO: 15881 - protein, 81 aa, Oryctolagus cuniculus
SSALVSFEDLAVDFTWEEWQDLSHAQRILYKDVMLETYSSLLSLGYCITKPDLIFKLEQGEEPWIVQEYLNPNLKVSQERD

SEQ ID NO: 15882 - protein, 81 aa, Canis lupus
ALLNPSQKKLYRDVMQETFRNLASIGDRWKGNSLKTPFMIITFDNSNDHLLAEHLGYTHFQTVHVIERPCKNKEGSKCGES

SEQ ID NO: 15883 - protein, 81 aa, Canis lupus
SLGSVSFKDVTVDFSREEWQQLDLAQKSLYRDVMLENYFNLISVGCQVPKPEVIFNLEQEVLRMLAGDICSHSHHDGDIGF

SEQ ID NO: 15884 - protein, 81 aa, Canis lupus
VTFTDVAVNFTEEEWALLDSTQRNLYRDVMLENCRNLASVDLMSQHKTQNSTPQQDILAKKTLDEANRVCAVNNSSQFSLL

SEQ ID NO: 15885 - protein, 81 aa, Gorilla gorilla
SQGTVTFKDVAIDFTQEEWKRLDPAQRKLYRNVMLENYNNLITVGHPFTKPDVIFKLEQEEEPWVMEEEVLRRHWQGEIWG

SEQ ID NO: 15886 - protein, 81 aa, Ailuropoda melanoleuca
LKSKQGSMSFEDVIVEFTQDEWQYVSPAQRTLYRDVMLENYSHLISVGYCTTKPEMIFKLEQGEKPWSLEEEFLNQTYPGG

SEQ ID NO: 15887 - protein, 81 aa, Ailuropoda melanoleuca
QIKRDMLLQGLLSFSDVTVDFTWEEWQLLDTVQRNLYRDVMLENYSNLMSLGYQATRPEATVHLEKEQGMVEREFPSQRSP

SEQ ID NO: 15888 - protein, 81 aa, Lynx canadensis
MESVTFEDVAVGLLREWALLDGARTNLCRYVILDKCRTLAPKGTPPRKPSLGSQLGPGAELRPRGVDWDSRLKSQASPPVQ

SEQ ID NO: 15889 - protein, 80 aa, Lynx canadensis
MTSGLLTFRDVAIEFSQEEWGCLSHSQQELYRDVMLENYGHLLFLGLVLSKPDLVIFLEQKELWDVKRNHTVTSHPGRWE

SEQ ID NO: 15890 - protein, 81 aa, Lynx canadensis
LPHSVTFEDVAVEFTQEEWALLDPSQRTLYRDVMQENCRNLASLGCHVDKPSLTSQLEQEDKVMTQERGILPGTCPGLETV

SEQ ID NO: 15891 - protein, 81 aa, Lynx canadensis
MAVTFEDVTVIFTWEEWKFLDSSQKKLYREVMWENYTNVMSVGNWKESYKPQEERFRYLEHENHPCWQGWRSASTQIYKNR

SEQ ID NO: 15892 - protein, 81 aa, Lynx canadensis
AQGSVVFSDVSVDFSQEEWECLDSGQRDLYRDVMLENYSNLLSMGFYIPKPQVISLLEQGKEPWMVGRELTKGLCSDLESM

SEQ ID NO: 15893 - protein, 81 aa, Phyllostomus discolor
KDQELLKLEDVAVDFTWEEWQLLDPDQKDLYRDVMLENYRNLVSVGYPASKPDTLSRLEQGELWTIEDEFHSGICSEIKKN

SEQ ID NO: 15894 - protein, 81 aa, Phyllostomus discolor
KPGSVSFADVAVYFSSEEWGCLRPAQRALYRDVMRETYGHLGALGFPGPKPDLISWMEQESEAWSTDAQDPEEGESVGGAL

SEQ ID NO: 15895 - protein, 81 aa, Phyllostomus discolor
FQEAVTFKDVAVVFTEEELGLLDPSQRKLYQDVMVENFRNLVSVGDKTLNNMEIIQEVGLKYLPHEEFFCSQIWQQITKDL

SEQ ID NO: 15896 - protein, 81 aa, Phyllostomus discolor
MITSQISFEDVAVDFTLEEWRLLNPTQRNLYRDVMLETYSNLVFLGHQSVKPDAVFKLEQEPWTVNEEIVSHHFSEELWID

SEQ ID NO: 15897 - protein, 81 aa, Phyllostomus discolor
AEVGVTFEDVAVYLSRTEWLLLDEAQRRLYFDVMLENYTLISSLGCCCGVENLEAPTEQNITVRVSKAMNLKSTLSSQESH

SEQ ID NO: 15898 - protein, 81 aa, Phyllostomus discolor
AQESVMFSDVSIDFSQEEWECLNDDQRDLYRDVMLENYNNLVSMGHSISKPDVISFLEQGKEPWLVNREVTGGQCPVLGSR

SEQ ID NO: 15899 - protein, 81 aa, Phascolarctos cinereus
LQGSVTFQDVAVDFSWEEWGHLGPAQKELYREVMLENYGNLVCLGLAVSSPDVVCQLERGEGPWMPEGDVPGSSCAGWETK

SEQ ID NO: 15900 - protein, 81 aa, Phascolarctos cinereus
VQEAVTFKDVSVDFTQEEWGFLSPVQRELYREVMLENYRNLVSLGLLDPTSGSISWLKEAEEPLAQDLQGRAPRSAHPPEG

SEQ ID NO: 15901 - protein, 81 aa, Myotis lucifugus
KSQDMIFEDVAVAFSQEEWELLDEAQRRLYCDVMLEVFALLSIGGHWHKMDDVEAYSEHSVSVGESQVRASKTAAATQRTY

SEQ ID NO: 15902 - protein, 81 aa, Myotis lucifugus
GDVNFEDVAIAFSEEEWVILDEAQRLLYCDVMLEVFAVVSSVGCWHKMEDEEACSDQRVCIQGESQVRASKTAPATHKNHL

SEQ ID NO: 15903 - protein, 81 aa, Puma concolor
YQELVTFRDVAVDFSREEWDCLNSSQRHLYSNVMLENYRILVSLGLCFSKPSVILLLEQGKEPWMVTRELAKGLCSGWESR

SEQ ID NO: 15904 - protein, 81 aa, Myotis lucifugus
QELVTFGDVAVDFSQEEWDCLNSSQRHLYSNVMLENYRILVSLGLCFSKPSVILLLEQGKEPWMVKKELAKDLCSGWESVC

SEQ ID NO: 15905 - protein, 81 aa, Puma concolor
SHALVTFKDVLVNFTREEWKLLDTAQQIMYKDVMLENYKNLVSLGHQLPKPDVILQLEKGEEPWLVERGTHRETHPDLDTA

SEQ ID NO: 15906 - protein, 81 aa, Myotis lucifugus
RDMNFEDVAIAFSQEEWGLLDEAQRHLYCDVMLEVFALVSFVGHWHKMDDVEAYSEHSVSVGESQVRASKTGVATQRTHLC

SEQ ID NO: 15907 - protein, 81 aa, Puma concolor
GCVTFEDVFVYFSREEWELLEEAQRLLYRDVMLENFALVASLDCWREADNEETPEQNVSVGVSQLRTPESGPFVQKAHPCE

SEQ ID NO: 15908 - protein, 81 aa, Puma concolor
SQGLVTFEDVAVYFSLEEWERLDAGERDLYKDVMQENYGILVSLGYPIPKPDLIFRLEQGEEPWVPDSPRPEEGDIVTGVY

SEQ ID NO: 15909 - protein, 81 aa, Sapajus apella
MLENYRNLVFLGIAACKPDLITCLEKAKEPWKMKRHAMVDEPPGIFPHFAQHLWPEQGMEDSLQKVILRRDEKCGHENLQF

SEQ ID NO: 15910 - protein, 81 aa, Sapajus apella
MEPLTFKDVAIEFSLEEWQCLDNAQRDLYRHVLLENYRNLVFLGIAVCKPYLITCLEQKKEPWNMKRREMVAKTPVMCFHF

SEQ ID NO: 15911 - protein, 81 aa, Desmodus rotundus
PKVPVAFDDISIYFSTPEWEKLEEWQKELYKNIMKGNYESLISMDYAMNQPDVLSQIQPEGEHNTEDQAGPEESAIPTDPS

SEQ ID NO: 15912 - protein, 81 aa, Desmodus rotundus
QGRVVLEDVAIHFSQEEWGLLDEAQRHLYHSVMLENLALLSSIGCWPGAQEEEVPLGQGDSVRVSQVQTPNQDPCTQKSHS

SEQ ID NO: 15913 - protein, 81 aa, Desmodus rotundus
VTLEDVAVYFSRTEWRLLNEAQRRLYLDVMLENFALVSSLGCCCGAKDVEAPSEQTISVGVSQTRTPKESPSSQKTHPCEM

SEQ ID NO: 15914 - protein, 81 aa, Macaca fascicularis
PQVSLTFEDVAVLFTRDEWRKLVPSQRNLYRDVMLENYRNLVALGLPFTKPKVISLLQQGEDPWKVEKDSSGDSSLGSKSS

SEQ ID NO: 15915 - protein, 81 aa, Macaca fascicularis
RSQESLTFQDVAVDFTKEEWDQLYPAQKNLYRDVMLENYRNLVALGYQLYKPEVIAQLELEEEWVIERDSLLDTHPDGENR

SEQ ID NO: 15916 - protein, 81 aa, Macaca fascicularis
FRGMVTFKDVAVVFTREELGLLDLAQRKLYQDVMLENFRNLLSVGYHSFKLDVILQLGREDKLWLMETEIQRDGCSGLILW

SEQ ID NO: 15917 - protein, 81 aa, Macaca fascicularis
FQESVTFKDVIVDFTQEEWKQLDPGQRDLFRDVTLENYTHLVSIGLQDSKPDVISQLEQGTEPWIMEPSIPVGTCADWETR

SEQ ID NO: 15918 - protein, 81 aa, Macaca fascicularis
PQGLVTFGDVAVDFSQEEWEWLNPNQRNLYRKVMLENYKNLASLGLCVSKPDVISSLEQGKEPWTVKRKMTRAWCPDLKIV

SEQ ID NO: 15919 - protein, 81 aa, Macaca fascicularis
QGSVTFEDVAVYFSWEEWDLLDEAQKHLYFDVMLENFALTSSLGCWHGVEHEETPSEQRISVEGVPQFRTSKEGSSSQNAY

SEQ ID NO: 15920 - protein, 81 aa, Macaca fascicularis
FQGPVTLKDVIVEFTKEEWKLLTPAQRTLYKDVMLENYSHLVSVGYHVNKPNAVFKLKQGKEPWILEVEYPHRGFPEDLWS

SEQ ID NO: 15921 - protein, 81 aa, Macaca fascicularis
YQDLLIFEDTAVDFTQEEWTLLDPVQRNLYRDVMLENYENVAKVGFQLLKPSVISWLEEEELRTLQQGVLQDRAMKHQTSV

SEQ ID NO: 15922 - protein, 81 aa, Macaca fascicularis
CEASLSFEDVTVDFSREEWQQLDPAQRRLYQDVTLELYSHLFSVGYHIPNPDVIFRMLKEKEPCVEEAELSHQRCQEGEFG

SEQ ID NO: 15923 - protein, 81 aa, Macaca fascicularis
MEEWQQLNPAQKTLHRDVMLETYSHLVSVGCSGIKPDVIFKLEHGKDPWIIESELSRWIYSDRVKGLESSQQIISGELLFQ

SEQ ID NO: 15924 - protein, 81 aa, Macaca fascicularis
TLQGPVSFKDVAVDFTQEEWQQLDPDEKITYRDVMLENYSHLVSVEVWKFDDLIERIQENEDKHSRQAACINSKTLTEEKE

SEQ ID NO: 15925 - protein, 81 aa, Macaca fascicularis
FFSREPVCPFEEKTKAERMVEDYLANSYQDSVTFDDVAVDFTPEEWALLDTTEKYLYRDVMLENYMNLASVDKRLQWMETL

SEQ ID NO: 15926 - protein, 81 aa, Macaca fascicularis
MGPLQFRDVAIEFSLEEWHCLDTAQRNLYRDVMLENYRNLVFLGIPVSKPDLITCLEQGKKPWTMKRHEMVAKSPVIYSHF

SEQ ID NO: 15927 - protein, 81 aa, Macaca fascicularis
VTFEDVAVYFSWKEWGLLDEAQKCLYHDVMLENLTLTTSLGGCGAGDEEAPYQQSTSSQRVSQVRLPKALPSPQKTNPCEI

SEQ ID NO: 15928 - protein, 81 aa, Macaca fascicularis
GEACVGGGVTFSDVAIDFSHEEDLYKDVMVQNYKNLVSVTGLSVTKPYVITLLEDGREPWMVEKKLSKGMIPGELRKILLK

SEQ ID NO: 15929 - protein, 81 aa, Macaca fascicularis
MSNVTFSDVAIDFSHEEWAWLDSAQRDLYKDVMVQNYENLVSVAGLSITKPYVIMLLEDGKEPWMVEKKLSKVYPFPLSHS

SEQ ID NO: 15930 - protein, 81 aa, Phascolarctos cinereus
HQELLTFRDVAVGFSQEEWGHLHPYQKALYRDVMLENYQNLVFLGLVVSKPAMIDQLERGEEPWIAEGDVPRGPCPGWESW

SEQ ID NO: 15931 - protein, 81 aa, Phascolarctos cinereus
AQELVTFRDVAVDFTPEEWGFLDHPQKELYKNVMLENAQNLLSLGLPVPREDLISYLEEREAPWLLEQEDLRSCCPEGEIR

SEQ ID NO: 15932 - protein, 81 aa, Phascolarctos cinereus
GKESVTFKDVAVEFTQEEWVQLNPSQKKLYRDVMLENYRNLVSLGFAVSKPDVIYQMERKETSWIPEADIPRSSFPENREF

SEQ ID NO: 15933 - protein, 81 aa, Phascolarctos cinereus
AQELVTFKDVSVDFTQEEWGLLDHPQKELYKEVMLENAQNLLSLGLPVPREDLVSYFEEKDAPQLLEHEGLRSCYPEGDVR

SEQ ID NO: 15934 - protein, 81 aa, Phascolarctos cinereus
GQESLTFEDVAVYFTRKEWKHLDSCQKDLYRNVMLENYGNMTLLKFSVSKPELISQLERGEEPWVLDLQGTEDQDTPKGFN

SEQ ID NO: 15935 - protein, 81 aa, Phascolarctos cinereus
YVVSVTFQDVAVEFSSEEWTHLNPSQKKLYRDVMLENYRNLASLGFAVSRPDVICQLERKEVPWMPEADVLKSSCTGSKEF

SEQ ID NO: 15936 - protein, 81 aa, Phascolarctos cinereus
PLELVTFKDVAVDFSWEEWGHLEPSQKELYREVMLENYRNLVCLGLAISKPDVIFQLEQGEAPWMPEREGPKCRCADWKTR

SEQ ID NO: 15937 - protein, 81 aa, Phascolarctos cinereus
QVPVTFEDLAVKFSSDEWHLLEEWQREFHRDVMRENYETLVSLGTAQLLPLSAFLSLTEPQEDMGDSGCSDGEWERPGGGL

SEQ ID NO: 15938 - protein, 81 aa, Phascolarctos cinereus
SQKALTFQDVAVEFTLEEWGLLEPAQRDMHRDVMLENYENFVSLGLPVPKPALIFHLERRETSWLPGGAVLKSTYPDFLVR

SEQ ID NO: 15939 - protein, 81 aa, Myotis lucifugus
LQGSDLFRDVAVVFSREEWEWLAPAQRDLYRDVMLETYSNLRSLDLAISKPDVIAFLEQGKEPWRAAEAAAGGLCPALEAR

SEQ ID NO: 15940 - protein, 81 aa, Phascolarctos cinereus
QQELVTFKDVAVDFTPEEWGNLDSSQKALYKDVMLENYRNLVFLAGLTVWKPDVISHLEEGEAPWMQDREVPKTINPDLET

SEQ ID NO: 15941 - protein, 81 aa, Myotis lucifugus
PLESVIFEDVAVDFTQEEWALLDTPQRKLYRDVMLENISHLVSLGYRICKSDVTFQLEQGEELWSEGTGFLQGQSAGRESA

SEQ ID NO: 15942 - protein, 81 aa, Myotis lucifugus
VSFRDVAVDFTQEEWQQLGPEQKTTYRDVMLENYSHLVSVGYDSTKPSVIVRLEQGEEPWVAEGGSPCQGCPEKIKKVDDV

SEQ ID NO: 15943 - protein, 81 aa, Myotis lucifugus
PQKSVTFEDVAVYFTPTEWDGLSPAQRALYRDVMLENYGNVASLGFPLIKPAVILQLEGGGELGGPSPLAAETGTDPPGLW

SEQ ID NO: 15944 - protein, 81 aa, Myotis lucifugus
LGMNMNFEDVAVVFSEEEWGLLNEAQRLLYCNVMLEVFALVSSAGCRHEMDDEEACPEQSVSVQGESQVRASKTEPATQKT

SEQ ID NO: 15945 - protein, 81 aa, Puma concolor
IQGSLTFGDVAVAFTHIEWKHLDAAQRALYKDVMLENYGNLVSVGLLSSKPKLITQLEQGSEPWMEVQQVPSGTCSVQEYW

SEQ ID NO: 15946 - protein, 81 aa, Puma concolor
AQESLTFDDVAVNFTWEEWQLLAPAQKNLYRDVMLENYRNLVSLGFYPRRPDVLTKLDQGKPTGTVEDDIPFRTCSEIWKL

SEQ ID NO: 15947 - protein, 81 aa, Puma concolor
MDSVVFEDVAVDFTLEEWALLDSAQRKLYRDVMLENLKNLAAVGKIWEELSTEDQPTNQGRHLRNPVVERLSESNGQCREG

SEQ ID NO: 15948 - protein, 81 aa, Puma concolor
FKEAVTFRDVAVAFTEEELGLLDSAQRKLYQDVMLENFRNLVSVGGNSQSELRTLQDREPREELSCWQIWQHIASDLTRWQ

SEQ ID NO: 15949 - protein, 81 aa, Puma concolor
TKESVTFRDVAVVFSQDEWLHLDSAQRTLYREVMLENYGTLVSLGIPSSMPKVICRLQQGEDPCVVERETPQDACLGFKTW

SEQ ID NO: 15950 - protein, 81 aa, Sapajus apella
RSGAVSFADVAVYFSLEEWGCLWPAQRALYRDMMRETCGHLGVLGFSGPKSAFISWVEEEVEAWSLEVQDPESESSGTVSR

SEQ ID NO: 15951 - protein, 81 aa, Sapajus apella
QTEVTFEDVAVLLSREEWGRLGPAQRGLYRDVMLETYGNLVSLGVGPAGPKPGVISQLERGDEPWVLDVQGTSGREYLRVN

SEQ ID NO: 15952 - protein, 81 aa, Oryctolagus cuniculus
LQGSLSFKDVTVDFTQEEWQHLDPAQKTLYMDVMLENYCHLISVGCHMTKPDVILKLERGEEPWTSFLGHTLEENWKTEDF

SEQ ID NO: 15953 - protein, 81 aa, Oryctolagus cuniculus
VRESVTFKDVIVDFTQEEWKQLDPVQRDLFRDVTLENYTHLVSIGLQVSKPDVISQLEQGTEPWMVEPGRPAGPCGDLQIQ

SEQ ID NO: 15954 - protein, 81 aa, Oryctolagus cuniculus
PEVSVSFKDVTVDFSREEWQHLDPAQRRLYRDVTLENYSHLLSVGYQVPKPDAILKLKQGEGPWTLETEAPHQSCSEKNVV

SEQ ID NO: 15955 - protein, 81 aa, Canis lupus
SVVFEDVVVDFTPEEWALLDCAQRRLYRDVMRETCRNLTSVGENWKCHGIEDQHKNLGTCMRCHAVEILSENNGTNQCGET

SEQ ID NO: 15956 - protein, 81 aa, Muntiacus muntjak
MGRLTFRDVAIDFTQEEWECLDLGQRDLYWEVMLENYGNLASLGLVASKPNLVTFLEELNDPRSIRRMDTAAIHPVVSHSL

SEQ ID NO: 15957 - protein, 81 aa, Canis lupus
KPVTFKDVAVDFIQEEWGLLDPTQRILYYDVMLTNYSNSVSLGEAFLSPFYPCPMYICHVMCILFVWLLIYLFIYLFIYLF

SEQ ID NO: 15958 - protein, 81 aa, Ailuropoda melanoleuca
WLTFRDVAVEFSQEEWECLDPAQRALYRDVMVENYRNLVSLAISSKCMIKELPPKENSNTGEVLQTVILERHKSCDTKDYA

SEQ ID NO: 15959 - protein, 81 aa, Ailuropoda melanoleuca
SQELVTFEDVAVYFIRKEWKRLEPAQRDLYRDVMLENYGNVFSLDGETRPEHGQEISEDTGSHGVLLGRFQKDISQGLKFE

SEQ ID NO: 15960 - protein, 81 aa, Ailuropoda melanoleuca
SKDLVTFKDVAVDFSQEEWEWLNPAQRNLYKNMMLENYQNLVSLGLCVSKPYVISLLEQGKEPWEKTLLKPSKPEEKIRTL

SEQ ID NO: 15961 - protein, 81 aa, Gorilla gorilla
GSVSFRDVAIDFSREEWQHLDLSQRNLYRDVMLETYSHLLSVGNTKYGKMSFYTYCECTPTGEKLWDHNQHRKIIGYKPAS

SEQ ID NO: 15962 - protein, 81 aa, Gorilla gorilla
PQGLLTFRDVAIEFSQEEWKCLDPAQRTLYRDVMLENYRNLVSLGSCCVVEVGLDLLVSRHPPWPPKKLGLQAPTPVPNYW

SEQ ID NO: 15963 - protein, 81 aa, Myotis lucifugus
FQGPVKDVHVTRGFSYKKSVHQIPAHGDLYRDIREENVGDMVSLGSAVSTSNKIAQVEQRKELWMHYSNKRNSLRSNCIKE

SEQ ID NO: 15964 - protein, 81 aa, Myotis lucifugus
VTFEDIALFFSREEWSLLDEGQRQLYLNVMLENFELISSLGCCCGAENVEAPFEENISVRVSQARNPKLVLSSQKSHPCES

SEQ ID NO: 15965 - protein, 81 aa, Myotis lucifugus
RQNDMNFEDVAIVFSQEEWGLLDEAQRLLYYDVMLKVFALVSSVGCWHNMDDKEACSSQSVSIQGESQVRASKTAPATQKT

SEQ ID NO: 15966 - protein, 81 aa, Myotis lucifugus
QSKDMNFEDVVIAFSQEEWGLLDEVQRHLYCNVMLEVFALVASVGCWHKMDNEEAYSDQSVSVQGESRVRASETAPTTQKS

SEQ ID NO: 15967 - protein, 81 aa, Myotis lucifugus
VGEDMNFEDVAIAFSQEEWGLLDEAQRLLYCDVMLEVFALVSSIDCWHKMDNEEACSEQSESVQGESQVRASETEPAAQRT

SEQ ID NO: 15968 - protein, 81 aa, Puma concolor
ALALVSFEDVAVTFTGEEWRQLDLAQRTLYQEVMLETCGLLVSLGHPVPKPELIYPLEPGQELWTGKRGVSKSTYTGEKAK

SEQ ID NO: 15969 - protein, 81 aa, Sapajus apella
RPRALKFVDVAVYFSSEEWGCLRPAQRALYRDVMRETYGHLGALGCAGPKPALISWLERNTDDWEPAALDPQEYPRGLTVQ

SEQ ID NO: 15970 - protein, 81 aa, Sapajus apella
AHGSVTFRDVAIDFSQEEWEFLDPAQRDLYRDVMWENYSNFISLGPSISKTDVITLLDEEGKEPGMVVREGIRRYCPDLDS

SEQ ID NO: 15971 - protein, 81 aa, Sapajus apella
LQGPVSFKDVAVDFTQEEWQQLDPDEKITYRDVMLENYSHLVSVGCDITKPNVIVKLEQGEEPWITEDEFPCQHSPEVWKV

SEQ ID NO: 15972 - protein, 81 aa, Oryctolagus cuniculus
VTFQDVAVVFSEEELRLLDTAQRALYRAVMLENFRNLLSVGEDGRARILGVTLCSDLVCPGIKALEALHLQLESAHPPEGP

SEQ ID NO: 15973 - protein, 81 aa, Oryctolagus cuniculus
PQDLLTFKDVAICFSQEEWEWLNPAQRHLYSSVMLENYQNLVSLGVCISKPFMISLLEQGKEPWKMKSEMTRTSLSDGEPL

SEQ ID NO: 15974 - protein, 81 aa, Oryctolagus cuniculus
TARSQTTVTFKDVAMDFTPEEWGKLDPTQRAVMLENYRNLVSLWLPISKPESYDVENGKEPLTLERKVPSSSYPDVETRPK

SEQ ID NO: 15975 - protein, 81 aa, Ursus maritimus
QLVSVSFEDVTVDFSREEWQQLDPAQRRLYQDVTLENYSHLLSVGYEVPKPEIIFKLEQGEEPWILERKTPHQSCSDGRFG

SEQ ID NO: 15976 - protein, 81 aa, Ursus maritimus
AKGLLTFGDVAIEFSQEEWECLSHTQRELYRDVILENYGHLLFLGVIVSKPDLVSLLEQRKEPWGEKRNKTRIHVGKNPFG

SEQ ID NO: 15977 - protein, 81 aa, Ursus maritimus
GWVPALFDEVAIYFSDEEWEVLTEQQKALYREVMRMNYETVLSLEFPFPKPDVISRLEGDEESQNSDEWQLRGGTFAEQEE

SEQ ID NO: 15978 - protein, 81 aa, Ursus maritimus
LCELLTFKDISVDFTQEEWGHLAPAHRNLYREVMLENYGNLVSVGYQLSKPSVISQLEKGQEPWMTEKEGPGDPRSDLKNK

SEQ ID NO: 15979 - protein, 81 aa, Ursus maritimus
MEMLTFGDVAIEFSQEEWRCLSHTQRELYRDVMLENYGHLLFLGVIVSKPDLVSLLEQRKEPWDEKRNKTAGFDPALYTFE

SEQ ID NO: 15980 - protein, 81 aa, Ursus maritimus
VQGLVTFRDVALDFSQEEWEWLDPSQKDLYRDVMLENYRNLVWLGLSISKPNMISLLEQGKEPWMVEKEMSDGQYADWESW

SEQ ID NO: 15981 - protein, 81 aa, Ursus maritimus
GQGQVNFEDVAVYFSQEEWGLLDETQRLLYRDVMLENLALMASLGYESSMSRGVTSLELGSKPWGSDWADATPARTREAQG

SEQ ID NO: 15982 - protein, 81 aa, Ailuropoda melanoleuca
QAEVTFEDVAVLFSREEWGRLGPAQRGLYRDVMLETYRNLVSLGAGPAGPKPGVITQLERGDEPWVLDTQGAKGKERLRVS

SEQ ID NO: 15983 - protein, 81 aa, Gorilla gorilla
VVFEDVDVNFTQEEWALLDPSQKNLYRDVMQETFRNLASVGKKWKDQKIEDEYKNPRRNLRGLTGERLLESKKDHQHGEIL

SEQ ID NO: 15984 - protein, 81 aa, Ailuropoda melanoleuca
AHGLVMFKDVAIDVSQEEWECLNSTQRDLYKDVMLENYSNLVSLGLSISKPAVISSLEQGKEPWMVVREVAGGRCPDLVSR

SEQ ID NO: 15985 - protein, 81 aa, Ailuropoda melanoleuca
SQVHLTFEDVAVYFSQEEWGLLDEAQRHLYHTVMLENLALIASLGCWHGAEDGKSPSKQAVSVGVSQVRTHHAGPYPQKAY

SEQ ID NO: 15986 - protein, 81 aa, Gorilla gorilla
PQGHLTFMDVAIEFSQEEWKSLHPGQRALYRDVMLENYRNLVFLGICLPDLSIISMLKQRREPLTLQSQVKIVKTTDGREC

SEQ ID NO: 15987 - protein, 81 aa, Ailuropoda melanoleuca
FQDLVTFKDVAVDFSQEEWEWLNPAQRNLYKNMMLENYQNLVSLGLCVSKPYVISLLEQGKEPWETKTEMTSLFPDSGSIY

SEQ ID NO: 15988 - protein, 81 aa, Lynx canadensis
MLENYQNLLSLGAGPPGFKPDVISRLERGEEPRMEKREGWQMACPDLETRSAPTQETLVKKSISAEAASPVGKTGGGLGAA

SEQ ID NO: 15989 - protein, 80 aa, Lynx canadensis
LAVSFLGRLTFKDVAIEFSQEEWECLDPAQRALYRDVMLENYRNLVSLGEDNICSEVGICPWVSLHFSLVCLLGAPALLA

SEQ ID NO: 15990 - protein, 81 aa, Lynx canadensis
DEALMAFRDVAVAFTQKEWRLLSPAQRTLYRDVMLENYSHLVSLGIAFSKPKLITQLEQGDEPWREESECLLDLCPEPGTE

SEQ ID NO: 15991 - protein, 81 aa, Phyllostomus discolor
DTVASPSPTSQSRAQSALAASPRRPAEVGMTFADIALYFSREEWRLLNEAQRRLYLDVMLENFELVSSLVPNQAATLHLCL

SEQ ID NO: 15992 - protein, 81 aa, Phyllostomus discolor
FQGSLTFQDVAVDFTSEEWQLLDCDQRTLYWDVMLENFRNLVSLGAPVTKPKAVFKVEQGPELQVVEGESPHWSHLEADCP

SEQ ID NO: 15993 - protein, 81 aa, Phyllostomus discolor
MAEGLKFKDVAIFFSQKEWECLHSAQKDLYRAVMLENYNNLILLDWESRRETRNLSPKEGCCEMKSLQPEIKTPIRSNLVC

SEQ ID NO: 15994 - protein, 81 aa, Phyllostomus discolor
KALGSVAFRDVIVDFTQEEWQQLKPAQKDLYRNVMMEIYWNLVSLDLETRPVLKESDPQEDKWEDKSSIVVVEEGPTRNGA

SEQ ID NO: 15995 - protein, 81 aa, Phyllostomus discolor
YQELVTFRDVAIDFSQEEWDCLNSSQRHLYSNVMLENYRILVSLGLCFSKPSIILLLEQGKEPWMVKRELVKGLCSGWESV

SEQ ID NO: 15996 - protein, 81 aa, Phyllostomus discolor
AEVGVTFADIALYFSREEWHLLDEAQRRLYLDVMLENFELISSLGNAFTVPVVWTRLCISLCPLFSRGYSVLIRGLEVLLD

SEQ ID NO: 15997 - protein, 81 aa, Myotis lucifugus
DPVTFDDVAVYFSRREWRLLDEAQRRLYHEVMLDNLALASSLGPCCGAEDADAPCEQSVSVGGSPSSTSQAVLSSLKTHFC

SEQ ID NO: 15998 - protein, 81 aa, Myotis lucifugus
PKVPVTFDDVAVYFSELEWGKLDPWQKNLYKHVMRGNYEMLVSLDYAISKPDILTRIERGEEPCPEGLWGQEEGEEREAAC

SEQ ID NO: 15999 - protein, 81 aa, Myotis lucifugus
FREPVAFEDVAVDFTREEWGRLTPAQRALHREVMLETWGLLVAVGPWLLRPTLVTLLEQEAGRWLGDREVPQGVCPDLETK

SEQ ID NO: 16000 - protein, 81 aa, Myotis lucifugus
SQELVTFEDVAVYFIRKEWKRLEPAQRDLYRDVMLENYGNVFSLDGETRTEHDQEISEDTESDGVLLGRFQKDISQGLKFE

SEQ ID NO: 16001 - protein, 81 aa, Myotis lucifugus
SQDSVTFQDVAVDFTEKEWPLLDSSQRKLYKDVMLENYSNLASVGCQVGKPSLIFHLEQEEELRTEESGFPQGTCPDWEIP

SEQ ID NO: 16002 - protein, 81 aa, Puma concolor
MDFTLEDWEQLGLDQGDLFWDTALDNYQNLFLLNPCKPKLTSCPDGGEELEAVVRESPESEGLAPYVRPHAERRHLHLPLW

SEQ ID NO: 16003 - protein, 81 aa, Sapajus apella
PQKLVTFEDVAVYFTQAEWDGLSPAQRILYRDVMLENYGNVASLGFPLLKPAVISQLEGGGELGAPSPLAAGTGLHGLRTV

SEQ ID NO: 16004 - protein, 81 aa, Sapajus apella
MGHLTFMDVAIEFSQEEWKCLDPAQQALYRDVMLENYRNLVSLGICLPDLSIISMLEQRREPSTLQGEVKIVKIQDGKECV

SEQ ID NO: 16005 - protein, 81 aa, Sapajus apella
FQEVVTFGDVAVHFSREEWQCLDPGQRALYREVMLENHSSVAGLAGFLVFKPELISRLEQGQEPWVLDLQGAEGTEAPKTS

SEQ ID NO: 16006 - protein, 81 aa, Sapajus apella
VPVTFRDVAFTEAEWKRLSPEQRNLYREVMMENARNLLSAAEPKPEIYPCSSCLLAFSFQQFLSQHVLQIFLGLRAENHFH

SEQ ID NO: 16007 - protein, 81 aa, Sapajus apella
ILTEAVTFKDVAVVFTEEELGLLDPVQRRLYQDVMLENFRNLLSVGHQPFHGDTFHLQREEKFWMMETATQREGNSGGKIQ

SEQ ID NO: 16008 - protein, 81 aa, Sapajus apella
AHALVTFRDVAIDFSQKEWECLDPTQRKLYRDVMLENYGNLVSLGYSGSKPDVITLLEQGKEPCVAVRDMAGRQYPGLLSR

SEQ ID NO: 16009 - protein, 81 aa, Sapajus apella
VSFGDVAVYFSREEWGCLQPAQRALYRDVMRETYSHLGALADSRNKEEKRPREGVGALEKPLPVATGPLGLKAPQALSAGP

SEQ ID NO: 16010 - protein, 81 aa, Sapajus apella
AQDHVVFEDVVIYFSQEEWGHLDEAQRLLYRDVMLENLALLSSLGCCHGAEDEEAPLEQGVSVGVSQVMAPKPSLSTQKTQ

SEQ ID NO: 16011 - protein, 81 aa, Sapajus apella
MLFIFNKAGIAVSKADLITCLQEEKDPWNMKRHSMVAKPPVIYSHFAQDLWPEQGIKDSFQEVILRRYRKCGHEDLQLRTG

SEQ ID NO: 16012 - protein, 81 aa, Sapajus apella
MLENYSNLVSVGYHIIKPDVITKLEQGEEPWIVEGEFLLQSYPDEVWQTDNLIERVQEDENKLSRQTVFIKTLTEERGNVP

SEQ ID NO: 16013 - protein, 81 aa, Sapajus apella
VTFEDVAVVFTDEEWSHLVPIQKDLYKEVMLENYKSVVSLDWETKPEIYDASEEKAEGSLRESLGRQSPLCPKFEVHAPDS

SEQ ID NO: 16014 - protein, 81 aa, Oryctolagus cuniculus
FQVLVSFEDVAVDFTWEEWQDLDNAQKTLYRDVMLETYNSLLSLGYCVTKPDVIFKLEQGAEPWTVEEPPQQSLQVVQKMD

SEQ ID NO: 16015 - protein, 81 aa, Oryctolagus cuniculus
MIAFEDLAVYFTWEEWQKMNNAQKILYRDVMLETYSSLFSLGHCITKPDLIFKLEQGAEPWIVEECLNQSLPVVMKRDDLI

SEQ ID NO: 16016 - protein, 81 aa, Sapajus apella
FQAPLTFTDVAMEFTLEEWQCLDTAQQNLYKNVMLENYRNLVFLGIIVSKQDLITFLEKEKEPWNMKQHEMVDEAPGFWKN

SEQ ID NO: 16017 - protein, 81 aa, Oryctolagus cuniculus
MTAFEDLAVYFTWEEWQKMNNAQKILYRDVMLETYSSLFSLGHCITKPDLIFKLERGEEPWMVDECLNLSLSVVMKRDDLI

SEQ ID NO: 16018 - protein, 81 aa, Oryctolagus cuniculus
LQVLVSFEDLTVDFTWEEWQNLNSAQRILYRDTMLEIYNNLQSLGHCITKPHLICKLEQGAEPWMVEEEVYISFPLLLLVT

SEQ ID NO: 16019 - protein, 81 aa, Oryctolagus cuniculus
LREAVTFQDVAVVFSEEELRLLDAAQRALYREVMLENFRNLLSVGHQSFKPDVISQLEREERLQVQEIQTQRGSKNGNKTG

SEQ ID NO: 16020 - protein, 81 aa, Oryctolagus cuniculus
SQVMITFEDLAVYFTWEEWQNMNQAQKILYRDVMLETYSSLFSLGHCMTKPDLILKLEQGAEPWMGKECLHHSLSVAMKRD

SEQ ID NO: 16021 - protein, 81 aa, Pteropus alecto
MLETCGFLVSLGQLVPIPELIYFLEPGQKLWTVKRDLSESTCTGEKAKLETKEPPASQLAFTEEAAFKEGVTQRASRDSRL

SEQ ID NO: 16022 - protein, 81 aa, Oryctolagus cuniculus
SPGLLSFEDLAVDFTQEEWQDLDNAQKTLYKDVMLETYSSLQSLGHCITKPDLIFKLEQGAEPWLVKECLNQSLPVAQRRD

SEQ ID NO: 16023 - protein, 81 aa, Rhinolophus ferrumequinum
VQEPVTFRDVAVDFTQEEWGQLGPAQRTLYRDVMLETYGHLLSLGKQIAKPEVISLLEQGEEPWLVEHTYPQSTCPEMMRN

SEQ ID NO: 16024 - protein, 81 aa, Gorilla gorilla
QGLLTFRDVAIEFSQEEWKCLDPAQRTLYRDVMLENYRNLVSLDISSKCTMKEFLSTAQGNREVFHAGTSQRHESHHNGDF

SEQ ID NO: 16025 - protein, 81 aa, Ailuropoda melanoleuca
QGLLTFGDVAIEFSQEEWRCLSHTQRELYRDVMLENYGHLLFLGLIVSKPDLVSLLEQRKEPWDVKRKKTVVFDPAVSSHG

SEQ ID NO: 16026 - protein, 81 aa, Phyllostomus discolor
RKTDMSFADVAIAFSQEEWGLLDEAQRLLYCDVMLEIFVLLASVGCWHKKEDEEAPCEPSVYVHEESQGGVSKTSPATQKT

SEQ ID NO: 16027 - protein, 81 aa, Desmodus rotundus
TQEEWQQLDPVEKTTYRDVMLENYSHLVSVGCQVVKPEVIIKLEQGEEPWVEGELLPRRWPGVWRADVTEIVRESEDKCPR

SEQ ID NO: 16028 - protein, 81 aa, Macaca fascicularis
MGPLTFRDVKIEFSLEEWQCLDTAQRNLYRDVMLENYRNLVFLGIAVSKPDLITWLEQGKEPWNMKRREMVDKTPVICSHF

SEQ ID NO: 16029 - protein, 81 aa, Macaca fascicularis
TQGPLKFMDVAIEFSQEEWKCLEPAQRTLYRDVMLENYRNLVSLGICLPDLSVISTLEQKKDPWILQSEEKIANNPDGREC

SEQ ID NO: 16030 - protein, 81 aa, Macaca fascicularis
EQGYVTFEDVAVYFSQEEWRLLDEAQRLLCRNVMLENFSLLASLGLASSKTHDITQLESWKEPFMPASEVVTSAIPRGCWH

SEQ ID NO: 16031 - protein, 81 aa, Macaca fascicularis
MEHLTFRDVAIEFSPEEWKCLDPAQQNLYRDVMLENYRNLVSLGVAISNPDLVTFLEQRKEPYNVKIHETVAKHPAMCSHF

SEQ ID NO: 16032 - protein, 81 aa, Macaca fascicularis
PLETVTFKDVAVDLTQEEWEQMKPAQRNLYRDVMLENYSNLVTVGCQVTKPDVIFKLEQEEEPWVMEEEIFGRHCPEVWEV

SEQ ID NO: 16033 - protein, 81 aa, Macaca fascicularis
GSVSFSDVALGFTQEEWQHLDPAQRTLYRDVMLENYNLLLCTGYCITKPVVICKLEHGEVLWILEEESPSQSHLDCCIDDN

SEQ ID NO: 16034 - protein, 81 aa, Macaca fascicularis
PQGSLTFRDVAIEFSQEEWKCLDPIQKALYRDVMLENYRNLGFLGLCLPDLNIISMLEQGKEPWTVVSQVKIARNPNWGEC

SEQ ID NO: 16035 - protein, 81 aa, Macaca fascicularis
GKELLSFEDVAMYFTREEWGRLDWGQKDLYRDVMLENYRNMVLLGFQFPKPEVICQLENWDEQWILDLPRAGSRKASGSAC

SEQ ID NO: 16036 - protein, 81 aa, Macaca fascicularis
GTVTFEDVAVKFTREEWNLLSEAQRCLYRDVTLENLALISSLGCWCGVEDEAPSKQSIYIQRETQVRIPMAGVSPKKAHPC

SEQ ID NO: 16037 - protein, 81 aa, Macaca fascicularis
FQRSVSFQDLTVNFTQEEWQQLDPAQRLLYRDVMLENYSNLVSVGYHVSKPDVIFKLEQGEEPWIVEEFSNQNYPEVNDAL

SEQ ID NO: 16038 - protein, 81 aa, Macaca fascicularis
GMEPLQFRDVAIEFSLEEWHCLDAAAAAAAAAAAAAAVMLENYRNLVFLEPDLITRLEQGENPLTVKRHKMTANPSVMCSH

SEQ ID NO: 16039 - protein, 81 aa, Macaca fascicularis
HQEMVTFEDVAVHFTKTEWTGLSPAQRALYRSVMLENFGNLTALGYPVPKPALISLLEGGDMAWGLEAQDDAPAERTKNIC

SEQ ID NO: 16040 - protein, 81 aa, Phascolarctos cinereus
RQELLTFRDVAVVFTPEEWGHLRPAQKELYRDVMLENYRNLVCLGLVISKPDVIDQLERGGKLWMPEGDVLRSTCPGRSLR

SEQ ID NO: 16041 - protein, 81 aa, Phascolarctos cinereus
MVVDFTQEEWSLLDPAEKDLFWDVMLENYENFVSLASFQMFPHEQGLPDSKPLLISQLERREAPWLPMEEVLKSIYVDFLP

SEQ ID NO: 16042 - protein, 81 aa, Phascolarctos cinereus
MLENYKNLVSLGLLVSQPDVLSQLQRGKVPWIPEGDIPRGTCPDFLTQETRQDTMEPVAKQGIFMGKSSMERHMMNGPWGY

SEQ ID NO: 16043 - protein, 81 aa, Puma concolor
LQEAVVFEDVAVYFTRIEWSCLAPDQRALYRDVMLENYGHVASLGFVVAKPALISLLEQGEEPGALILQVAEEQGTVANLC

SEQ ID NO: 16044 - protein, 81 aa, Myotis lucifugus
QESVTFEDVAVYFTQNQWASLDPVQRALYRDVMLENYANVAALVAFPAPKPDLISQLERGSAPWGPDPWEAEVLRGICPGD

SEQ ID NO: 16045 - protein, 81 aa, Puma concolor
MLENFSHVISLGYPVSKPDVISKLEQGEDPWIIKRDVSNWIYTDENQKMHNGVMPCNNNQCGNIFSSKQSLMQYQNVETKE

SEQ ID NO: 16046 - protein, 81 aa, Puma concolor
LQNSITFEDVAMDFTEEEWVLLNPRQRKLYRDVMLENYRNLASLEKQLSRPALITQMQQEDEMKSETRNHQDTCSNGIVLP

SEQ ID NO: 16047 - protein, 81 aa, Puma concolor
FQESLTFRDVFVDFTLEEWRCLDSAQKNLYRDVMLENYSHLVSVGQLVPKPDVVIRLGQGEEARTAEGETPTRNPPEFWQV

SEQ ID NO: 16048 - protein, 81 aa, Puma concolor
RPGAVCFADVAVYFSPEEWGCLRPAQRALYRDVMRETYGHLGALGFRGTKPALISWVEEEADLWGPDARDPEVGECLTAAD

SEQ ID NO: 16049 - protein, 81 aa, Sapajus apella
PQVSLTFEDVAVLFSREEWRKLAPSQRNLYRDVMLENYRNLASLGLPFTKPKVISLLQQGEDPWKVEKDSSGGPCLGLKSS

SEQ ID NO: 16050 - protein, 81 aa, Sapajus apella
NFWILRLPPGSKGEAPKEWGKLEDWQKELYKHVMRGNYETLVSLDYAISKPDILTQIERGEEPCPDQWSQKKGSEVEVAHS

SEQ ID NO: 16051 - protein, 81 aa, Sapajus apella
FQGPVSFRDVSVGFTQEEWQHLDPAQRTLYRDVMMENYSHLVSVGYCIRKPEVILKLEKGEEPWILEEKFPSQSHLGELVC

SEQ ID NO: 16052 - protein, 81 aa, Sapajus apella
MLENFALIASLGLISFRSHIVSQLEMGKEPWVPDSMDMTSAMARGAYGRPGSDFCHGTEGKELPSEHNVSVEGVAQDRSPK

SEQ ID NO: 16053 - protein, 81 aa, Sapajus apella
VCVLQGPLTFMDVAIEFSLEEWQCLDTAQQNLYRNVMLENYRNLVFLGIAVSKPDLIACLEQEKKPWNIKRNEMVAKPPGR

SEQ ID NO: 16054 - protein, 81 aa, Sapajus apella
LQEPVTFRDVAVDFTQEEWGQLDPTQRILYRDVMLETFGHLLSIGPELPKPEVISHLEQGTEPWVTERGITQGYYPGCEPR

SEQ ID NO: 16055 - protein, 81 aa, Sapajus apella
MGPLTFRDVAIEFSLEEWQCLDTAQRNLYRKVMFENYRNLAFLGIAVSKPHLITCLEQGKEPWNRKRQEMVAEPPVMCSHF

SEQ ID NO: 16056 - protein, 81 aa, Sapajus apella
EKDLMAFEDVAVYFSQEEWGLLDTAQRALYRHVMLENFTLVTSLGLSTSRPLVVIQLEHGEEPWVPSVKDMTLARNAYGRH

SEQ ID NO: 16057 - protein, 81 aa, Sapajus apella
SQESLTFKDVFVDFTLEEWQQLDSAQKNLYRDVMLENYSHLVSVGYLLAKPDMIFRLGPGEESWRADGGTPVRTCAVLKER

SEQ ID NO: 16058 - protein, 81 aa, Sapajus apella
MEEAVTFKDVAVFFTEEELGLLDLAQRKLYRDVMLENFRNLLSVGHQPFHQDVFHFLREEKFWMMETATQREGNSGGKIQT

SEQ ID NO: 16059 - protein, 81 aa, Sapajus apella
PQESVAFEDVAVYFTKKEWAIMVPDQRALYCVMLENCEAVALVAVPPTSKLALVSHLEQGKEPCFTQPQGVLSRRGWRAGF

SEQ ID NO: 16060 - protein, 81 aa, Oryctolagus cuniculus
NYGNVPSLGFPVPKPELISQLEQGEELWVLDLVGAEDPRVLDNSFMFFVTDSEVGTKKELSVLNQQCSEEVENPEFISRRF

SEQ ID NO: 16061 - protein, 81 aa, Sapajus apella
LVTFEDVAVEFTQEEWALLDPAQRTLYKDVMLENCRNLASLDLETLLKAKWLTPKKHVFKKEQSKRVKTERSHRGVKLNEC

SEQ ID NO: 16062 - protein, 81 aa, Oryctolagus cuniculus
SVTFEDVAVHFSWEEWDLLDEAQRRLYLDVMLENFALTSALGCCLGVEHEEALSEQSISLGLSQVRTPKEGSSFQNAYPCD

SEQ ID NO: 16063 - protein, 81 aa, Oryctolagus cuniculus
QEFVTFEDVAVHLTREEWGCLDPVQRDLYREVMLENYGNVVSLDGETTEENKLLIPKQNISEEVHSYKTRVGRLKQDIAHV

SEQ ID NO: 16064 - protein, 81 aa, Oryctolagus cuniculus
MLENYSNLLSLGLPCTKPKVISLLQQGEDPWKIEKDSPGGSSVDWKSGPKTTTSTQTQDSSFQGLIMKRSRRNRPWDLKSE

SEQ ID NO: 16065 - protein, 81 aa, Oryctolagus cuniculus
AHALVMFRDVAVEFSQEEWECLDTSQRNLYRDVMLENYRNLVSLGHAASKPDVITLLEQGREPCTVARVVTARPYPGLFPR

SEQ ID NO: 16066 - protein, 81 aa, Oryctolagus cuniculus
SQESVTFQDVAVDFTEKEWPLLDSSQRKLYIDVMLENYSNLTSLGYQVGKPSLISHLEQEEEPRTEQRGIHQDTCPDWETP

SEQ ID NO: 16067 - protein, 81 aa, Pteropus alecto
TLVSVTFNDVAVTFTQEEWGQLDLSQRTLYQEVMLENCRILLSLGCPVPRPELIYQLEHGQELWMVNRDLSQSTCPGNKEK

SEQ ID NO: 16068 - protein, 81 aa, Oryctolagus cuniculus
AEVMIAFEDLAVYFTWEEWQNMNKAQKILYRDVMLETYSSLLFLGHCITKPDLIFKLEQGAEPWMVNECLNQRLPVAMKSD

SEQ ID NO: 16069 - protein, 81 aa, Pteropus alecto
MLDPTQKILYRNVMLENYSHLVSIGCCTIKPEVIIKIEQKEEPWILEQGFPSQCHPEDWKVDDLIESSQENQDEHFWQLAF

SEQ ID NO: 16070 - protein, 81 aa, Rhinolophus ferrumequinum
VKESVTLEVVTVDFTWEEWQLLVPEQKDLYRDVMLETYSNLVSVVYQASKPDTLSKLECGEELEPARGRPGSRILVSRRRC

SEQ ID NO: 16071 - protein, 81 aa, Desmodus rotundus
KFQEPLTFKDVAVVFTEEELGLLDPSQRKLYRDVMLENFRNLVSLGQPFKPNEIPHLEQGRETWVTERGTIRESHPGDKNV

SEQ ID NO: 16072 - protein, 81 aa, Macaca fascicularis
ASVTVTFDDVALYFSEQEWEILEKWQKQMYKQEMKTNYQTLDSLGYAFSKPDLITWMEQGRMLFIREQGCLDKTRRTTSPP

SEQ ID NO: 16073 - protein, 81 aa, Macaca fascicularis
LQASVSFEDVTVDFSREEWQHLDPAQRRLYWDVTLENYSHLLSVGYQVPKSEAAFKLEQGEGPWTLAGEAPHQSCSGEAIE

SEQ ID NO: 16074 - protein, 81 aa, Macaca fascicularis
AQESVMFSDVSIDFSQEEWECLNDDQRDLYRDVMLENYSNLVSMAGHSISKPNVISYLEQGKEPWLVDRELTRGQWPVLES

SEQ ID NO: 16075 - protein, 81 aa, Macaca fascicularis
MGSVSFKDVTVGFTQEEWQHLDPAQTTLSRDVMLENYSHFVSVGYCIPKPEVILKLEKGEEPWILEEKFPLQSHLELINTS

SEQ ID NO: 16076 - protein, 81 aa, Macaca fascicularis
RAEEAVTFKDVAVVFTEEELELLDPDQRKLYRDVMLENFRNLLSVGHQPFHGDTFHFLRDEKFWVMETTSQREGTSGGKIQ

SEQ ID NO: 16077 - protein, 81 aa, Macaca fascicularis
NKGPVTLKDVIVEFTKEEWKLLTFAQRTLYKDVMLENYSHLVSVGYHVNKPNAVFKLKQGKEPWILEVEFPHRVLPYLWSI

SEQ ID NO: 16078 - protein, 81 aa, Macaca fascicularis
VAFEDVAVNFSQEEWSLLSEVQRCLYHDVMLENWVLISSLGYWCGSEDEEAPSKRNILRSLHLSAQAEVSRSQLTAASASR

SEQ ID NO: 16079 - protein, 81 aa, Macaca fascicularis
AHGSVTFRDVAIDFSQEEWEFLDPAQRDLYRDVMWENYSNFISLGPSISKPDMITLLDEEGKEPGMVVREGTRRYCPGDVQ

SEQ ID NO: 16080 - protein, 81 aa, Macaca fascicularis
MDVAIEFSQEEWKCLEPAQRTLYRDVMLENYRNLVSLGICLPDLSVISTLEQKKDPWILQSEEKIANNPDGRECIKGVNTV

SEQ ID NO: 16081 - protein, 81 aa, Macaca fascicularis
TGGDVTFSDVAIDFSHEEWAWLDSAQRDLYKDVMVQNYENLVSVGLSITKPYVIMLLEDGKEPWMVEKKLSKDWESRWENK

SEQ ID NO: 16082 - protein, 81 aa, Phascolarctos cinereus
GKESVTFKDVAIEFTPEEWVQLNPSQKKLYRDVMLENYRNLVSLGFAVCKPDVIYQLERKEASWKPEADIPRSSCPESREF

SEQ ID NO: 16083 - protein, 81 aa, Macaca fascicularis
RESGKAPVTFDDITVYLLQEEWVLLSQQQKELCGSDKLVAPLGPTVANPELFCKFGPGPEPWLGSVQGQRSHLEHHPGKKQ

SEQ ID NO: 16084 - protein, 81 aa, Phascolarctos cinereus
APVPVKFDDVAIYFSEQEWDILDDWQKDLYKHVMRANYSTLVSLDYTIPKPELIFRIELGEVLFVGNWGDLEQAEIGVSLN

SEQ ID NO: 16085 - protein, 81 aa, Phascolarctos cinereus
SQIPLTFQDVAVDFTWEEWGLLEPSQKDMYWDVMLENYENFVSLGGIPVSFPDVISQMERIEAPWMTERGVLVSAFLDSPN

SEQ ID NO: 16086 - protein, 81 aa, Phascolarctos cinereus
VKIEDVADVAVSFILEEWGHLDQTQKDLSRNDRQENYETVTSVDYEPRNENMELIVKQEISEEAESLWMTPESIQKNDSQD

SEQ ID NO: 16087 - protein, 81 aa, Phascolarctos cinereus
PQELVTFEDVAVYLTKEEWGQLGPAQRKLYRDVMLENYENVISLGFPVSKPDLISQLERGEVPCLPDVPRTEVPETHGAKS

SEQ ID NO: 16088 - protein, 81 aa, Phascolarctos cinereus
FQESVTFRDVAVDFTQEEWGYLDLSEKELYRDVMLENYRHLVHLGLAVSKPDVIFHLERGEPPWRPESEVTRTSFPDWEYI

SEQ ID NO: 16089 - protein, 81 aa, Phascolarctos cinereus
MMFEDVAVYLTQEEWGCLGPAQRGLYKDVMLENYGNLVSLGFPVSKPDVISQLERGEEPWVLNMQQRAEKREILRGSCSGT

SEQ ID NO: 16090 - protein, 81 aa, Phascolarctos cinereus
SLASLTFQDVAVAFSREEWRCLDPAQKTLYREVMLENYRHLVFLGLPVSKPELISQLECGEGPWMLLEEEPRSPCADQNSS

SEQ ID NO: 16091 - protein, 81 aa, Phascolarctos cinereus
PQALIIFEDVAVYLTRGEWNCLEPAQKSLYRDVMLENYENLVSLGFPLSKPDVICQLERGEEPWVVHTQEKVTLKGNCSDL

SEQ ID NO: 16092 - protein, 81 aa, Phascolarctos cinereus
MFKDVAVEFTQEEWRQLDPAQRSLFKDVMLENYRNLVSLGLAVNKPGIISHLERGRAPWIPEKAVSGGTFPGIPIKLKANL

SEQ ID NO: 16093 - protein, 81 aa, Phascolarctos cinereus
GKESVTFQDVVVEFSLEEWKHLHPSQKKLYRDVMLENYKNLVSLGFAVSKPHVIYQLERKEAAWMPEADIPRSSCPGNKGF

SEQ ID NO: 16094 - protein, 81 aa, Myotis lucifugus
TQDSVVFEDVAVDFSQEEWALLDRAQRSLYREVMLENFRNLASLGYPLHTPCLIFQWKQEEDREITKRGLSMGSTRKARIL

SEQ ID NO: 16095 - protein, 81 aa, Myotis lucifugus
HNDMDFEDVAIAFSQEEWGLLDEAQRLLYCEVMLENFALVASVGAGRTLLLSQAVHRKMVSGEGWPCQHRYLSISLLSGCW

SEQ ID NO: 16096 - protein, 81 aa, Myotis lucifugus
VTFEDVAVCFSKKEWCLLDEAQRHLYLEVMLENYDLISSLGCCCRTEDVEAPTEQHVSVRVSQAKNPNVALSSQKSHPCES

SEQ ID NO: 16097 - protein, 81 aa, Myotis lucifugus
LLSFEDVAMYFTREEWNKLDWAQKDLYRDVMLENYRNMILLGFQIPKPEVICQLEQWEDPWILDLPRAGTRRASSSACPGS

SEQ ID NO: 16098 - protein, 81 aa, Puma concolor
IQEPVMFKDVAVVFSEEELGLLGPTQRKLYRDVMLENFRNLVSVGNQPFKPELISQLEREEKLLMMETETQRDGCLGTKSQ

SEQ ID NO: 16099 - protein, 81 aa, Myotis lucifugus
GWEDMNFEDVAIAFSQEEWELLDEAQRRLYCDVMLEVFTLVSFVGPWHKIDDVEAYSEHSVSVGDSHVRASKTAAATQRTH

SEQ ID NO: 16100 - protein, 81 aa, Puma concolor
HQEVVTFEDVAVYFTGTEWTGLSPGQKALYRSVMLENYGNLTSLGYQVPRPALISLLEAGNLPWGLEAQDNLSAERTKDLC

SEQ ID NO: 16101 - protein, 81 aa, Puma concolor
MEFTWDEWQLLDSAQKYLYRDVILENYSHLVSVGYHGTKPDLIFKLEQGEEPWIINAKVSRQSCPGGARPYECTKCERAFS

SEQ ID NO: 16102 - protein, 81 aa, Puma concolor
FQGSLSFGDVTVDFSWEEWQCLNPAQRTLYRDVMLENYHNFVSLGFLINKPEVIFRLEEGEEPWIVKEEFLYQNYPGELVS

SEQ ID NO: 16103 - protein, 81 aa, Puma concolor
EGSVTFEDVALYFSWEEWDLLDEDQRCLYHDVMLENFALTSSLGCGHGVDDEDVPLEESISVGVLAANLQQYEGQHTREVP

SEQ ID NO: 16104 - protein, 81 aa, Sapajus apella
SRSLENDGVCFTEQEWENLEDWQKELYRNVMESNYETLVSLKVLGQPEGEAELGTEMLGDLEEEGPGGAHPAGGVMIKQEL

SEQ ID NO: 16105 - protein, 81 aa, Sapajus apella
VTFEDVAVNFSKEEWCLLSEAQRCLYRDVMLENLALISSLGCWCGLKDEAALSKQSITVQTESQDRTPRAVSPKKAHSCHM

SEQ ID NO: 16106 - protein, 81 aa, Sapajus apella
HLTFRDVAIEFSQEEWKCLNSTQRTLYRDVMLENYRNLVSLALSHNGVINELAPKQESNMGDVFHTVALEQHETPDMQEFC

SEQ ID NO: 16107 - protein, 81 aa, Sapajus apella
KPGAVSFADVAVYFSPEEWGCLRPAQRALYRDVMRETYGHLGALGFPGPKPALISWMEQESEAWSSAAQDPEKGESLGGAR

SEQ ID NO: 16108 - protein, 81 aa, Sapajus apella
MEGLVMFQDLSIDFSQEEWECLNPAQKDLYRDVMMENYNSLLSLGLSIPKPDVISLLEQGKEPWMVSRDVLGGWCPDLKFR

SEQ ID NO: 16109 - protein, 81 aa, Sapajus apella
FQVLLTFRDVAIEFSLTEWQFLDTAQRNLYRNVMLENYENLVFLGIAVSKPDLITCLEQEKELWNMKRHEMVDKPPVMCSH

SEQ ID NO: 16110 - protein, 81 aa, Oryctolagus cuniculus
MLENYGNMVSLGFGFPKPPLISYLEQETELCAQDPWNRKSLSCSYSVSTDRTLPGNERASSEQEVFENRDVFQLKSSSLPK

SEQ ID NO: 16111 - protein, 81 aa, Oryctolagus cuniculus
IYLKVREREAGRGCSISKPDLITLLEQGKEPWMVVRGEKRRWSLDLESRYDTKKLFQEKDNYEMKLSQWEIMERVKSRGLD

SEQ ID NO: 16112 - protein, 81 aa, Oryctolagus cuniculus
LQVLVSFEDLAVDFTWEEWQDLDSAQRTLYRDVMLETYSSLLSLGFCITKPEVIFKLEQGAEPWTVEESLNQSVSVVQKID

SEQ ID NO: 16113 - protein, 81 aa, Ailuropoda melanoleuca
WKELLSFEDVAMYFTREEWNKLDWAQKDLYRDVMLENYRNMILLGFQFPKPEVICLLEQWEEPWILDLPRAGTRKASSSAC

SEQ ID NO: 16114 - protein, 81 aa, Macaca fascicularis
AQGCVTFEDVTIYFSQEEWGLLDEAQRLLYCDVMLENFALIASLGLISFRSHIVSQLEMGKEPWVPDSVDMTSAMARGAYG

SEQ ID NO: 16115 - protein, 81 aa, Macaca fascicularis
DSVVFEEVAVNFTPEEWALLDHAQRSLYRDVMLETCRNLASLDCCIYVRTSGSSSQRDVLGNGISNDEEIVKFTSDYWSIF

SEQ ID NO: 16116 - protein, 81 aa, Macaca fascicularis
MALPQVLLTFRDVAIEFSQEEWKCLDPAQRTLYRDVMLENYRNLVSLATVPGPYFLFFLDTVSLSVTQCGVRWCDHGSLQS

SEQ ID NO: 16117 - protein, 81 aa, Macaca fascicularis
AEGLVMFEDVAVYFSREEWGLLNVTQKGLYRDVMLENFALVSSLGLAPSRSPVFSQLEKDEQLWVRSWVDVTPVSRAEARR

SEQ ID NO: 16118 - protein, 81 aa, Macaca fascicularis
EPGIVSFADVAVYFCREEWGCLRPAQRALYRDVMRETYGHLSALGIGGNKPALISWVEEEAELWGPAARDPETKCPTETDP

SEQ ID NO: 16119 - protein, 81 aa, Macaca fascicularis
MELLTFRDVAIEFSPEEWKCLDPAQQNLYKDVMLENYRNLVSLGFVISNPDLVTCLEQIKEPYNLKIHETAAKPPVVQHFW

SEQ ID NO: 16120 - protein, 81 aa, Macaca fascicularis
VAFEDVAVNFTQEEWALLDIFQKNLYREVMLETFRNLTSIGKSWKDQNIEYEYQNPRRNFRSLIEEKVNEIKEDSHCGETV

SEQ ID NO: 16121 - protein, 81 aa, Phascolarctos cinereus
AQGLVTFKDVAVDFTQEEWGLLDHPQKELYKGVMLENAQNLLSLGLPVPREDVMCYFEQREAPWMLEQEVLRSHCLVASWV

SEQ ID NO: 16122 - protein, 81 aa, Macaca fascicularis
APGSVTFEDVAVYFSWEEWDLLDEAQKHLYFDVMLENFALTSSLGLTSSWSHVVAQLGLGEVSSVLHRMFMTPASARWDQR

SEQ ID NO: 16123 - protein, 81 aa, Phascolarctos cinereus
GESGQMLVTFDDITVYLLQEEWMLLGEQQREICGSDKLVAPLGTPIANPELFCKLERGVEPWLGDAPGRRKLLSHHLGNKK

SEQ ID NO: 16124 - protein, 81 aa, Phascolarctos cinereus
AQESVTFKDVAVDFTQEEWEQLDPAQRDLYRDVMLENYKNFISLGFPVFKPDVISQLERGEEPWTSETEVSYIVCPDSIIQ

SEQ ID NO: 16125 - protein, 81 aa, Myotis lucifugus
PRSLENDGVCFSEQEWENLEDWQKELYRNVMMSNYETLVSLKVLGQPEGEAELGTEMLGDLEEEGLGGVHPAEGVVIKQEV

SEQ ID NO: 16126 - protein, 81 aa, Myotis lucifugus
QTGDVNFEDVAIAFSEVEWVILDDAQRLLYYDVMLEVFALVSSVGCWHKMEDEEACSDQRVCIQGKSQVRTSKTAPVTHKN

SEQ ID NO: 16127 - protein, 81 aa, Puma concolor
SLEDGLLTFRDVAVEFSQEEWGCLNHSQQELYWDVMLETYGHLLFLGLVSKPDLVIFLEQKRELWDIKREETVATHPGRWE

SEQ ID NO: 16128 - protein, 81 aa, Sapajus apella
QEMPLTFQDVAVYFSQAEGQQLGPQQRALYRDVMLENYGNVASLGFPVPKPELISQLEQGKELWVLNLLGVEEPEILKSCQ

SEQ ID NO: 16129 - protein, 81 aa, Sapajus apella
MLENYRNLVSLGLTVSKPELISCLEQRQEPWSVKRPETVAKPPAMSCHYTEDFLPEQGMKDSFQKVILRRSGSCGLENLHL

SEQ ID NO: 16130 - protein, 81 aa, Sapajus apella
SLGPVSFKDVAVDFTQEEWQQLDPEQKITYRDVMLENYSNLVSVGYHIIKPDVITKLEQGEEPWIVEGEFLLQSYPDEVWQ

SEQ ID NO: 16131 - protein, 81 aa, Sapajus apella
VRAGSALTVQWPRRGREEWGLLNVTQKGLYRDVMLENFALLSSLGLAPSRSPVFTQLVDDEQPCVPSWVDVTLVSRTEASR

SEQ ID NO: 16132 - protein, 81 aa, Sapajus apella
MDFTPEEWGKLDPAQRDVMLENYRNLVSLWLPVSKPENYTLENGKEPLKLERKAPKNSYSDMKTRPESKDSTSVQDFSKAE

SEQ ID NO: 16133 - protein, 81 aa, Sapajus apella
FQDLVTFEDVSVDFTHEEWTLLDPLQRNFYRDVMLENYENLAKVGFQLLKPSLISWLEEEEELRTLQQGLLQEWAIKLLHT

SEQ ID NO: 16134 - protein, 81 aa, Oryctolagus cuniculus
SRSLENDGVCFTEQEWENLEDWQKELYRNVMQSNYETLVSLKVLGQPEGEAELGTEMLGDLEEEGPGGAHPPDGIVLRQEL

SEQ ID NO: 16135 - protein, 81 aa, Sapajus apella
AHVSLAFRDVSIDLSQEEWECLDPAQRDLYKDVMFENYSNLVSLGYTIPKPDVIALLEQEKEPWIVMREGTRSWYTESEDK

SEQ ID NO: 16136 - protein, 81 aa, Sapajus apella
TARPQAFEDMAVYFTKKEWANMAPDQRALYRDVMMENYEAVAFEVPPTSKPVLVSHLEAGKEPCFAQPQGVLSRRDWRAVF

SEQ ID NO: 16137 - protein, 81 aa, Sapajus apella
MDVAVEFSLEEWQCLDTAQRHLYRNVMLENYRNLVFLGIAVSKPDLITCLEKEKEPWNMKRHGMVDKPPVTFFHFAEDLWP

SEQ ID NO: 16138 - protein, 81 aa, Sapajus apella
MLENYRNLVSLAGISLPEMNIVSTLEQGKEPRTVESEVKITKTSNGWKCVKGVNTGVSPTHMIKELPPKENNSTGKAFQAV

SEQ ID NO: 16139 - protein, 81 aa, Oryctolagus cuniculus
AEGFVTFADVAVSFSWEEWNLLDTAQRHLYRSVMLETSALLDSLGLKASKTHEIVQLELWGQPFTPRGRWPGGDTAEAPWE

SEQ ID NO: 16140 - protein, 81 aa, Oryctolagus cuniculus
AQGSLTFEDVAICFSQEEWGLVDEAQRLLYFGVMLENFALTASLGCKHRTEYEKIPPEKSIGMPQVRTSKAGPSTQKIHPC

SEQ ID NO: 16141 - protein, 81 aa, Oryctolagus cuniculus
EALPVVFEDVAVYFTREEWGMLDKRQKELYRDVMRMNYELLASLGPAAAKPDLISKLERRTAPWIKDPNGPKLGKGCPPGK

SEQ ID NO: 16142 - protein, 81 aa, Oryctolagus cuniculus
PLESLTFKDVAIDFTLEEWRLMDPTQRSLHKDVMLENYRNLVSLGLAVSKPDMISHLENGKGPWAVVREISRGPYPDLETK

SEQ ID NO: 16143 - protein, 81 aa, Oryctolagus cuniculus
PKVPVAFDDVSIYFSTPEWEKLEEWQKELYKNIMKGNYESLISMDYAMNQPDVLSQIQPEGEHHTEDQAGPEESEIPADPS

SEQ ID NO: 16144 - protein, 81 aa, Oryctolagus cuniculus
SKVPVSFEDVSVYFTKTEWKLLDLSQRLLYKRVMLENYSHLVSLGFAFCKPHVVSQLERGKGPWVSDFPRLGDPAGLRAGD

SEQ ID NO: 16145 - protein, 81 aa, Rhinolophus ferrumequinum
PLESMMFEDVAIDFTQEEWALLDTFQRKLFRDVMLETISHLVSLGYQHCKSAVIFQLEQGEELWHEGTGFLQSQRITIRTG

SEQ ID NO: 16146 - protein, 81 aa, Rhinolophus ferrumequinum
SLGPVSFHDVAVDFTQEEWRQLDPEQKTTYRDVMLENYSHLVSVGCHIIKPEVIIKLEQGEEPWIVEGEFFLQSYPEEVWK

SEQ ID NO: 16147 - protein, 81 aa, Rhinolophus ferrumequinum
AQGLMVFEDVAVYFSREEWGLLDAAQRALYHHVMLENFALVASLGLSASRPRVVIQLERGEEPWVLSGTDVTLARNNQRRP

SEQ ID NO: 16148 - protein, 81 aa, Rhinolophus ferrumequinum
AHGSVTFMDVAIDFSQEEWEFLNSAQRDLYRDVMWENYSNFISLGPSISKPDVITLLDEGKEPWMVVREGTRRHYPDLESR

SEQ ID NO: 16149 - protein, 81 aa, Ursus maritimus
QHLDPAQKTLHRDVMLETYSHLVSVGEDTFSVEKSLDSPQQIISEELSFQKEILEKAPKEAACQIHEQIERQHQDDQDRYL

SEQ ID NO: 16150 - protein, 81 aa, Ursus maritimus
PQGSVSFKDVTVDFTQEEWQHLDPAQKALYRDVMLENYCHLISVGFHMTKPDMIRKLEQGEELWTTERMFPSQSYLEEDGK

SEQ ID NO: 16151 - protein, 81 aa, Ursus maritimus
VTFEDVAVYFSWKEWRLLDEAQRRLYHRVMLENFTLISSLGCCCGAEGEEAPFAQSTTVGASQAGTPAAAVSSRKTHPCEL

SEQ ID NO: 16152 - protein, 81 aa, Gorilla gorilla
QDSVTFDDVAVEFTPEEWALLDTTEKCLYRDVMLENYVNLASVDFFFCLTSEWEIQPRTKRSSLQQGFLKNQIFTGIQMTR

SEQ ID NO: 16153 - protein, 81 aa, Gorilla gorilla
TGEDVTFNDVAIDFTHEEWGWLNSAQRDLYKDVMVQNYENLVSVAGLSVTKPYVITLLEDGKEPWMMEKKLSKGMIPDWES

SEQ ID NO: 16154 - protein, 81 aa, Ailuropoda melanoleuca
SQDADEIQGESLKDEVTSGSPGAESKELLTFKDISVDFTQEEWGHLAPAHRNLYREVMLENYGNLVSVAGYQLSKPSVISQ

SEQ ID NO: 16155 - protein, 81 aa, Ailuropoda melanoleuca
LQGSVSLKDVTVGLTQEEWQHLDPAQKALYRDVMLGNYCHLISVGFHMTKPDMIRKLEQGEELWTTEFFQVRATLKKMEKL

SEQ ID NO: 16156 - protein, 81 aa, Ailuropoda melanoleuca
DSVVFEDVAVDFTQEEWALLDLAQRSLYRDVMLENFQNLASLVTGYPLHTPYLISQWKQEEDLETVERGPIQGEHQEGFEI

SEQ ID NO: 16157 - protein, 81 aa, Ailuropoda melanoleuca
NQITVTFNDVAVDFIQEEWILLDLTQRSLYRHVMLENYQNLVAVGYQLPKPKLITWLEQQELRTVEKRVFQGELETSLVNE

SEQ ID NO: 16158 - protein, 81 aa, Lynx canadensis
LQGWLTFRDVAIEFSQEEWECLDPAQRALYRDVMLENYRNLVSLEIFLELNIISIISFQGKDPWTVESEVNIGEHPDRWEC

SEQ ID NO: 16159 - protein, 81 aa, Lynx canadensis
MLENYGHLLLLGLVSKPDLVNFLEQKKEAWDVNGKGTVATHPAVSSHGTLSFLPKSCIEASFQNKSMGRCKHSTLENLHLM

SEQ ID NO: 16160 - protein, 81 aa, Lynx canadensis
SLESDLFRDVAVVFSQEEWERLAPAQRDLYRDVMLETYSNLVSLGLAISKPDVISFLEQGKEPWLVEKAAAGGLCPELDSR

SEQ ID NO: 16161 - protein, 81 aa, Lynx canadensis
PLTFKDVAVVFTEEELRLLDPTQRKLYRDVMLENFQNLLSLGDKNEKDLEYIQERELKCLSCRELSYWKIGEQAAGELTGR

SEQ ID NO: 16162 - protein, 81 aa, Lynx canadensis
MAFEDVAVYFSQEEWELLDAAQRALYCHVMLENFALVSSLGLSASRPRVVLQLERGEEPWVLSGTVVTPARNAQRKPSPGE

SEQ ID NO: 16163 - protein, 81 aa, Lynx canadensis
FQAKVTFEDVAVLLSQEEWDRLGPAQRGLYRHVMMETYGNVVSLGLPGSKPNVICQLERGEEPWVLDGQGAEETGGLGIGH

SEQ ID NO: 16164 - protein, 81 aa, Lynx canadensis
TQVLVTFKDVAVTFTQEEWGQLELDQRALYQEVMLETCGLLVSLGHEVPEAELTHLLEHGRELWTGKGGLLWSTCPGDSTR

SEQ ID NO: 16165 - protein, 81 aa, Lynx canadensis
FQGRLTFRDVAIDFSQEEWECLDPAQRALYKDVMLENYRNLVSVGEDNLPPEVGNYFLSVCCAFSIESPCFDHKSSNSLFF

SEQ ID NO: 16166 - protein, 81 aa, Lynx canadensis
KFQEAVTFKDVAVVFTEEELGLLDPTQRKLYREVMLENFRNLVSVGHSSSKPDVISQLEREEKLCMKEIHTQRGRHSGFLW

SEQ ID NO: 16167 - protein, 81 aa, Phyllostomus discolor
SQMPVTFEDVALYLSREEWGRLDHPQQSFYRDVLQKRNGLALGMADVRKEEPTSSPAVPGDGKSFKARAGRAQEDVLQCGR

SEQ ID NO: 16168 - protein, 81 aa, Phyllostomus discolor
VQEPVTFKDVAVDFTQEEWGQLDPVQRMLYRDVMLETFGHLLSVGNQIAKPKVISVLEQGGEPWLVEQTYSQGTGTEMVRY

SEQ ID NO: 16169 - protein, 81 aa, Phyllostomus discolor
MASPSPSLEPKEWDYLDPAQRSLYKDVMMENYGNLVSLDVLNRDKDEEPTVKQEIEEIEEEVESKGIIVTRIKSETDQDPM

SEQ ID NO: 16170 - protein, 81 aa, Phyllostomus discolor
DMNFADVAIAFSQEEWGLLDEAQRLLHCDVMLEIFALVASVGCWHKMEDEEAPAEHIVSIEGESQVRVSTTTPIMQKTHLC

SEQ ID NO: 16171 - protein, 81 aa, Phyllostomus discolor
LQESLTFHDVAVDFTLEEWQLLDPNQKDLYRDVMLENYSNLVSVGYQASKPDTLSRLERGEEPRAVQDEMHHVVCPELRRV

SEQ ID NO: 16172 - protein, 81 aa, Phyllostomus discolor
KALGPVAFRDVIVDFTQEEWQQLKPAQKDLYRDVMMEIYWNLVSLDLETRPDMRELDPQEDIWKERPTLVVEAERPIRNGA

SEQ ID NO: 16173 - protein, 81 aa, Phyllostomus discolor
KMTKFQAAVTFMDVAVVFTEEELGLLDLSQRKLYRDVMLENFRNLVSLSMATQLEAEEKLWMMERETQRNGASGSKNQNEV

SEQ ID NO: 16174 - protein, 81 aa, Myotis lucifugus
SQAPVTFEDMAMYLTREEWRPLDPTQRDLYRDVMQENYGNVVSLDFEIRSENEVNPKQEISEDVELGTASERPVGNAEENP

SEQ ID NO: 16175 - protein, 81 aa, Sapajus apella
FQEPVTFEDVAVYFTQNEWTSLQPSQRALFREVMLENYATVTSLSFPFPKPDLIFRLEQGEAAWGPDPWTLAGEEALRGLC

SEQ ID NO: 16176 - protein, 81 aa, Sapajus apella
MESVTFEDVAVEFIQEWALLDSARRNLCRYGMLDKCRSLASRAWESQLKPKELPSMRDILEEASSRDVQMGPGLFLRMQLV

SEQ ID NO: 16177 - protein, 81 aa, Sapajus apella
EMGPLTFRDVAIEFSLEEWQCLNTDQQDLYRKVMLENYRNLVFLGIAVSKADLITCLQEEKDPWNMKRHSMVAKPPVIYSH

SEQ ID NO: 16178 - protein, 81 aa, Sapajus apella
MLQNYRNLVFLGLAVTKPDLITHLEQEKELWNVERQETVAKYPEILPKQNIKDSSKNVTPRKYKSCDLDNLCLKKAWQDEN

SEQ ID NO: 16179 - protein, 81 aa, Oryctolagus cuniculus
LQEPVTFRDVAVDFTQEEWGQLDPTQRTLYRDVMLETFGHLLSVGPELPKPEVISQLEQGAELWVAERGITQSCHPGWEPR

SEQ ID NO: 16180 - protein, 81 aa, Oryctolagus cuniculus
MLTFEDLAVYFTWEEWQNMNKAQKILYRDVMLETYSSLLSLGNCITKPDLIFKLEQEAEPWMVNECLNQSLPVAMKSDDII

SEQ ID NO: 16181 - protein, 81 aa, Pteropus alecto
FQEAVTFGDVAVHFSREEWQCLDPGQRALYKEVMLENHSSVAGLAGFLVFKPELISRLEQGQEPWVLDLQGAERREAPRTP

SEQ ID NO: 16182 - protein, 81 aa, Pteropus alecto
EGVNFKIVTVDFTREEERTLKHVQRTLDRGVILENHKDLVSWDSATAFERRESTSKQSIFDDEPPCGVKTERLTRDDPWLS

SEQ ID NO: 16183 - protein, 81 aa, Desmodus rotundus
LQVSVSFEDVTVDFSREEWQHLDPAQRRLYWDVTLENYSHLLSVGYQVPKPEVILKLEQGEGPWTLEGETPHQSCSDEDIG

SEQ ID NO: 16184 - protein, 81 aa, Desmodus rotundus
SQELVTFEDVAVYFIRKEWKRLEPAQRNLYRDVMLENYGNVFSLDGETRPEHDPEISEDTGSHGVLLGRFQKDISQGLKFE

SEQ ID NO: 16185 - protein, 81 aa, Desmodus rotundus
VVTFKDVAVIFTEEELGLLEPSQRMLYRDVTLENLRNLVSVGHWNQKEIESLQEVASWYLLHEDLACWHIWDQLLRKLTRN

SEQ ID NO: 16186 - protein, 81 aa, Desmodus rotundus
DSVTFEDVAVDFTLEEWALLDPSQKKLYRNVMRETYRNLASIGLHLGEKWEDHNIENQYKTQGRKLRDHMVEKLYESKEGS

SEQ ID NO: 16187 - protein, 81 aa, Desmodus rotundus
DLVTFTDVAIVFSQDEWEWLNLAQRKLYKKVMLENYKNLVSVGLCLSKPDMISLLEQGKEPWVMNGEMTGGLCPDLKYMWM

SEQ ID NO: 16188 - protein, 81 aa, Macaca fascicularis
FQEMVTFKDVAVVFTEEELGLLDSVQRKLYRDVMLENFRNLLLVAHQPFKPDLISQLEREEKLLMVEMETPKDGCSGRKNQ

SEQ ID NO: 16189 - protein, 81 aa, Macaca fascicularis
MGPLQFRDVAIEFSLEEWHCLDTAQRNLYRNVMLENYRNLVFLGIVVSKPDLITCLEQGEKPLTMKKHEMVANPSETGFHH

SEQ ID NO: 16190 - protein, 81 aa, Macaca fascicularis
QQGYVTFEDVAVYFSQEEWRLLDETQRLLYRNVMLENFSLLASLGLASSKTHEITQLESWEEPFMPAWEVMTSALPKGCWH

SEQ ID NO: 16191 - protein, 81 aa, Macaca fascicularis
MTFEDVSVEFTQGEWGQLNPAQKDLYREVMLENFRNLAFLGLPVSKPYVICQLEEGGEPFIVEREVSTGAYSDWERRSKSK

SEQ ID NO: 16192 - protein, 81 aa, Macaca fascicularis
YDSVAFEDVAVNFTREEWALLGPSQKTLYRDVMWETIRNLNCIGMKWEDTDVEDQHKNPRRSLRCLIVERFSESNQIPGST

SEQ ID NO: 16193 - protein, 81 aa, Macaca fascicularis
IYFSQEEWELLEYTQKALYNDVMQENYETVISLALFVLPKPKVISCLEQGEEPWVQVSPEFKDSAGKSPTGLKLKNDTENH

SEQ ID NO: 16194 - protein, 81 aa, Macaca fascicularis
MELLTFRDVTIEFSLEEWEFLKPAQQNLYRKVMLENYRNLVSLGLTVSKPELISCLEQRQEPWNVKRHETIAKPSAVSSHC

SEQ ID NO: 16195 - protein, 81 aa, Macaca fascicularis
LVTKESMTFKDVAVDITQEDWELMRPVQKELYKTVTLQNYWNMVSLGLTVYRPTVIPMLEEPWMVIKEILEGPSPEWETKV

SEQ ID NO: 16196 - protein, 81 aa, Phascolarctos cinereus
PQASVTFEDVAVYLTQEEWGHLEPAQRGLYRDVMLENYGNVVSLGFPVSKPDVILQLELRGEPWFLDMQGTEGREILRDCE

SEQ ID NO: 16197 - protein, 81 aa, Macaca fascicularis
AQGLVTFADVAIDFSQEEWACLNSAQRDLYWDVMLENYSNLVSLDLESAYENKSLPTGKSIHEIRASKRNSDRRSKSLGRN

SEQ ID NO: 16198 - protein, 81 aa, Phascolarctos cinereus
QQGSVTFRDVAVDFTLEEWGHLDPFQKELYRDVMLENFRNLVCLGLTVSKPDVIHQLEQGEAPWIPEGESPRNSFAGCASD

SEQ ID NO: 16199 - protein, 81 aa, Phascolarctos cinereus
GHLPQELVTYKDVAVDFTQEQWSFLDHPQELYKEVMLENAQNLLSLGQPVAREDLIYYFEEREAPWMLEVEGRRSCCRGAH

SEQ ID NO: 16200 - protein, 81 aa, Phascolarctos cinereus
WQESLTFKDVAVDFTQEEWSLLDHSQKELYKEVMLENSQNLLSLGIPLLREDFISHFEEREPSWILDQKGPRNCCPGAETK

SEQ ID NO: 16201 - protein, 81 aa, Phascolarctos cinereus
QESSVTFEDVAVYFTWEEWRQLDLAQRALYREVMLENYGNAASLGFMGPKPYLISQLERGQMLWTLDLQGTETIEARRGTW

SEQ ID NO: 16202 - protein, 81 aa, Phascolarctos cinereus
CQEPVTFRDVVVDFTPEEWGRLGPSQRQLYQDVMLETYRNLVSLAGIPVPDCDTLCHLEQVDMLRVGEEADGKPGPEASRP

SEQ ID NO: 16203 - protein, 81 aa, Phascolarctos cinereus
DQEVVSFRDVAVDFTEEERGCLSPAQWQLYKEVMLENYRNLVSLGLIEDKPDLVSWLEQEEEPWALDLQGEGPRSPCPWGG

SEQ ID NO: 16204 - protein, 81 aa, Phascolarctos cinereus
NKESLTFKDVAVDFTQEEWGQLDPAQRNLYREVMLENYRNLVFLGYPFSKPNMISQLEQGEEPWILEKEISRCIYAGGLFS

SEQ ID NO: 16205 - protein, 81 aa, Phascolarctos cinereus
RQGSLTFQDVAVDFTWEEWGQLGPTQKELYREVMLENYGNLVCVGLAGSKPDVICRLEQGEAPWRPGEGFSGSGRPDWETR

SEQ ID NO: 16206 - protein, 81 aa, Myotis lucifugus
ETGDVNFEDVAIAFSEVEWVILDDAQRLLYYDVMLEVFALVSSVGCWHKMEDEEASSDQQVCRQGKLQVRTSKTAQDTHKN

SEQ ID NO: 16207 - protein, 81 aa, Myotis lucifugus
VKFADVAVYFSPEEWGCLRPAQRALYRDVMRENYGHLGALGCAGPKPALISWLERNTEDWEPAALDPQDCPRGLMVQRKWP

SEQ ID NO: 16208 - protein, 81 aa, Myotis lucifugus
MNFKDVAIAFSQEEWGLLDEAQRLLYYEVMLEVFALVSSLGCWHKMEDEEACSIQSVSIQGESQVRASKTAPATQKIPLCK

SEQ ID NO: 16209 - protein, 81 aa, Myotis lucifugus
VNFEDVAIAFSQEEWGLLDEPQRLLYCDVMLEVFALISSVDVAFSLLQQTMGSEKNMQGEPWFFHRVNMQDGLRRGLALLS

SEQ ID NO: 16210 - protein, 81 aa, Myotis lucifugus
SQGLVTIKDVSLCFSQEEWRSLDPSQTDFYGEYVMQENCGIVVSLRFPIPKLDMLSQVEGGEEQWVPDPQDLEERDILRVT

SEQ ID NO: 16211 - protein, 81 aa, Myotis lucifugus
FGDVAIDFSQEEWEWLNLAQRNLYRKVMLENYRNLESLGVSVSKPEVISLLEQGREPWMATKARTEGTCSDWEYAFKNSEF

SEQ ID NO: 16212 - protein, 81 aa, Puma concolor
APGCVTFEDVAVRFSWEEWGLLDEAQRLLYRDVMLENFALMASLGLASSRTHEITQLEWWRQPSLPPRGVMTAAMPRGLRR

SEQ ID NO: 16213 - protein, 81 aa, Myotis lucifugus
PPPGRPQEPVTFRDVAVDFSPEEWGHLGPEQRTLYRDVMLETFGHLLSVGPELPKPEVISQLERGAELWVVERGLAQGCCP

SEQ ID NO: 16214 - protein, 81 aa, Puma concolor
MLENYGHLLFLGLVVSKPDLVIFLEQKKDVWDVKRKETVATHPEKPYQCKECGHVFNQFSTLTGHQRIHTGEKTYQEKEGG

SEQ ID NO: 16215 - protein, 81 aa, Puma concolor
WSQDSVTFEEVAVDFSQEEWALLDPTQKILYRDVMLENYRNLASVGYPLCKHSLITEVGQEALSTEKRGMLQGACVGLDIQ

SEQ ID NO: 16216 - protein, 81 aa, Puma concolor
VGDQDFTASVLQAAPQEPWRHLESVQKEHYWDLMLETYGKMVSGGISSSKPDPTGPTEYGEEPAGRHPHLSEKIPRPTCLG

SEQ ID NO: 16217 - protein, 81 aa, Puma concolor
LFQGSLALEDVAVNFTQDEWQLLDSAQKNLYRNVMLENVSSLVSLGFQLIKPDVIFKLEREQPWIIGEEVPSQSLSEYWKV

SEQ ID NO: 16218 - protein, 81 aa, Sapajus apella
LQEAVVFEDVAVYFTRIEWSCLAPDQQVLYRDVMLENYRNLASLGFLVAKPALISLLEQGEEPGALILQVAEQRGAKTSLC

SEQ ID NO: 16219 - protein, 81 aa, Sapajus apella
MELLTFRDVTIEFSLEEWEFLKPAQQNLYRNVMLENYRNLVSLGLTVSKPELISCLEQRQEPWSVKRPETVAKPPAMSCHY

SEQ ID NO: 16220 - protein, 81 aa, Sapajus apella
QEQVSFKDVCVDFTQEEWYLLDPAQKMLYRDVILENYSNLVSVERKWKVDDVLKGSQENEDDHFWELLFHNNKTVSAESGD

SEQ ID NO: 16221 - protein, 81 aa, Sapajus apella
QLQETMTFKDVEVTFSQDEWGLLDSAQRNLYRDVMLENYRNMAFLVGPFTKPALISWLEAREPWGLNVQVAQPKGNPGAAP

SEQ ID NO: 16222 - protein, 81 aa, Sapajus apella
MLENYSNLVSVAGYQLSKPVVISQLEKGEEPWMTEKEGPGDPSSDLKSNTETTESTAKSTISQEQLYHGIMMERFMRDDII

SEQ ID NO: 16223 - protein, 81 aa, Sapajus apella
WEESLTLEDVAVDFTWEEWRLLGPTQKDLYRDVMLENYSNLVAVGYQASKPDALLKLERGEEPCCTTEDEIYTQICSEIRK

SEQ ID NO: 16224 - protein, 81 aa, Sapajus apella
KESVSFKDVAVDFTQEEWGQLDSPQRALYRDVMLENYQNLLALGAGPPLHKPDVISHLERGEEPWCVQRDIPGGPCPEWEM

SEQ ID NO: 16225 - protein, 81 aa, Sapajus apella
DMGPLTFMDVAIEFSLEEWQCLDTAQQNLYRNVMLENYRNFVFLGIAVSNLDLITCLEQGKEPWNMKRHEMVAKSPVICSD

SEQ ID NO: 16226 - protein, 81 aa, Sapajus apella
SQGLVSFKDVAVDFTQEEWQQLDPAQRTLYRDVMLENYSHLVSMGYPVSKPDVISKLEQGEEPWIVKRDISNWIYPDEYQA

SEQ ID NO: 16227 - protein, 81 aa, Sapajus apella
FQEAVTFKDVAVAFTEEELGLLDSSQRKLYRDVMLENFRNLVSVGRQSFKPDMISQLEREEKLWMKEFQNQRGRHSGDRNQ

SEQ ID NO: 16228 - protein, 81 aa, Sapajus apella
PQGHLTFKDVAIEFSLEEWKCLTPSQRALYRDVMLENYSNLESVDISSKCMMKTFSLTAQGNTEMFHTRTLETHENHHIAD

SEQ ID NO: 16229 - protein, 81 aa, Sapajus apella
SVAFEDVAVTFTQEEWALLDPSQKTLYRDVMQENFRNLASVGKKWKAQNIYVEYKNLRRNLRNLMGKRLFESKKDHQHGEI

SEQ ID NO: 16230 - protein, 81 aa, Sapajus apella
ILALLGLLTFRDVAIEFSLEEWQCLDTAQQNLYRNVMLENYRNLAFLGIAASKPDLITCLEKAKEPWKVKRHAMVDEPPGR

SEQ ID NO: 16231 - protein, 81 aa, Sapajus apella
LSFEDVAMYFTREEWGHLDWGQKDLYRDVMLENYRNMVLLGSEARHKMKKLTPRQKFSEDLESYKISVVMQESAKKLSEKL

SEQ ID NO: 16232 - protein, 81 aa, Sapajus apella
MLENYCHFISVGFHMTKPDMIRKLEQGEELWTQRIFPSYSYLEEDGKTEDVLVKFKEYQDRHSRSLILINHKKLIKERSNI

SEQ ID NO: 16233 - protein, 81 aa, Sapajus apella
SQEPVTFEDVAVDFTQEEWQQLNPAQKTLHRDVMLETYSRLVSVGCSGIKPDVIFKVEHGMDPWIKDSELSRWVYPDREKG

SEQ ID NO: 16234 - protein, 81 aa, Oryctolagus cuniculus
STVMIAFEDLAVYFSWEEWQNMNNAQKILYRDVMLETYSSLFSLGHCITKPDLIFKLEQGAEPWMVDECLNQSLSVGMKRD

SEQ ID NO: 16235 - protein, 81 aa, Oryctolagus cuniculus
IAFEDLAVYFSWEEWQKMNNAQKTLYRDVMLETYSSLFSLGDGPNQLQGGEKFDNTKIPGKSLQFCEPLRQHDNIHIMKQP

SEQ ID NO: 16236 - protein, 81 aa, Oryctolagus cuniculus
LSQVMTTFEDLAVYFTWEEWQNMNKAQKILYKDVMLETYSSLFSLVSIKGDDLTRINQESQDKNLNQNVMKNKKISIPKRA

SEQ ID NO: 16237 - protein, 81 aa, Oryctolagus cuniculus
SPTMIAFEDLAVYFSWEEWKNMNKAQKILYRDVMLETYSSLLSLGHYITKPDLIFKLEQGAEPWMVEECLYQSLPVAMKND

SEQ ID NO: 16238 - protein, 81 aa, Phyllostomus discolor
GSVAFRDVIVDFTQEEWQQLKPAQKDLYRDVMMETYWNLVSLDLETEGDMNEPDPEKDSWEDRTSIVVAEELMRNGAQDYA

SEQ ID NO: 16239 - protein, 81 aa, Macaca fascicularis
FQGSVTFEDVAIAFSQQEWESLDSSQRGLYRDVMLENYRNLVSMAGHSLSKPHVIALLERWKEPKVTERKDGRRWCTDLQL

SEQ ID NO: 16240 - protein, 81 aa, Macaca fascicularis
LTLEDVAKDLYQDVMVENYNHLVSLGYQTSKQDALSRLAHGQEPWITDAKIQNKNCPGIRKVDSHLQDMQQCSGQNAFRNI

SEQ ID NO: 16241 - protein, 81 aa, Macaca fascicularis
LQELLTLEDVTVEFTWEEWQLLDPFQKGLYRDVMLEIYSNLVSMGYQVSKPDALSRLERGEEPWTMEDERHSQICPENNKV

SEQ ID NO: 16242 - protein, 81 aa, Macaca fascicularis
MLENYGAVASLAFPFPKPALISQLERGEAPWCSVPWGALDGEDPRSISSGYPFLKPAGISHLEQVEEPLNLKLQEEGPSLI

SEQ ID NO: 16243 - protein, 81 aa, Macaca fascicularis
MFKEAVTFKDVAVVFTEEELGLLDPAQKKLYRDVMLENFRNLLSVGHQLSYQDTFHFQREEKFWIMETATQKEGNSGGKIQ

SEQ ID NO: 16244 - protein, 81 aa, Macaca fascicularis
TKGCVTFEDIAIYFSQEEWGLLDEAQRRLYLEVMLENFALVASLGCGHGTEDEETPSEQNVSVRVSQSKAGSSTQKTQSCE

SEQ ID NO: 16245 - protein, 81 aa, Macaca fascicularis
FQGSISFKDVTVGFTQEEWQHLDPSQRALYRDVMLENYSNLVSVGYCVHKPEVISRLEQGEEPWRLEEEFPSQSFPVWTAD

SEQ ID NO: 16246 - protein, 81 aa, Phascolarctos cinereus
PQESVTFRDVAVDFTWEEWGQLDPSQKELYREVMLENYGNLACLGLAVSKPDVILQLERGEIPWMSERKVPEGICPDWEAR

SEQ ID NO: 16247 - protein, 81 aa, Phascolarctos cinereus
LRESVTFKDVAVDFTGEEWRRLDPAQRALYRDVMLENYENLVSLGLPVSKLDVISLLERGEAPWWLEGGGLQSPCSDALSQ

SEQ ID NO: 16248 - protein, 81 aa, Puma concolor
APLPLTFEDVAIYFSEQEWQNLEAWQKELYKHVMRTNYEILVSLDDGLPKPELISRIEQGKEFFKNWGESQKSGNIICSSA

SEQ ID NO: 16249 - protein, 81 aa, Puma concolor
MRENYGHLVSVGYCVNKPNAVFKLKQGKEPWILEVEFPRRNYPEDLWKIHDLGARSQGSQAENSRNGELTKHQQTPAREKI

SEQ ID NO: 16250 - protein, 81 aa, Puma concolor
QQGCVTFEDVAIDFSQEEWGLLDEAQRRLYHDAMLENLALTASLVCWHGMEDEGTPFEQSVSIEVLSQVRIPKAGASIQKT

SEQ ID NO: 16251 - protein, 81 aa, Puma concolor
SRSLVTFGDVAVDFSQEEWEWLNSAQRNLYRSVMLENYRNLASLGLCVSKPDMISSLEQRKEPWMVKRRLTRGRGPDLEAG

SEQ ID NO: 16252 - protein, 81 aa, Puma concolor
RMDSVTFEDVAVNFTLEEWALLDSSQKKLYRDVMRETFRNVASVEKKWKDHDTEYRCKTQGRKTGSPTVGKPCESKEGLQC

SEQ ID NO: 16253 - protein, 81 aa, Puma concolor
QAEVTFEDVAVLFSREEWGRLGPTQRGLYRDVMLETYRNLVSLGAGRAGPKPGVITQLERGDEPWVLDAQGAKGKGRPRVS

SEQ ID NO: 16254 - protein, 81 aa, Sapajus apella
MCVFQRPLTFMDVAIEFSPEEWQCLDTTQQNLYRNVMLENYRNMVFLGIAVSKPDLITCLEQGKEPWNMKRQEMVAKPPGR

SEQ ID NO: 16255 - protein, 81 aa, Sapajus apella
VCNVGGSVPEIPGPWVCIGTLSSGAGKTRLRLHSSLHSPRVTENEHISGYCFTKPELIFTLEQGEDPWLLEKEKGFLSRTS

SEQ ID NO: 16256 - protein, 81 aa, Sapajus apella
LLDPVAFEDVAVNFTQEEWALLDISQKNLYREVMLETFRNLTSIGKKWKDKSIEDECQNPGRNLRSLIEEKVNEIKEDSHC

SEQ ID NO: 16257 - protein, 81 aa, Sapajus apella
MYKQEMKTNYETLDSLGYAFSKPDLITWMEQGRMLLISDQGLLHRTKRTTGPPTDEQLDMKNTEKLPCFDDRGTLGTKEDC

SEQ ID NO: 16258 - protein, 81 aa, Sapajus apella
TQESLTLEDVAVEFSWEEWQLLDTAQKDLYRDVMVENYNHLVSLGYQTSKPDVLSKLAHGQEPWITDAKIQNKNCPGIRKV

SEQ ID NO: 16259 - protein, 81 aa, Pteropus alecto
GGWVPALFDEVAIYFSDEEWDVLTEPQRALYREVMRMNYDTVLSLVGLRLPRDIAELPEWSEGYPFYMAMGFPGYDLAADD

SEQ ID NO: 16260 - protein, 81 aa, Oryctolagus cuniculus
SPESVAFEDVAVYFTKKEWASLLPAQRALYKEVMLENYGMVASLAPPPISKPALISQLEQGKEPWFTRPQGALNRRARRVV

SEQ ID NO: 16261 - protein, 81 aa, Oryctolagus cuniculus
DHGLVMFRDVAVDVSQEEWECLNPAQRNLYKDVMLENYRNLVSLGLSISKPAVISSLEQGKEPWMGVRDVTGRQCPDLASR

SEQ ID NO: 16262 - protein, 81 aa, Oryctolagus cuniculus
NPVMTAFEDLAVYFTWEEWQKMNNAQKILYRDVMLETYSNLSSLGHCITKPDLIFKLERGEEPWMVDECLNQSLSVVMKRD

SEQ ID NO: 16263 - protein, 81 aa, Oryctolagus cuniculus
SPVMTAFEDLAVYFTWEEWQKMNNAQKILYRDVMLETYSSLFSLGHCITKPDLIFKLEQGEEPWMVDECLNQSLSVVMKRD

SEQ ID NO: 16264 - protein, 81 aa, Oryctolagus cuniculus
LQVLVSFEDLAVDFTQEEWQDLDNAQKTLYKDVMLETYSSLLSLGHCIIKPDLIYKLEQGAEPWIVEKPLNQSLPGKSTHI

SEQ ID NO: 16265 - protein, 81 aa, Pteropus alecto
GCVTFEDVAIFFSQEEWCLLDEAQRCLYHHVMLENLALMASLVCWRATENEETPSEQSVSIEALSQVRTPKAGPSTQKTHP

SEQ ID NO: 16266 - protein, 81 aa, Pteropus alecto
TTELVTFQDVVVDFSPEELASLSAAQRNLYREVMLENYRNLVSLGYQFSKPDVISQLEEEESRVIEEDSDKKMCQDWEKRT

SEQ ID NO: 16267 - protein, 81 aa, Oryctolagus cuniculus
MIGFEDLAVYFTWKEWQNMNNAQKILYRDVMLETYSILFSLGHCMTKPDLILKLEHGAEPWMVEECLHQSLPVAVKRDDLI

SEQ ID NO: 16268 - protein, 81 aa, Pteropus alecto
MLENYSHLLSVGYEIPKPEVIFKLEQGEEPWVLERETPHQSCSDGKFGIKISQKRSSRKASFYSEMEGEDTRDGPLYSILE

SEQ ID NO: 16269 - protein, 81 aa, Oryctolagus cuniculus
MTFDDVALYFSEQEWEILQKWQKEMYQQVMKANYETLDSLDGGLPKPELITWIEQQGEFGSCTESQKPRNIICSSADTHFD

SEQ ID NO: 16270 - protein, 81 aa, Oryctolagus cuniculus
SQGLVTFEDVAVYFSLEEWARLDASQRGLYQEVMQENYGILVSLGAWFWADDMEDHEEEDDEDFLAEVAEEENEPPGLWSA

SEQ ID NO: 16271 - protein, 81 aa, Oryctolagus cuniculus
VMIAFEDLAVYFSWEEWQKMNNAQKILYRDVMLETYSSLFSLGEIHMEETCNTSTVTRPHTGKKPYACKPCEKSFDSKCCH

SEQ ID NO: 16272 - protein, 81 aa, Oryctolagus cuniculus
AGYQVSKPEVIFKLEQGEEPWISEGEIQRRFCADWKTRSEAKSSNLHQGIAEVSRSTDGLSSATLEDTCDISSQLERHQEN

SEQ ID NO: 16273 - protein, 81 aa, Oryctolagus cuniculus
MVLMSFEDLAVDFTWEEWKFLTNAQKTLYRNVMLETYSNLLFLIAPNDDLIGNNQESQDIKLNQNVITNNSTSTPKRIKLR

SEQ ID NO: 16274 - protein, 81 aa, Rhinolophus ferrumequinum
KPRGLKFADVAVYFSPEEWGCLRPAQRALYRDVMRETYGHLGALGFRGTKPALISWVEEEAELWGPDARDPEMGECLTEAD

SEQ ID NO: 16275 - protein, 81 aa, Rhinolophus ferrumequinum
QNHCQRNLVSYCHRRSIYLLTHLCCEEEDRGCSISKPHVITLIEQGKDPWMVVRDEKKRWSLDLESRYDIKKLSQKDIYEM

SEQ ID NO: 16276 - protein, 81 aa, Phyllostomus discolor
DENVVTFQDLYICFTPEEWLLLDEGQRRLYCSVALETFLTAASVGLLICRPPMITQPGPVRQPNVPHRVDVSLVRTNMIQG

SEQ ID NO: 16277 - protein, 81 aa, Phyllostomus discolor
SRKPVSFADVAVYFSPEEWGCLRPVQRALYRDVMRETYGHLGALGFQDTKPALISWMEEEAELWGSDARDPELGECLSEDT

SEQ ID NO: 16278 - protein, 81 aa, Macaca fascicularis
KPRTVSFADVAVYFSREEWGCLRPAQRALYRDVMRETYGHLGALGFPGPKPALISWMEQETEAWSPAAQDPEKGERLGGAR

SEQ ID NO: 16279 - protein, 81 aa, Macaca fascicularis
TEECMVFEDVAIYFSREEWGILNDAQRHLHSNVMLENFALLSSVGCWHGAKDEEVLSKQCVSVRVLQVTAPKPALPTLKAQ

SEQ ID NO: 16280 - protein, 81 aa, Macaca fascicularis
QVTFSDVAIDFSHEEDLYKDVMVQNYKNLVSVTGLSVTKPYVITLLEDGREPWMVEKKLFIFFTYCFIYYVYFTHFCYHSF

SEQ ID NO: 16281 - protein, 81 aa, Macaca fascicularis
AQESLTLRDVAVDFTWEEWQLLGPAQKHLYRDVMLENYSNLVSVGFQASKPDALTKLEQGEPLWALEDEIHSPTHPEIEKA

SEQ ID NO: 16282 - protein, 81 aa, Macaca fascicularis
ADVSLAFRDVSIDLSQEEWECLNPAQRDLYKDVMLENYSNLVSLGYTIPKPDVITLLEQQKEPWIVMREGTRSWYTDLEYK

SEQ ID NO: 16283 - protein, 81 aa, Macaca fascicularis
TARSQETVTFKDVAMDFTPEEWGKLDPAQRDVMLENYRNLVSLWLPVSKPENYNLENGKEPLKLERKTPKSSYSDVETRPQ

SEQ ID NO: 16284 - protein, 81 aa, Macaca fascicularis
ASVALGDVAVNFTREEWALLGPCQKNLYKDVMQETIRNLDCVGMKWKDQFLFKDQIEEQYKYPRKNLRCRMLERFGESKDG

SEQ ID NO: 16285 - protein, 81 aa, Macaca fascicularis
YQDSVTFDDVAVEFTPEEWVLLDTTQKYLYRDVMLENYMNLASVEWEIQPRTKRSSLQQGFLKNQIFTGIQMTRGYSGWKL

SEQ ID NO: 16286 - protein, 81 aa, Macaca fascicularis
MLENYSHLVSVGYLVAKPDVIFRLGPGEESWMADGGTPVRTCAEVWQVDEQIDCYKESQDKLLWQAAFIGKETLKDESGQE

SEQ ID NO: 16287 - protein, 81 aa, Macaca fascicularis
EMGPLTFRDVAIEFSLEEWQCLDTAQQDLYRKVMLENYRNLVLAGIDVSKPNLITCLEQGKYPWNMKRHSMVVKPPGFLLP

SEQ ID NO: 16288 - protein, 81 aa, Phascolarctos cinereus
SQELVTFQDVAVDFTQEEWGHLEPAQKDLYREVMLENYQNFVSLGLAVSKPEVISQLERGKALWLPDGGVPRCTFLTSFAQ

SEQ ID NO: 16289 - protein, 81 aa, Phascolarctos cinereus
NFWILRLPPGSKGEVPKEWGKLEEWQKELYKHVMRGNYEMLVSLDYAVSKPDILSQIERGEKPCLKDQWGSDEEVSCPGKL

SEQ ID NO: 16290 - protein, 81 aa, Phascolarctos cinereus
FQKLLTFKDVAVEFTQEEWGQLNSSQKNLFRDVMLENYKNFVYLGLPVSMPAVILLLERGEVPRMSEGEVPRGIHSDSVSQ

SEQ ID NO: 16291 - protein, 81 aa, Phascolarctos cinereus
LKQSVTFKDVAVDFTREEWRRLGPAQRDLYRDVMLENYNNFASLGLPFFKPDMISQLERGEGPWTPEAEVPQVTCPESLVQ

SEQ ID NO: 16292 - protein, 81 aa, Phascolarctos cinereus
IQASVTFRDVAVDFTWEEWRRLDPAQRALYRDVILENYENLISLGIPVSKLDVISLLVRGEAPWMPSGEGQRVFCADSISG

SEQ ID NO: 16293 - protein, 81 aa, Phascolarctos cinereus
CKESVTFKDVAVEFTWEEWVHLNSSQKTLYRDVMLENYRNLVSLGFAVSKPDVIYQLERKEASWIPGADIPRSSCPESKEF

SEQ ID NO: 16294 - protein, 81 aa, Myotis lucifugus
FQGSVTFRDVAIDFSQEEWAWLQPAQRDLYRHVMLENYGHLVSLGLNISKPDVVSLLEQGKEPWLGKGDVRTDFFPVSESN

SEQ ID NO: 16295 - protein, 81 aa, Myotis lucifugus
QNMNFEDVAIVFSEEEWGLLDEAQRLLYCNVMLEVFALVSSTGCCHKTDDEETCSEQSVSVQGESQVRTSKTEPATQRTHL

SEQ ID NO: 16296 - protein, 81 aa, Myotis lucifugus
QTGDVNFEDVAIAFSEVEWVILDDAQRLLYYDVMLEVFALVSSVGCWHKMEDEEASFDQQVCIQGKLQVRTSKTAPVTQKN

SEQ ID NO: 16297 - protein, 81 aa, Myotis lucifugus
RVQNMNFEDVAIVFSEEEWGLLDEAQRLLYCNVMLEVFTHFSSAGCWHNTDDEETCSELSMCVQGESQVRASQTEPATQRT

SEQ ID NO: 16298 - protein, 81 aa, Puma concolor
FREPVTFEDVTLGFTSDEWGLLDLEKKSLYREVMLENYRNLVSVEHQLSKPDVVSQLEEEEALWSVERGIPQDTFSECPAA

SEQ ID NO: 16299 - protein, 81 aa, Sapajus apella
VQVSLTFEDVAVLFTRDEWRKLAPSQRNLYRDVMLENYRNLVSLGLPFTKPKVISLLQQGEDPWKVEKDCSGSSSLGCKSN

SEQ ID NO: 16300 - protein, 81 aa, Sapajus apella
SQELLTFKDISIDFTQEEWGQLTPAHQNLYREVMLENYSNLVSVGYQLSKPVVISQLEKGEEPWMTEKEGPGDPSSDLKSN

SEQ ID NO: 16301 - protein, 81 aa, Sapajus apella
SQDLVTFKDVAIDFSQEEWQWMNPAQKRLYRSMMLENYQSLVSLGLCVSKPYVISLLEQGREPWEMTSEMTRSPFSDWESI

SEQ ID NO: 16302 - protein, 81 aa, Sapajus apella
GTVTFEDVAVKFSQEEWSLLSEAQRCLYHDVMLENLALISSLGCWYGAKDETPSKQTLSIQQQSPLRSHWTGVCTKKAHPW

SEQ ID NO: 16303 - protein, 81 aa, Sapajus apella
SQELVTFKDVVVHFSLEELSSLSAAQRNLYREVTLENYRNLVSLGYHFSKPDIISRLEKEESRAVETDSNAVICQGESHDD

SEQ ID NO: 16304 - protein, 81 aa, Sapajus apella
WSQMPVTFEDVALYLSREEWGRLDHTQQNFYRDVLQKRNGLSLGFPFSRPFWAPQVQGKGEASGSSRQTGEEKEDWRGACT

SEQ ID NO: 16305 - protein, 81 aa, Sapajus apella
FQKAVTFKDVAVVFSSEELRLLDLTQRTLYRDVMVENFKNLVAVGHLPFQPDMVSQLEAEEKLWMMEAETQRSSKHQNKME

SEQ ID NO: 16306 - protein, 81 aa, Sapajus apella
MLETYNHLVSLEIACSKPKLIAQLERGEEPWREERKCSLDLRPAGSKPEIQLCPSCPLMFSSQQALSQHVWLSHLPQLSSS

SEQ ID NO: 16307 - protein, 81 aa, Sapajus apella
QTEVTFEDVAVLLSREEWGRLGPAQRGLYRDVMLETYGNLVSLAVGTSTEYKELTSWETFDEEELGQLKGIFPQGSEPVDA

SEQ ID NO: 16308 - protein, 81 aa, Sapajus apella
MGPLEFMDVAIEFSLEEWQCLDTAQRNLYRDVMLENYRNLVFLGIVVSEPDLITCLEKGKKPLTVKGHEMIATPPVMCSHF

SEQ ID NO: 16309 - protein, 81 aa, Sapajus apella
MLENYRNLVFLAGIAVSKADLITCLQEEKDPWNMKRHSMVAKPPVIYSHFAQDLWPEQGIKDSFQEVILRRYRKCGHEDLQ

SEQ ID NO: 16310 - protein, 81 aa, Sapajus apella
AQEQVTFWDVAVYFSREEWECLEPSQRALYRDVMLDNFSNVAALGFCSPRPDLVSRLEQWEEPWVEDQERPELQAVQRGPR

SEQ ID NO: 16311 - protein, 81 aa, Sapajus apella
MPEQVTFEDVVVDFTQEEWRQLEPAQRTLYCDVMLDTFRLLVTVGHWLPKPNIISLLEQEAELWDVDPGVPQSVYQDLESR

SEQ ID NO: 16312 - protein, 81 aa, Sapajus apella
EMDSVAFEDVDVNFTQEEWALLSPSRKQLYRDMMLETLRNLASAASLVERFSGRKEGSDHRETFSQIPDCHLNKKSHTAVK

SEQ ID NO: 16313 - protein, 81 aa, Oryctolagus cuniculus
PQALVTFEDVAVDFSQEEWQYLNPQQRTLYRDVMLEAYSNLVSVGQQVTKPDLILRLEAEELYPEGKIPIWNFLEVGHVDE

SEQ ID NO: 16314 - protein, 81 aa, Sapajus apella
LQGLLTFRDVAIEFSLEEWQCLDTAQQNLYRNVMLENYRNLAFLGIAVSKPDLITCLEKEKGPWNMKRHEMVDEPPGICPH

SEQ ID NO: 16315 - protein, 81 aa, Sapajus apella
MKLLTFRDVTIEFSPEEWKCLDPAQQNLYKDVMLENYRNLVSLGVAISNPSLVTCLEQRKEPFNVKIRKTVARPPAMCSPF

SEQ ID NO: 16316 - protein, 81 aa, Oryctolagus cuniculus
VQRPVTFEDVAVDFTQDEWDYLDDSQRALYQDVMSETCKNLASVARIFLTKPNVIAKCEPKEAPWRAAVRPPDNEVLSGGK

SEQ ID NO: 16317 - protein, 81 aa, Oryctolagus cuniculus
VMFQVTFSDVAVDFSPEEWGWLSSAQRDLYREVTVQNYENLVSLGLSVAKPCVITLLEDGKEPWMVEKNLPKDWEPRWESK

SEQ ID NO: 16318 - protein, 81 aa, Oryctolagus cuniculus
LQVMIAFEDLAVYFTWEEWQKMNNAQKILYRDVMLETYSSLFSLGSCITKPDLIIKLEQGAEPWMVEEYLNESLPGQCAHN

SEQ ID NO: 16319 - protein, 81 aa, Oryctolagus cuniculus
FQGLVTFRDVALDFSQEEWEWLNTSQKDLYKEVMLENYRNLVWLGISISKPNMISLLEQGKEPWIVERKLSRGHRADWEPW

SEQ ID NO: 16320 - protein, 81 aa, Rhinolophus ferrumequinum
DEALMAFRDVAVAFTRKEWKLLSPAQRILYRDVMLENYSHLVSLGIAFSKPKLITQLEQGDEPWREESEWTETFSPAEPRK

SEQ ID NO: 16321 - protein, 81 aa, Rhinolophus ferrumequinum
VDGRLTFRDVAIDFSQEEWECLHPAERKLYTDVMLENYRNLCSLGLAVSKPDLVIFLERMKDAWDVQRKKTVSIHPAMSSA

SEQ ID NO: 16322 - protein, 81 aa, Rhinolophus ferrumequinum
PKVPVTFDDVAVYFSELEWGKLDEWQKELYKHVMRGNYEMLVSLDYAISKPDILTRMERGEEPCPEGVWCQEEGKEREAAC

SEQ ID NO: 16323 - protein, 81 aa, Rhinolophus ferrumequinum
GSDLFRDVAVVFSQEEWERLVPAQRDLYRDVMLETYSNLVSLDLETKPDVKESDLKEGISESRPSAGVVVEGPTRNGAWRS

SEQ ID NO: 16324 - protein, 81 aa, Ursus maritimus
TQEEWGQLEPDQRTLYRNVMLETFRLLVSVGKATTEPPMNISIFFLSDLETQPKTKLLAPKQDITEERASSVLVERFLWDS

SEQ ID NO: 16325 - protein, 81 aa, Rhinolophus ferrumequinum
FKVTLSFKDVFVDFTSGEWQLLDAAQKNLYWNVMLENYSNLVSVEDTWRVDDGVNWHQEHSDKLDPVETHGVLCGYGACGE

SEQ ID NO: 16326 - protein, 81 aa, Ursus maritimus
LFQGSLSFKDVAVVFTWEEWQLLDPVQKNLYQDVMLENYSNLVSVGYQVTKADAFYQLENGTPWITEEEIQSQSHPEDTWE

SEQ ID NO: 16327 - protein, 81 aa, Gorilla gorilla
VTLKDVGMDFTLGDWEQLGLEQGDTFWDTALDNCQDLFLLGEFPRGSPLWETFALALSDVTETKNSPLMEDFFEEGFSQEI

SEQ ID NO: 16328 - protein, 81 aa, Gorilla gorilla
IQSQISFEDVAVDFTVEEWQLLNPTQKNLYRDVMLENYSNLVFLEVWLDNPKMWLRDNQDNLKSMERGHKYDVFGKIFNSS

SEQ ID NO: 16329 - protein, 81 aa, Ailuropoda melanoleuca
MDVMLENYCHLISVGCHMTKPDVILKLERGEEPWTSFTGHTCLEENWKEEDFLVKFKEHQDKFSRSVVFINHKKLSKENSN

SEQ ID NO: 16330 - protein, 81 aa, Ailuropoda melanoleuca
RESGKAPVTFDDITVYLLQEEWMLLSQQQKEICGSDKLVAPLGPTIATPELFYKFEQGPEPWLGNVQGQRNVLSHQPGKNK

SEQ ID NO: 16331 - protein, 81 aa, Ailuropoda melanoleuca
QEPVTFEDVAVYFTQNQWAKLDPTQRALYREVMLENYANVASLGVAFPFPKPDLVSQLERGEVPWGPDPWEAEVLRGICPG

SEQ ID NO: 16332 - protein, 81 aa, Ailuropoda melanoleuca
RKGCVTFEDMAIYFSQEEWVLLDEAQRHLYHDAMLENFALIASLVCWHGMEDEEAPFEQSVAGEVLLWRVHTGERPHECSE

SEQ ID NO: 16333 - protein, 81 aa, Ailuropoda melanoleuca
FQGSLSFEDVTVGFTQEEWQHLDPAQRSLYRDVMLENYSHLVSLGCCIPKPEVILKLEQGEQPWILEEESPGQSYPEVCRV

SEQ ID NO: 16334 - protein, 81 aa, Ailuropoda melanoleuca
FRGTVTFKDVAIDFTQEEWQQLDPAQRNLYRNVMLENYNNLITVGCPFTKPDVIFKLEQEEEPWVVEEEVLRRHCPGEMWG

SEQ ID NO: 16335 - protein, 81 aa, Gorilla gorilla
MLENYSHLVSVGYLVEKPDVIFRLGPGEESWMADGGTPVRTCAEVWQVDEQIDHYKESQDKLPWQAAFIGKETLKDESGQE

SEQ ID NO: 16336 - protein, 81 aa, Ailuropoda melanoleuca
QGHVTFEDVAVYFSWEEWGLLDEAQRLLYRDVMLENFSLMASLGKVLTTHSNVLFSDSSTCLHVLGIAITDSTSLNFAFLK

SEQ ID NO: 16337 - protein, 81 aa, Ailuropoda melanoleuca
LMGSLSFGDVAVDFSQEEWQHLDPAQRTLYRDVMLENYHNFVSVGYLIKKPALIFKLEEGKEPWILEEEFLYQNYPGELVS

SEQ ID NO: 16338 - protein, 81 aa, Gorilla gorilla
SPLAMAEMDPTQGRVVFEDVAIYFSQEEWGHLDEAQRLLYRDVMLENLALLSSLGKLTLAQCPGLGCVTPFYPKAALRFPQ

SEQ ID NO: 16339 - protein, 81 aa, Gorilla gorilla
QGTVTFEDVAVNFSQEEWCLLSEAQRCLYRDVMLENLALISSLGCWCGSKDEEAPCKQSISVQRESQSRTPRAGVSPKKAH

SEQ ID NO: 16340 - protein, 81 aa, Lynx canadensis
KSPGLLSFKDVAVVFTWEEWQLLDPIQKHLYQDVMLENYSNLVSVGCQVTKADAFYQLEQGPPWITEEEIQSQIHPDDTWQ

SEQ ID NO: 16341 - protein, 81 aa, Lynx canadensis
PLRLSSSASHTQAAPSFKDVTVEFTEEEWKHLGPAQRTLYRHMRILVDEQTLPRHCLENAILFFMIATFIICVISCSVSTN

SEQ ID NO: 16342 - protein, 81 aa, Lynx canadensis
FQGSVTFQDVAVDFTPEEWQLLDCDQRTLYWDVMLENFRNLTAVGGPVTKTKVIFKEEQGQESWMVEGENPCWRYPEADWL

SEQ ID NO: 16343 - protein, 81 aa, Lynx canadensis
IQGSLTFGDVAVAFTQIEWKHLDAAQRALYTDVMLENYGNLVSVGLLSSKPKLITQLEQGSEPWMEVQQVPSGTCSVQEYW

SEQ ID NO: 16344 - protein, 81 aa, Lynx canadensis
MLENYGNLVSVGLLSSKPKLITQLEQGSEPWMEVQQVPSGTCSVQEYWFETKVSTLKQNTSEGSDLGEQTKIDMMERGLDW

SEQ ID NO: 16345 - protein, 81 aa, Lynx canadensis
FQWLVTFRDVAINFSQEEWECLNSTQRDLYRDVMLENYSNLISLAGCAIPKPDVFSLLEQGKDPWMVTRAMTRRWSSDLES

SEQ ID NO: 16346 - protein, 81 aa, Lynx canadensis
LFIGLLTFRDVAIEFSRKELGCLNHSQWELYRDVMLENYGHLLFLGLVVSKPDLVIFLEHKRDVWAVKRKETVATHPGWWN

SEQ ID NO: 16347 - protein, 81 aa, Lynx canadensis
WSQDSVTFEEVAVDFSQEEWALLDPTQKILYRDVMLENYRNLASVGYPLCKHSLITEVGQEALSTEERGMLQGACIGLDIQ

SEQ ID NO: 16348 - protein, 81 aa, Phyllostomus discolor
LQEPVTFRDVAVDFTQEEWGQLGPAQRTLYRDVMLETFGHLLSVGPELPKPDVISQLEQGTELWMVERGIAQGRHPGENPP

SEQ ID NO: 16349 - protein, 81 aa, Phyllostomus discolor
AQGHVVFEDVAVHFSQEEWGLLNEAQRCLYHSVMLENLALLSSVGCWSGAQDEEAPLEQGDSGGGSQVRTPKSALSTQKTQ

SEQ ID NO: 16350 - protein, 81 aa, Myotis lucifugus
VNFEDVAIAFSEVEWVILDDAQRLLYYDVMLEVFALVSSVGCWHKMEDEEAPSDQQVCIQGKSQVRTSKTAPVTHKNHLCK

SEQ ID NO: 16351 - protein, 81 aa, Puma concolor
SQHLVTFEYVAVDFTQEEWTLLDQTQIVLYRDVMLENYQNLITLGSELSPQSLTSALEAAELLRTGGRGVLQEVDLQLQTK

SEQ ID NO: 16352 - protein, 81 aa, Puma concolor
SQGSVTFRDVAIDFSQEEWEWLQPPQRDLYRHVMLENYSHLVSLGLNISKPYVVSLLEQGKEPWLEKRGVRRDLFSVSEPN

SEQ ID NO: 16353 - protein, 81 aa, Sapajus apella
FQGSISFKDVTVGFTQEEWQHLDPSQRALYRDVTLENYSNLVSVGYCVHKPEVIFRLEQGEEPWRLEEEFPSQSFPEVWTA

SEQ ID NO: 16354 - protein, 81 aa, Sapajus apella
PQERLTFRDVAIEFSQEEWKCLDPAQRTLYRNVMLENYRNLVSLGISLPEMNIVSTLEQGKEPRTVESEVKITKTSNGWKC

SEQ ID NO: 16355 - protein, 81 aa, Sapajus apella
MGPLTFMDVTIEFSLEEWQCLNTAQQNLYRDVMLENYRNLVFLGIALSKPALITYLEQGKEPWNMKRHETVAKPPVMCSYF

SEQ ID NO: 16356 - protein, 81 aa, Sapajus apella
MLENYSHLVSVGYLLAKPDMIFRLGPGEESWRADGGTPVRTCAGEDRPVFHYGRLRLNSSCCSCHPPKEVWQVDKQIDCYK

SEQ ID NO: 16357 - protein, 81 aa, Sapajus apella
VQGLMAFKDVAVDFSREEWDFLDATQRHLYRCVMLENYSNLASVRLSILKPDVISLLEEESQPWLVNRGMTAGPCPGEWEL

SEQ ID NO: 16358 - protein, 81 aa, Sapajus apella
SQNSVTFQEVAVDFSQEEWALLDLAQKNLYKDVMLENFRNLTSVGYQLCRHNLISKVHQEELKTDEGGILQSDSAEWETQL

SEQ ID NO: 16359 - protein, 81 aa, Sapajus apella
GSRGCAPGDVAVEFTQEEWQHLGPVEWTLYRDVMLENYSHLVSVGYCITKPKVISQLEQGEEPWSLEDEFLNQRYPGHFKV

SEQ ID NO: 16360 - protein, 81 aa, Sapajus apella
LVTFRDVALDFSQEEWEWLKPSQKDLYRDVMLENYRNLVWLDWESWCEIKELSPKWFTDEDEISQEVVMERLASHGLDHCS

SEQ ID NO: 16361 - protein, 81 aa, Sapajus apella
FQELVTFTDVAIDFSRQEWEYLDPHQRDLYRDVMLENYRNLVSLGGHSISKPVLVDLLEQGKEPWMILREETQFPDLDLQC

SEQ ID NO: 16362 - protein, 81 aa, Sapajus apella
MLENYSHLVSLGYQVSKPEVIFKLEQGEEPWISEGEIQRPFCPDWKTRPEFKSSHLQQDVSHCTDDFSRATLEDSWDVSSQ

SEQ ID NO: 16363 - protein, 81 aa, Sapajus apella
ELESVTFKDVAIDFTLEEWRLMDPTQRNLHKDVMLENYRNLVFVGLAVSKPDMISHLENGKGPWVTVREISRIPYPDLETK

SEQ ID NO: 16364 - protein, 81 aa, Sapajus apella
FQEPLTFMDVAIEFSLEAWQCLDNAQQNLYRKVMLENYRNLVFLGIAVSKADLITCLQQGKDPWNMKRHSMVAKPPVIYSH

SEQ ID NO: 16365 - protein, 81 aa, Oryctolagus cuniculus
VYFSQEEWELLEPTQKALYDAVMQENYEAVISLALFVLPKPKVISCLEQGEEPWVRGALEIQHGLGEPPTGVKLKNDTENH

SEQ ID NO: 16366 - protein, 81 aa, Oryctolagus cuniculus
SLVLMSFEDLAVDFTWEEWKFLTNAQKTLYRNVMLETYSNLLFLRHCITKPDLIFKLEQGPEPWMVEEHLNQSLPVAPNDD

SEQ ID NO: 16367 - protein, 81 aa, Oryctolagus cuniculus
ASEGSVSFRDVAIDFSSEEWQHLEPAQRSLYWDVMQETFSHLLSVGYQVPEPEIFMLEQGKGPWALWNESRYQSCSEEKLW

SEQ ID NO: 16368 - protein, 81 aa, Oryctolagus cuniculus
LVTFRDVALDFSQEEWEWLNTSQKDLYKEVMLENYRNLVWLDWEPWCEIKELSPKCFIDDEEISQGMVMERPIRNDLECSS

SEQ ID NO: 16369 - protein, 81 aa, Macaca fascicularis
MEHLTFRDVAIEFSPEEWKCLDPAQQNLYRDVMLENYRNLVSLAMCSHFTQDFLPVQEIEDSFHKLILRRYEKCGHENLQL

SEQ ID NO: 16370 - protein, 81 aa, Macaca fascicularis
TQGQVTFRDVAIEFSQEEWTCLDPAQRTLYRDVMLENYRNLASLAGISCFDLSIISMLEQGKEPFTVESQVQIARNPDGWE

SEQ ID NO: 16371 - protein, 81 aa, Macaca fascicularis
MAQVTFSDVAIDFSHEEWAWLDSAQRDLYKDVMVQNYENLVSVGLSVTKPYVIMLLEDGKEPWMVEKKLSKGMIPDWESRW

SEQ ID NO: 16372 - protein, 81 aa, Macaca fascicularis
QRGGVAASGPCPEDPVQRCDAGELQPPPLYRDVMLENYSLLLSVGYCITKPVVICKLEHGEVLWILEEESPSQSHLDCCID

SEQ ID NO: 16373 - protein, 81 aa, Macaca fascicularis
PQGLVTFEDVAVDFTQEEWQYLNPPQRTLYRDVMLETYSNLVFVGQQVTKPNLILKLEVEEYPAEGKIPFWNFPEVCQVDE

SEQ ID NO: 16374 - protein, 81 aa, Macaca fascicularis
PRGLEMGLLTFRDVAIEFSLEEWQHLDIAQQNLYRNVMLENYRNLAFLGIAVSKPDLITCLEQGKEPWNMTQHEMVDESPG

SEQ ID NO: 16375 - protein, 81 aa, Macaca fascicularis
VMFRDVAIDFSQEEWECLDSAQRDLYRDVMLENYSNLVSLDLPSRCASKDLSPEKNTYETELSQWEMSDRLENCDLEESKS

SEQ ID NO: 16376 - protein, 81 aa, Macaca fascicularis
WSQNSVTFQEVAVDFSQEEWALLDPAQKNLYKDVMLENFRNLASVGYQLCRHSLISKVDQEELKTDERGILQGDCADWETR

SEQ ID NO: 16377 - protein, 81 aa, Phascolarctos cinereus
CKESVTFKDVAVDFSQEEWGQLNPAQRQLYRDVMLENYRNLVSLGLPVSKPEVISHLERGVIPWMLERKVPRDICPESISR

SEQ ID NO: 16378 - protein, 81 aa, Phascolarctos cinereus
SQESVTFKDVAVNFTQEEWGQLNPAQRELYRDVMLENYRNLISLGLPISKPDVIFQLEQGQEPWMLDVQGTEGGGVPRNTS

SEQ ID NO: 16379 - protein, 81 aa, Phascolarctos cinereus
SQELVTFEDVAIYLTEEEWVLLDPAQKRLYRNVMLENYGNVLLQGFPIPKPDLISRLERGEIPCVPFLLRTKIQVIRFDCG

SEQ ID NO: 16380 - protein, 81 aa, Phascolarctos cinereus
PKVPVTFDDVAVYFSEKEWGNLDKWQKELYKHVMTGNYEMLVSLDYALSKPEFLTRIEQGEEPCVQNQLDSEETEIATNPE

SEQ ID NO: 16381 - protein, 81 aa, Phascolarctos cinereus
RFQLPVTFRDVAVDFSSEEWRRLSPAQRALYRDVMLENYENLVSLGLSVSKPDVISQLEKDVPWTPEGGFPSDPYPDSFKQ

SEQ ID NO: 16382 - protein, 81 aa, Phascolarctos cinereus
PQESVTFKDVAVDFTWEEWGYLDTSQKELYQEVMLENYRNLVSLGFVVAKPDVISQLEQGEAPWRPEGRFPRSRHPDSDTR

SEQ ID NO: 16383 - protein, 81 aa, Phascolarctos cinereus
AQELVTFKDVVVDFTPEEWGLLNHSQKELYKEVMVENTRNLLSLGLPVLREGLISHFGQGEAPRMQEQEDLRTSCPDGETR

SEQ ID NO: 16384 - protein, 81 aa, Phascolarctos cinereus
PQEPVTFKDVAVDFSQEEWGLLGPAQRHLYRDVMLENYRNLVSLGLILAKPEVVCHLEQGGELWKPEHGVLCSGDGELWVR

SEQ ID NO: 16385 - protein, 81 aa, Phascolarctos cinereus
LLPVTFSDVAVDFSSEEWRLLSPAQRALYRDVMLENYENLVSVGAGLPPSKPDVISQLEKGETPQMLKAGVLRAIYPGIHV

SEQ ID NO: 16386 - protein, 81 aa, Phascolarctos cinereus
KVPVTFVDIAVYFSEDEWKNLDEWQKELYNNLVKENYKTLMSLGAENPMPKPDAQSRVEPREEPCVWEQHNPEEREIPMDP

SEQ ID NO: 16387 - protein, 81 aa, Phascolarctos cinereus
PQELVTFQDVAVDFTQEEWGLLDHPQKELYKEVMLENAQNLLSLGVPVPKENFISNFEQREGPLILVREDPRHSSPDGETR

SEQ ID NO: 16388 - protein, 81 aa, Phascolarctos cinereus
DQEVVSFRDVAVDFTEEEWECLSPAQWQLYKEVMLENYRNLVSLGLLEDKPDLVSRLEQGEEAWASDMQEEGPRSPCPWGG

SEQ ID NO: 16389 - protein, 81 aa, Phascolarctos cinereus
HQEPVTFQDVVVVFTREQWAYLDPSQKELYRDVMLETYRNLLCLGLAMSKPQVIRQLERREAPWIPERRIPGSSCPDWETR

SEQ ID NO: 16390 - protein, 81 aa, Phascolarctos cinereus
EQELVTFKDVAVDFTQDEWRQLSQAQRDLYRNVMLENYKNLVSLGLLVSQPDVLSQLQRGKVPWIPEGDIPRGTCPDFLTQ

SEQ ID NO: 16391 - protein, 81 aa, Phascolarctos cinereus
CQESVTFKDVAIDFTQEEWGHLDSSQKELYREVMLENYSNLVCLGLAASRPDLISHLKQGEAPWVARRDVEAGTWPDCETG

SEQ ID NO: 16392 - protein, 81 aa, Phascolarctos cinereus
TGESVTFKDVAVDFTAEEWGCLGPSEKKLYRDVMLENYGHLVHLGLAVSKPDVICHLERGDPPWKPVIKVPRTSFPDGETR

SEQ ID NO: 16393 - protein, 81 aa, Phascolarctos cinereus
AAVPMTFDDLAMYFSEQEWRQLVEWQKELYKQVMKANYETLISLDYSISKPDLISLIELGEEPFIRNLKDSQETKTAFSSS

SEQ ID NO: 16394 - protein, 81 aa, Phascolarctos cinereus
HQGSVTFGDVAVDFSQDEWGHLDPAQKELYREVMLENYGNLVCLGLAVSKPHVIEQLERGEVPWLPRGAVPRSCGPGWEAE

SEQ ID NO: 16395 - protein, 81 aa, Myotis lucifugus
GSVSFADVAVYFSPEEWGCLRPAQRALYRDVMRETYGHLGALGGAPNKKEEEPKAVPGARSPRKTPGKDRPGEPVQHHPDW

SEQ ID NO: 16396 - protein, 81 aa, Myotis lucifugus
FQDLVTFGDVAIDFSQEEWEWLNLAQRNLYRKVMLENYRNLESLGVSVSKPEVISLLEQGREPWMATKARTEGTCSDWEYA

SEQ ID NO: 16397 - protein, 81 aa, Myotis lucifugus
LRQDMNFEDMAIPFSQEEWGLLDEAQRLLYCDVMLEVFAVVSSVGCWHKTDDVEACSEQNASIEGESLVRASKTAPTTQKS

SEQ ID NO: 16398 - protein, 81 aa, Puma concolor
MLETYNHLVSLEIPFSKPKLISQLEQGEEPWTEEKRCPLVLCPARSKLEIQPYPPCPLAFSSQRGLSQHVWLRHLPQLFSS

SEQ ID NO: 16399 - protein, 81 aa, Puma concolor
LTFKDVAIEFSQEEWECLDPAQRALYRDVMLENYRNLVSLGEDNICSELFSQNSHLANHQRIHAGQKPYKCNGCGKAFSVR

SEQ ID NO: 16400 - protein, 81 aa, Puma concolor
PQEPVTFEDVAVLFTPEEWMFLDSAQRSLYRDVMLENYRNLASVGDQLGKFSSFSHLEQGEEWWPTERRVFPGSCPEPSLP

SEQ ID NO: 16401 - protein, 81 aa, Sapajus apella
RESGKAPVTFDDITVYLLQEEWVLLSQQQKELCGSDKLVPPLGPTVANPELFCKFGRGPEPWLGSVQDQRNLLEHHPGKKQ

SEQ ID NO: 16402 - protein, 81 aa, Sapajus apella
LTFRDVAIEFSQEEWKCLDRAQRTLYRDVMLENYRNLVSLATYLQSGKVFNQKRQLVRHRRFHTGEKPYKCNECGKNFSQM

SEQ ID NO: 16403 - protein, 81 aa, Sapajus apella
IWGPLSFMDVFVDFTWEEWELLDPAQKCLYRSVMLENYSNLVSLGYQHTKPDIIFKLEQGEELCMVPAPIPNQCCPNKVWK

SEQ ID NO: 16404 - protein, 81 aa, Sapajus apella
PQGHLTFTDVAIEFSQEEWKCLDPAQRALYKDVMLENYRNLVSLGISLPDLNINSMLEQRREIWSGESEVKIAKSSDRREC

SEQ ID NO: 16405 - protein, 81 aa, Sapajus apella
MAHMAFRDVAVDFTQDEWRLLSPAQRTLYREVMLENYSNLVSLGISFSKPEIITQLEQGKETWREEKKCPPATCPDHQEYG

SEQ ID NO: 16406 - protein, 81 aa, Sapajus apella
ASVTVTFDDVALYFSEQEWEILEKWQKQMYKQEMKTNYETLDSLGYAFSKPDLITWMEQGRMLLISDQGLLHRTKRTTGPP

SEQ ID NO: 16407 - protein, 81 aa, Sapajus apella
EMETLTFRDVAIEFSLEEWQCLNPAQQNLYRNVMLENYRNLVFLGITVSKQNPITCLVQRKEPCNMKRHEMVARPKAMCSY

SEQ ID NO: 16408 - protein, 81 aa, Sapajus apella
SLETVTFKDVAVDLTQEEWEQMKPAQRNLYRDVMLENYSNLVTVGCQVTKPDVIFKLEQEEEPWVMEDEMFGRHCPEVWKV

SEQ ID NO: 16409 - protein, 81 aa, Gorilla gorilla
VHGSVTFRDVAIDFSQEEWECLQPDQRTLYRDVMLENYSHLISLAGSSISKPGVITLLEQEKEPWMVVRKETSRWYPDLES

SEQ ID NO: 16410 - protein, 81 aa, Gorilla gorilla
QGHVTFEDIAVYFSQEEWGLLDESQRCLYHDVMLENFSLMASVAGLSQSNHKDSCSQQKVPVSLNNCVAQCSPDDGHYAPK

SEQ ID NO: 16411 - protein, 81 aa, Ailuropoda melanoleuca
DSEAVVFEDVAVYFTRIEWSCLAPDQRALYRDVMLENYGHVASLGFLIAKPALISLLEQGEEPGALILQMTEERGSTASLR

SEQ ID NO: 16412 - protein, 81 aa, Macaca fascicularis
MGPLTFRDVTVEFSLEEWQCLDTVQQNLYRDVMLENYRNLVFLGIAVSKPDLITCLEQGKEPWNMNRHEMVATPPAFYLMG

SEQ ID NO: 16413 - protein, 81 aa, Macaca fascicularis
EPGIVSFVDVAVYFCREEWGCLRPAQRALYRDVMRETYGHLSALGIGGNKPALISWVEEEAELWGPAARDPETKCPTETDP

SEQ ID NO: 16414 - protein, 81 aa, Macaca fascicularis
MKPGVISHAPDSVVPAAFPFSKPDLIFQLEQGEAAWGPDPWTLAGGEALRGMCTGGKTKTKNEEQTAQLNISKESESHRLI

SEQ ID NO: 16415 - protein, 81 aa, Macaca fascicularis
SQGSVTFRDVAIDFSQEEWKWLQPAQRDLYRCVMLENYGHLVSLGLSISKPDVVSLLEQGKEPWLGKRNVNRDLFSVSESS

SEQ ID NO: 16416 - protein, 81 aa, Macaca fascicularis
LKGLVTFEDVAVEFTQEEWALLDPAQRTLYRDVMLENFRNVASLGDQVDKPGLITQLEQEDEVMTEERGILPGTCPDVENP

SEQ ID NO: 16417 - protein, 81 aa, Macaca fascicularis
QASVCFEDVAMAFTQEEWEQLDLAQRTLYREVTLETWEHIVSLDWKTTLEENRLNSEKDRAREELSHHVEVKQCVQEEPPC

SEQ ID NO: 16418 - protein, 81 aa, Macaca fascicularis
QGTVTFEDVAVNFSQEEWSLLSEAQRCLYHDVMLENLALISSLGCWYGAKDEPPSKQTLSIQQESPLRTHWTGVCTKKVHL

SEQ ID NO: 16419 - protein, 81 aa, Macaca fascicularis
TFQDVAIDFSKEEWGFLNPAQRDLYTTVMLENYQNLVWLGLSISKSVISLLEKRKLPWIMGKEEIRVPLPATIYIYFYKCL

SEQ ID NO: 16420 - protein, 81 aa, Macaca fascicularis
MAFTQLTFRDVAVEFSQEEWKCLDSTQRTLYRDVMLENYRNLVSLEYYLMWEHRKEPWTMESQVQIARKPKGWEWIKGVKI

SEQ ID NO: 16421 - protein, 81 aa, Phascolarctos cinereus
FQESLTFKDVAVDFTQEEWQRLKPDQRYLYRDVMLENYRNLVSLGYQVSKPDVISQLEQGEEPWTIEREVSTYSCRDWETR

SEQ ID NO: 16422 - protein, 81 aa, Phascolarctos cinereus
IKESVTFKDVAVEFTWEEWRHLETAQRDLYRRVMMENYKNFVFLGLPVSKLDVISLLERGEAPWMPEGGVPSRCCPGSHTQ

SEQ ID NO: 16423 - protein, 81 aa, Phascolarctos cinereus
QQGSVTFQDVAVDFSWEEWGHLGPTQKELYREVMLENYGNLVCLGLAVSSPDVVCQLERGEGPWMPEGDAPGSSRAGSSKH

SEQ ID NO: 16424 - protein, 81 aa, Phascolarctos cinereus
PEGSVTFQDVAVTFTPEEWGRLATPQKELYREVMLENFGHLACLGLALSKPEVICQLERGEAPWMPGGDVPQMPSADLEVA

SEQ ID NO: 16425 - protein, 81 aa, Phascolarctos cinereus
AQEVVTFQDVAVDFTQEEWGFLDHPQKELYKEVMLENAQNLLFLGLPVPREDLISYFEEREAPWLLEQEGLRGCCPEGQIG

SEQ ID NO: 16426 - protein, 81 aa, Phascolarctos cinereus
SEKSLTFQDVAVDFTREEWGQLDPAQKNMYRDVMLENYENFISLGLPVSKLDVISHLEKREAPWLLGGKVLQSPQLDSLVL

SEQ ID NO: 16427 - protein, 81 aa, Phascolarctos cinereus
PKVPVTFDDVSIYFSTPEWEKLEEWQKELYKNIMKGNYESLISMDYAMTQPEVLSQTQPESQQNTENQVRPDESEMTAEPS

SEQ ID NO: 16428 - protein, 81 aa, Phascolarctos cinereus
RKESVTFKDVAVEFTQEEWVQLNPSQKKLYRDVMLENYKNLVSLGFAASKPNLINQLERKESSSLPEADIPRNSCPGDYIK

SEQ ID NO: 16429 - protein, 81 aa, Phascolarctos cinereus
LEPEGMARGSCRPPAQEEWGLLDHPQKELYKEVVVENAHNLLSLGRPVPRKDLMSYFEEKEAPWLLEQEGLRSCCPEGEIR

SEQ ID NO: 16430 - protein, 81 aa, Phascolarctos cinereus
TQDSVTFKDVAVDFTREEWERLNSTQRDLYRDVMLENYRNLVSLGLAVSKPDIIFQLEQEKELWMLKRKVLRSTRPAQKTE

SEQ ID NO: 16431 - protein, 81 aa, Phascolarctos cinereus
AQELVTFKDVVVDFTLEEWGLLDHSQKELYKEVMLETSQNLLSLGLPVLREDLIPPFHQGEAPGMLEQKGPRNSWPDAENK

SEQ ID NO: 16432 - protein, 81 aa, Myotis lucifugus
EYQLSKPEVVSRLEEEEELWSVERGIPQDTFSGRPEAPRDPPRDPLPAAAPPMQIEVVEVLSLNEEAARSRNARIWALYAG

SEQ ID NO: 16433 - protein, 81 aa, Myotis lucifugus
FQGLVTFRDVEIEFSQEEWKYLEPAQRDLYRDVTLENFGNLVSLGLSISKPDIISLLERGKEPWMIANDITGPRCPDLESR

SEQ ID NO: 16434 - protein, 81 aa, Myotis lucifugus
FQEPVTFKDVAVIFTEEELGLLNPSQRKLYRDVTLENFRNLVSVGTQLFKPDLIFQLEREEKLLFILIGIKNQHNVKSFQE

SEQ ID NO: 16435 - protein, 81 aa, Sapajus apella
ELVTFRDVLINFSQEEWEYLDSAQRNLYWDVMMENYSNLLSLDLESKYETKLLPVGTDIIKNSGSQWEVMESSKLCGLENS

SEQ ID NO: 16436 - protein, 81 aa, Sapajus apella
SLGSELFKDVAIVFSQEEWQWLAPAQRDLYRDVMLETYSNLVSLGLAISKPDVISFLEQGREPWMVERVVAGGLCPVLESR

SEQ ID NO: 16437 - protein, 81 aa, Sapajus apella
YQDSVTFDDLAVDFTPEEWMLLDPTQRNLYRDVMLENYKNLATVGCQLLKPSLISWLEQEESRTVQRGDFYEWKVQLKTKE

SEQ ID NO: 16438 - protein, 81 aa, Sapajus apella
LTFRDVAIEFSPEEWRCLDPTQRALYRDVMLENYRNLVSLDISSKCMMKEFSSTGPGNTKVFHTGTLEIHESHHIENFCFQ

SEQ ID NO: 16439 - protein, 81 aa, Sapajus apella
WDRTRSRSLKGTNPRSQPCISAFSAHCFTNRRIERRTGRLGMLSHGSCLCIYQPDVFSLLEKGKEPWKILRDETRGPCPDM

SEQ ID NO: 16440 - protein, 81 aa, Sapajus apella
EKETLTFRDVAIEFSLEEWQCLNPAQQNLYRNVMLENYRNLVFLADIAVSKQSPITGLEQKKESCNMKRHEMVARPTAMCS

SEQ ID NO: 16441 - protein, 81 aa, Sapajus apella
GKELLSFEDVAMYFTREEWGHLDWGQKDLYRDVMLENYRNMVLLGFQFPKPEVICQLENWDEQWILDLPRAGNRKASGSAC

SEQ ID NO: 16442 - protein, 81 aa, Sapajus apella
QQGPLTFRDVAIEFSLEEWQCLDTAQQDLYRKVMLENYTNLASLGIAVSKPDLITCLEQGKEPWNMKRHEMADEPPPVIYS

SEQ ID NO: 16443 - protein, 81 aa, Sapajus apella
YMGVLTFRDVAIEFCLEEWQCLDTAQQNLYRNVMLENYRNLVFLGIAAFKPDLITCLEQGQEPWNVKRHGMVAELPVVCSY

SEQ ID NO: 16444 - protein, 81 aa, Sapajus apella
LQGTVTFKDVAIDFTQEEWKRLDPAQRNLYRNVMLENYNNLITVGYPFTKPDVIFKLEQEEEPWVMEEEVLRRHWQGEIWG

SEQ ID NO: 16445 - protein, 81 aa, Oryctolagus cuniculus
MITFEDLAVYFTWEEWQNMNKTQKTLYRDVMLEIYSSLLSLGYCMTKPDLIFKLEQGAEPWIVEECLSQSLPVAMKWDYLT

SEQ ID NO: 16446 - protein, 81 aa, Oryctolagus cuniculus
VQGQVNFEDVFVHFSQEEWGLLDEAQRLLYRDVMLENFALTASLGHVSSVSHVVASLEMGSESRVPDWVNMIPDKETVGGC

SEQ ID NO: 16447 - protein, 81 aa, Oryctolagus cuniculus
VTFQDVAVVFSEEELRLLDTAQRALYRAVMLENFRNLLSVGEDGRARILGVTLCSDLVCPGIKALESSALRVHQRAHRGER

SEQ ID NO: 16448 - protein, 81 aa, Oryctolagus cuniculus
MVTFQDVAVVFSEEELRLLDAAQRALYRAVMLENFRNLLCVGHQSFKPDVISQLEREERLQVQEIQTQRGSKNGNKTGTCL

SEQ ID NO: 16449 - protein, 81 aa, Pteropus alecto
PYVSVTFEDVAVLFTRDEWRKLRPSQRSLYQDVMLENYGHLVSLGFPLSKPKVISLLQQGEEPWKVEEGSRRGSWLGWKSS

SEQ ID NO: 16450 - protein, 81 aa, Gorilla gorilla
RPGAVSFADVAVYFSPEEWECLRPAQRALYRDVMRETFGHLGALGFSGPKPAFISWVEGEVEAWSPESQDPDGESSAAFSR

SEQ ID NO: 16451 - protein, 81 aa, Ailuropoda melanoleuca
LQGLLTFRDVAIEFSQEEWGCLSHTQRELYRDVMLENYGHLLFSGLIASKPDLVSCLEQKKEPWDLKRKKTVAIHPVYELK

SEQ ID NO: 16452 - protein, 81 aa, Gorilla gorilla
LKGLVTFEDVAVEFTQEEWALLDPAQRTLYRDVMLENCRNLASLGNQVDKPSLISQLEQEDKVMTEERGILSGTCPDVENP

SEQ ID NO: 16453 - protein, 81 aa, Gorilla gorilla
CYQDSVTFDDVAVDFTQEEWTLLDSTQRSLYSDVMLENYKNLATVGGQIIKPSLISWLEQEESRTVQGGVLRGRKTQWRGT

SEQ ID NO: 16454 - protein, 81 aa, Ailuropoda melanoleuca
SEPFRLSRNVLLQASVSFKDVTVEFTQEEWQQMGPIQRTLYRDVMLENYNNLVSVGNCIFKPAVIVKLEQGEEPWFLEEKF

SEQ ID NO: 16455 - protein, 81 aa, Ailuropoda melanoleuca
EFLTFDDVAVDFTWEEWQLLAPAQKDLYRDMMLENYRNLVSVGYQASKPDALSKLERGEELWMIEDEIHSQICPGEKPHGC

SEQ ID NO: 16456 - protein, 81 aa, Gorilla gorilla
AQVSVTFEDVAVTFTQEEWGQLDAAQRTLYQEVMLETWGLLMSLGCPLFKPELIYQLDHRQELWMVTKDLSQSSYPGDNTK

SEQ ID NO: 16457 - protein, 81 aa, Ailuropoda melanoleuca
AQGLMAFEDVAVYFSQEEWELLDAAQRALYCHVMLENFALVASLGLSASRPRVVIQLERGEEPWVLSGTVVTPARNAHRKP

SEQ ID NO: 16458 - protein, 81 aa, Ailuropoda melanoleuca
QGSLSFRDVAVGFTRKEWQQLEPAQRMLYRDVMLENYSHLVSVATGCQVTKPAVISRLEQGQEPWMEEEEILRWSFPEEIL

SEQ ID NO: 16459 - protein, 81 aa, Lynx canadensis
APGLLTFRDVAIEFSQEEWGCLNQSQRELYRDVMLETYGHLLFLGLIVSKPHLVIFLEQKRELWDVKREKTVASPAGSGIG

SEQ ID NO: 16460 - protein, 81 aa, Lynx canadensis
GLVTFRDVAIDFSQEEWECLDPAQRDLYVDVMLENYSNLVSLDLESTYATKNKISEKDIFEIHFSQWERTERSKTLGLEAF

SEQ ID NO: 16461 - protein, 81 aa, Lynx canadensis
AHGSVTFRDVAIDFSQEEWEFLDSAQRDLYRDVMWENYSNFISLEPSISKPDVITLLDEGKEPWMVIREGTRRHYPDLESR

SEQ ID NO: 16462 - protein, 81 aa, Lynx canadensis
MVENFENLLSVGHLPFKPDMMSQLEAEEKLWMMERETQRNGYSSENHVAVPSGSKHQKEVETLRKVALKYLSHEELSCWQI

SEQ ID NO: 16463 - protein, 81 aa, Phyllostomus discolor
FQEELTFKDVAVVFTEEELGLLDPFQRKLYRDVMLENFRNLVSLGNQPFKPDLICQLEREEKCVMMETEAQRDACSGTKNQ

SEQ ID NO: 16464 - protein, 81 aa, Phyllostomus discolor
VQVSVTFNDVAVTFTQEEWGQLDPAQRTLYQEVMLETCRLLVSLGCPVPSPKLVNQLEHGQDLWMVKKDLSQSTCPGDEIK

SEQ ID NO: 16465 - protein, 81 aa, Phyllostomus discolor
LQSPMTFEDVAVYFSKEEWGLLDEAQKHLYHDVMLENFELMTSLGRWHEVQGEACSKQNAPIEGLSQLRIPYPSTLKTDTC

SEQ ID NO: 16466 - protein, 81 aa, Phyllostomus discolor
SEESVTFKDVAVDFTQEEWGQLDSPQRALYRDVMLENYQNLLALAGPPVCKPDVISHLERGEEPWQVPRKVPGGAPEWEPR

SEQ ID NO: 16467 - protein, 81 aa, Macaca fascicularis
MAKPVREEWRHLDPSQRNLYRDVMLETYSHLLSVGYQVPEAEVVMLEQGKEPWALQGERPRQSCPGEKLWDHNQCRKILTY

SEQ ID NO: 16468 - protein, 81 aa, Macaca fascicularis
AQVSVTFDDVAVTFTKEEWGQLDLAQRTLYQEVMLENCGLLVSLGCPVPRPELIYHLEHGQEPWTRKEDLSQDTCPGNKGK

SEQ ID NO: 16469 - protein, 81 aa, Macaca fascicularis
KSLVTFEDVAVYFSQEEWELLDAAQRHLYHSVMLENLELITSLGCWHGVEGEEAHPKQNISVEEVLPVRIPNADSSTKKAN

SEQ ID NO: 16470 - protein, 81 aa, Macaca fascicularis
PQGLLTFRDVAIEFSQEEWKCLDPSQRTLYRDVMLENYRNLVSLDISSKCMMEFLSTAQSNREVIHTGTLERHESHHIGDF

SEQ ID NO: 16471 - protein, 81 aa, Macaca fascicularis
RNVMLENYKNLVFLGIDISKQDPITSLEQEKELWNMKRHEMVDESPGQVWLTPVISALWEARAGGLLEPRSLRPAWSTWKN

SEQ ID NO: 16472 - protein, 81 aa, Macaca fascicularis
PLSFKDVAVVFTEEELGLLDSTQRQLYRDVMLENFRNLLSVGDKNGRDMEYIQDEELRLFSHKELSSCKIWEEVVGELPGS

SEQ ID NO: 16473 - protein, 81 aa, Macaca fascicularis
SVTGSVTFQDVAIDFSKEEWGFLNPAQRDLYTTVMLENYQNLVWLGLSISKSVISLLEKRKLPWIMGKEEIRVPLPGYFKV

SEQ ID NO: 16474 - protein, 81 aa, Macaca fascicularis
LTFRDVAIEFSLAEWKCLNPAQRALYREVMLENYRNLESVDSSFKTMMEYSSTGQGNTEVLHTGMLERHESHHIGDFCFPE

SEQ ID NO: 16475 - protein, 81 aa, Phascolarctos cinereus
GKESVTFKDVAVEFTQEEWVQLNPSQKKLYRDVMLENYRNLVSLGFAASRPNDSDQLERKEVSSLPEADIPRSSCPESREF

SEQ ID NO: 16476 - protein, 81 aa, Phascolarctos cinereus
RQGSVTFQDVAVDFSWEEWGRLGPTQKELYREVMLENYRNLVCLGLEVSKPDVVYQLERGEAPWMPEGAVRRSCSQNWGAR

SEQ ID NO: 16477 - protein, 81 aa, Phascolarctos cinereus
HQESVTFEDVAVEFTPEEWEHLRSFQKALYRDVMLENYRNLVCLGLAVSKPRVIYQLEQGKVPWMPEGDIPRTPYPDWDTG

SEQ ID NO: 16478 - protein, 81 aa, Phascolarctos cinereus
LTMEGLSLMFEDRGLLSPPSAGLPQDNSIEEKEEEEGKTSGFCSAQVQELVTFRDVAVDFTQEEWRRLDPAQRALYRASCF

SEQ ID NO: 16479 - protein, 81 aa, Phascolarctos cinereus
SAASVTFRDVAVDFSREEWSRLDAAQRALYRDVMWETYENLVSTGIPVSRLDVISLLAKQEAQWTPEEVPGWTSPDSFSEE

SEQ ID NO: 16480 - protein, 81 aa, Phascolarctos cinereus
SQELVTFKDVVVDFTWEEWELLEPGQKALYRDVMLENYRNLVALGHPVSKPNVIFQLEQSETPWMLEREAPSSIFPDWEAR

SEQ ID NO: 16481 - protein, 81 aa, Phascolarctos cinereus
PQESVTFKDVAVDFTWEEWGYLDTSQKELYWEMMLENYRNLVSLGLADANLDMISQLESGEAHGIPVGGVLRSCWPAWDTR

SEQ ID NO: 16482 - protein, 81 aa, Phascolarctos cinereus
PQELVTFKDVAVDFTQEEWGLMDHPQKELYKEVMLENAWNLLSLGLPVPREDVISNFERREAAWMLEQEGLRNCCPEREIR

SEQ ID NO: 16483 - protein, 81 aa, Myotis lucifugus
AHDLVIFRDVAVDFSQEEWKCLNSYQRNLYRDVILENYSNLVSVGCSISKPDVITLLEQGKEPWMVVRDEKKRWSLDLESK

SEQ ID NO: 16484 - protein, 81 aa, Myotis lucifugus
MNFEDVAIVFSEEEWGILDEAQRLLYCNVMLEVFALVSSAGCSHKTDDEEACSEKSVSVQGESQVRASKTEPATKRTHVCK

SEQ ID NO: 16485 - protein, 81 aa, Puma concolor
PQKSVTFEDVAVYFTQTEWNGLSPAQRALYRDVMLENYGNVASLGFSLLKPAVILQLEGAGELGDPSPLVAGTEIGSQGVW

SEQ ID NO: 16486 - protein, 81 aa, Puma concolor
LFKEAVTFRDVAVAFTEEELGLLDSAQRKLYQDVMLENFRNLVSVGHQSLKQDKWRIEREEKLWSMKTAAQMERNVGGNSQ

SEQ ID NO: 16487 - protein, 81 aa, Puma concolor
SQEPVTFEDVAVYFTQNEWVILDPSQRALYREVMLENYANVASLAFLFTRPVLVSQLERGELPWGPEPWEPAGREVLGGIC

SEQ ID NO: 16488 - protein, 81 aa, Puma concolor
SWASVVFEDVAVNFTPEEWALLNRGQRKLYRDVMLETCRNLSAVEKRKFHSSGDLTRMQEGLLRSPLVESVCERIEGDPCG

SEQ ID NO: 16489 - protein, 81 aa, Puma concolor
FQELVTFEDVAVYFIRKEWKRLEPAQRDLYRDVMLENYGNVFSLDGETRTEHDQEISEDTGSRGVLLGRFQKDISQGLKFE

SEQ ID NO: 16490 - protein, 81 aa, Puma concolor
PQGSVSFKDVTVDFTQEEWQQLDPAQKTLYRDVMLENYCHLISVGFHMTKPDMIRKLEQGEELWTTERIFPSQSYLEEDGK

SEQ ID NO: 16491 - protein, 81 aa, Gorilla gorilla
MLENYFNLISVGCQVPKPEVIFSLEQEEPCMLDGEIPSQSRPDGDIGFGPLQQRMSEEVSFQSEINVNLFTRDDPYSILEE

SEQ ID NO: 16492 - protein, 81 aa, Gorilla gorilla
AVLTDRAQVSVTFDDVAVTFTKEEWGQLDLAQRTLYQEVMLENCGLLVSLAPSQTHPGSIRCILQSNQVDTLIKIPEHTEH

SEQ ID NO: 16493 - protein, 81 aa, Gorilla gorilla
MGPLTFRDVAIEFSLKEWQCLDTAQRNLYRNVMLENYRNLVFLGIAVSKPDLITCLEQGKEAWSMKRHEIMVAKPTVTCSY

SEQ ID NO: 16494 - protein, 81 aa, Ailuropoda melanoleuca
PAQGCVTFEDVFVYFSREEWELLEEAQRVLYRDVMLENFALVSSLGLAVSRSHVGTQMEPEGSPGCLRSIHTGEKPCKCKR

SEQ ID NO: 16495 - protein, 81 aa, Gorilla gorilla
QVTFSDVAIDFSHEEDLYKDVMVQNYENLVSVAGLSVTKPYVITLLEDGKEPWMMEKKLFLFSYTVLSIMYILPISVITPA

SEQ ID NO: 16496 - protein, 81 aa, Gorilla gorilla
GTVTFEDVAVKFTQEEWNLLSEAQRCLYHDVTLENLALMSSLGCWCGVEDEAAPSKQSIYIQRETQVRTPMAGVSPKKAHP

SEQ ID NO: 16497 - protein, 81 aa, Gorilla gorilla
KMGLLTFRDVVIEFSLEEWQCLDHTQQNLYRDVMLENYRNLVSLGIAVSKPDLITCLEQNKEPWNKKRNEMVTKHPVMCSH

SEQ ID NO: 16498 - protein, 81 aa, Lynx canadensis
MLENFSHVISLGHPVSKPDVISKLEQGEEPWIIKRDVSDWIYPERETRLDNPQLDIPGDVSFHKEVLESVTRDPSLYSIFK

SEQ ID NO: 16499 - protein, 81 aa, Lynx canadensis
SQGLLSFSDVAVDFTCEEWELLDTVQKNLYRDVMLENYSNLMSLGYHAPWPEATVPVEKGVQGLVERGFPSSCSPERPLQC

SEQ ID NO: 16500 - protein, 81 aa, Lynx canadensis
AEGGVTFEDIAIYFSWKEWRLLDEAQRRLYHDVMLENFTLISSLGCCCGAEDAEAPLEQSVSVGVSQAGTPKAALSSRKTH

SEQ ID NO: 16501 - protein, 81 aa, Lynx canadensis
PGGLLTFRDVAIEFSQDEWGCLNQSQRELYRDVMLETYGHLLFLDTLAQYSESETQSNQGSHVSKHLRTLQENHFEPNKDE

SEQ ID NO: 16502 - protein, 81 aa, Lynx canadensis
GNMPANQSSPGPSLALAVGRCDNPCEGSVSFEDVTVDFSREEWQQLDSTQRRLYQDVMLENYSHLLSLGKHSHSKNLQRSM

SEQ ID NO: 16503 - protein, 81 aa, Lynx canadensis
RRDPAEDVNFEDVAIDFSQEEWGLLDETQRLLYCDVMLETFALVASLDLHQQQRHGSGEKPWKRDVDRASCLKSCNIFVSR

SEQ ID NO: 16504 - protein, 81 aa, Lynx canadensis
SQHLVTFEYVAVDFTQEEWTLLDQTQIALYRDVMLENYQNLITLAGYKSCKPDLSSALEGAELLRTGGRGVLQGEKQCGKT

SEQ ID NO: 16505 - protein, 81 aa, Lynx canadensis
AHGLVMFKDVAIDVSQEEWECLNPTQRSLYKDVMLENYSNLVSLGLSISKPAVISSLEQGKEPWMVVREVTGEQCPDLVSR

SEQ ID NO: 16506 - protein, 81 aa, Phyllostomus discolor
AVMFKDVAVVFTEEELGLLDPSQRMLYQDVTLENLRNLISVGHWNQNDIETLHKVQLRYLLLENILCWQVWNQLLSKLTRK

SEQ ID NO: 16507 - protein, 81 aa, Phyllostomus discolor
MAMYLTREEWRPLDPTQRDLYRDVMQENYGNVVSLVQGALKDGSMEAPKKKSFRPNFEIRSENEVNPKQEISDDVEFGTAS

SEQ ID NO: 16508 - protein, 81 aa, Phyllostomus discolor
LEVVVTFEDVAVYLSRTEWCLLDEAQRRLYLDVMLENFAHVSSLGCCCGAKDVEAPTEENICVPVSQARNAKTAVSSQKSH

SEQ ID NO: 16509 - protein, 81 aa, Phyllostomus discolor
ATESLTFKDISEDLSWEEWECLDPAQWKLYSDVILENYSNLVSLGLVVSKPGLVTFLEQMQESRDVSPKKSIFTPPAVSSA

SEQ ID NO: 16510 - protein, 81 aa, Phyllostomus discolor
AVMFKDVAVVFTEEELGLLDPSQRKLYQDVTLENLRNLISVGHWNQNEIDTVHEVALRYIFHEDLVCWQIWDQLLSKLTRN

SEQ ID NO: 16511 - protein, 81 aa, Phyllostomus discolor
MDSVVTFEDVAVNFTLEEWALLDPSQKKLYRNVMRETYRNLASIGLHLGEKWEDRNIENQYKTQGEKLRGHIVEKLYEIQE

SEQ ID NO: 16512 - protein, 81 aa, Macaca fascicularis
AQVSVTFEDVTVTFTQEEWGQLDAAQRTLYQEVMLETYGLLVSLGCPLFEPELIYQLDRREELWIVKKDLSQSSYPGDNTK

SEQ ID NO: 16513 - protein, 81 aa, Macaca fascicularis
ENTLENISDVTIEFSLEEWQCLDTAQQTLYRDVMLENYRNLVFLGIAVSKLDLIACLKQGKESWNMKRHEMVTKPPVTRSH

SEQ ID NO: 16514 - protein, 81 aa, Macaca fascicularis
SQESLTFKDVFVDFTLEEWQQLDSAQKNLYRDVMLENYSHLVSVGYLVAKPDVIFRLGPGEESWMADGGTPVRTCVGEDRP

SEQ ID NO: 16515 - protein, 81 aa, Macaca fascicularis
SYEGSVSFRDVAINFSREEWQHLDLSQRNLYRDVMLETCSHLLSVGYQVPKPEVVMLEQGKEPWALQGERPRQSCPGEKLW

SEQ ID NO: 16516 - protein, 81 aa, Macaca fascicularis
MGLLTFRDVAIEFSLEEWQRLDAAQQNLYRNVMLENYRNLAFLGIAVSKPDLITCLEQGKEPWNMERHEMVAKPPGMCCYF

SEQ ID NO: 16517 - protein, 81 aa, Macaca fascicularis
QGRVTFRDVAIEFSLAEWKCLNPAQRALYREVMLENYRNLESVDISSKCIMKEFSSTGQCNAEVFHTGTLQRHESHHIRDF

SEQ ID NO: 16518 - protein, 81 aa, Macaca fascicularis
PQGHLTFMDVAIEFSQEEWKCLDPGQRALYRDVMLENYRNLVSLGICPPDLSIISMLKQRREPLTLQSGVKIVKNPDGREC

SEQ ID NO: 16519 - protein, 81 aa, Phascolarctos cinereus
NMEVATFEDVAVYLTRDEWGLLEPAQRDLYRDVMLENYGNFISLGFLGSKPDVISQLERGEESWVLDIEKPEERELSSRKG

SEQ ID NO: 16520 - protein, 81 aa, Phascolarctos cinereus
GQKSLTFKDVAVDFTQEEWKQLNPAQRDLYRDVMLENYRNLALLGLLVFQPDVIHHLENGEVPWTPEGEGSKSSCSDSFIQ

SEQ ID NO: 16521 - protein, 81 aa, Phascolarctos cinereus
IQESVTFKDVAVNFTQEEWQELDTAQRDLYWDVMLENYENLVFLAGLPISKPDVLCHLERGVAPWMLEGDFPGDVFPDSLS

SEQ ID NO: 16522 - protein, 81 aa, Phascolarctos cinereus
QAGQESVTFTDVAVDFTLEEWAYLDHFQKELYKDVMLENYRNLLCLVSKPDVISQLEQGDAPWMSEGGVPRSIYSDWETRP

SEQ ID NO: 16523 - protein, 81 aa, Phascolarctos cinereus
GEEAVTFRDVALDFTWEEWGCLSAAQRELYKDVMLENYRNLVSLGLPGPKPGLISWLEGEEEPHPWDSLVHAARSTSLSKA

SEQ ID NO: 16524 - protein, 81 aa, Phascolarctos cinereus
HQGSVTFGDVAVDFSQDEWGHLDPAQKELYREVMLENYGNLVCLGLAVSRPHVIEQLERGEAPWLPRGAVPRSCDLDWMTR

SEQ ID NO: 16525 - protein, 81 aa, Phascolarctos cinereus
MLENFRNLVCLGLAMSKPDVISQLERGEAPWMPEGNGLRCRLGNKTENKESSPGLGVCMEESSQKTLPKDCPCVPKVGEAW

SEQ ID NO: 16526 - protein, 81 aa, Phascolarctos cinereus
MTFEDVAVYFTKKEWKQLTPDQRHLYRDVMLENYGNMVSLGVPVHKPDVISQLEHGEEPWVLNLQEAGEREEIPRYFSIDC

SEQ ID NO: 16527 - protein, 81 aa, Phascolarctos cinereus
LGESVTFNDVAVEFTQEEWVQLNPSQKKLYKDVMLENYRNLVSLGFPVSKPDVIYQLERREASWMPEADISGSSCPGSREF

SEQ ID NO: 16528 - protein, 81 aa, Puma concolor
PQEPVTFEDVAVYFTQNQWASLDPMQRALYREVMLENYTNMASLVAFPFPKPVLVSHLERGEAPWGPDPWEAEVLRGICPG

SEQ ID NO: 16529 - protein, 81 aa, Puma concolor
PPARLTTPGGCREGLRAGIRLVASLRKELYKHVMRGNYETLVSLDYAISKPEVLSQTEQGKEPCSWRRTAPKVPDVPVDPS

SEQ ID NO: 16530 - protein, 81 aa, Puma concolor
PQDLMTFKDVAVEFTQWEWGQLDPAQKDLYREVMLENFKNLASLGLPVSKPYVICQLEEGEEPCVVEGEISTGAHPDWEKR

SEQ ID NO: 16531 - protein, 81 aa, Sapajus apella
SSEPVTFEDVTLGFNPEEWGLLDLKQKSLYREVMLENYRNLVSVEHQLSKPDVVSQLEEAEDFWPVERGIPQDTIPEYPEL

SEQ ID NO: 16532 - protein, 81 aa, Canis lupus
FEVSVSFEDVAVDFTRQEWHRLDPAQRTMHKDVMLENYSNLASVGLCVAKPEMIFKLERGEELWILEEDSSGHCYPGSLSL

SEQ ID NO: 16533 - protein, 81 aa, Canis lupus
LVTFRDVALDFSQEEWEWLDPSQKDLYRDVMLENYRNLVWLDWESWYEIKELSPKWYIDEEEISQGMVMERLTSIDLEYSS

SEQ ID NO: 16534 - protein, 81 aa, Canis lupus
CCISMSFEDVTVDFSREEWQHLDSAQRRLYRDVTLENYSHLCSVGYQVPKPEVIFKLEQGEEPWILETKTPHQSCLDEDVG

SEQ ID NO: 16535 - protein, 81 aa, Canis lupus
RASPTPPREPKEEWDYLDPAQRSLYKDVMMENYGNLVSLDVLNRDKDEEPTVKQEIEEIEEEVEPQGVIVTRIKSEIDQDP

SEQ ID NO: 16536 - protein, 80 aa, Muntiacus muntjak
MGRLMFRDVAVDFTQEEWECLDLGQRDLYMDVMLETYGNLASLGLVVSKPDLVTFLEQMKNPWDVRRTDTTATYPENANL

SEQ ID NO: 16537 - protein, 81 aa, Muntiacus muntjak
LSGSVSFRDVAVDFTQEEWQQLDPDEKMTYRDVMLENYSHLVSVGYDSTKPNVIIKLEQGEEPWVADSKFLQQQHPEKVWK

SEQ ID NO: 16538 - protein, 81 aa, Muntiacus muntjak
RDLVTFEEVSVDFSQEEWALLAPAQKILYRDVMLENFRNLASVGYHLCIHSPITEVAQEELRPEGRGILQSACTDGATQLK

SEQ ID NO: 16539 - protein, 81 aa, Muntiacus muntjak
YEVPKPEVIFKLEQGEEPWALKEKTLHHSCSDEKFGIKTLQKRISGKVSFHGEMEGEDAKDDSLYSILEVLCQDAEQIKSY

SEQ ID NO: 16540 - protein, 81 aa, Canis lupus
VMFRDVAIDFSQEEWEYLDSAQRDLYRDVMLENYSNLVSLVDLPSRSVNKDLSPKKDIYETELSQWQMSARHQNCDFEESS

SEQ ID NO: 16541 - protein, 81 aa, Muntiacus muntjak
GLLTFQDVTVDFTQEEWEYLDLGQWELYRDVMLENYGNLACLAFFNSQSLLTFISIESILLFNHLFFCRSLLLPSICPSIR

SEQ ID NO: 16542 - protein, 81 aa, Muntiacus muntjak
SQEPLTFKDIIVDFTQEEWGHLAPAHWHLYREVMLENYGNLVSVGYQLSKPGVISQLEKGEEPWLMEREVSGGPSPEHMSI

SEQ ID NO: 16543 - protein, 81 aa, Canis lupus
LQEAVVFEDVAVYFTRIEWSCLAPDQRALYRDVMLENYGHVASLGFLVAKPALISLLEQGEEPGALILQVTEERGSATSRC

SEQ ID NO: 16544 - protein, 81 aa, Canis lupus
MLENYKSIVSLGLPVPCPEVIFQLKRGDEPWIVDLHGSEERECPENISLVFSSPGEKLHLYFLSVPDWETKPEIHGTSDKE

SEQ ID NO: 16545 - protein, 81 aa, Gorilla gorilla
LVMFQDLSIDFSQEEWECLDAAQKDLYRDVMMENYSSLVSLDSEFRCKTKDSCLPKEIYEVTSPQWVRMEKCHSLVGSSVR

SEQ ID NO: 16546 - protein, 81 aa, Ailuropoda melanoleuca
KSEPVTFRDVAVDFTQEEWGQLGPAQRTLYRDVMLETFGHLLSLGPELPKPEVISQLEQGAELWLAERGIVQGYYPGREPG

SEQ ID NO: 16547 - protein, 81 aa, Ailuropoda melanoleuca
QGSVTFQDVAVDFTPEEWQLLDCDQRTLYWDVMLENFRNLISVGTGGPVTKTKAIFKAEQGQEPWMGERENPRWRYPEADC

SEQ ID NO: 16548 - protein, 81 aa, Desmodus rotundus
AWVPALFDEVAIYFSDEEWEVLTEPQKALYREVMRMNYETVLSLEFPFPKPDMISRLDGEEESQSSDPWQLQGGSFAEHEE

SEQ ID NO: 16549 - protein, 81 aa, Macaca fascicularis
QAMVKIEDMAVSLILEEWGCQNLARRNLSRDHRQENYGSTFPQANVFAAFQHAVHVFCFLEEKGHVQSCHGPEACPACSNG

SEQ ID NO: 16550 - protein, 81 aa, Macaca fascicularis
FQKPVTFEDVAVNFTQEEWDCLDASQRVLYQDVMSEIFKNLASVARIFLHKPELITKLEQEEEQWRETQVLQASQAGPPFF

SEQ ID NO: 16551 - protein, 81 aa, Macaca fascicularis
RVTFKDVAVVFTKEELALLDKAQINLYQDVMLENFRNLISVGDGIKNNILNLQEKGLSYLSQEVLRCWQIWKQRIRDLTVS

SEQ ID NO: 16552 - protein, 81 aa, Macaca fascicularis
QDTVAYEDLCVDYTQKKWKCPALSQRALQWNMIPENDHSMASLGRNMMESSELIPKQEIFKGSESSNSTSGGLFGVVPGAA

SEQ ID NO: 16553 - protein, 81 aa, Macaca fascicularis
EMGLLTYRDIAIEFSLAEWQCLDHAQRNLYRDVMLENYRNLVSLGITVPKLDLITCLEQNKEPQNMKRSEMVAKHPVMCSH

SEQ ID NO: 16554 - protein, 81 aa, Macaca fascicularis
MGSLRFRDVAIEFSVEEWQCLDTAQQNLYRNVMLENYRNLVFLGIAVPKPDLIIFLEQGKEPWNMKRHEMAGEPSVICSHF

SEQ ID NO: 16555 - protein, 81 aa, Macaca fascicularis
PQASVCFEDVAMAFTQEEWEQLDLAQRTLYREVTLETWEHIVSLGLFLSKSDVISQLEQEEDLCRAEQVAPREKGVLGSFL

SEQ ID NO: 16556 - protein, 81 aa, Phascolarctos cinereus
PQESVTFKDVAVDFTWEEWGYLDTSQKELYWEVMLENYRNLVSLGLADSNVNMISQLESGEAQGIPVDSVLTSCWPDGDRR

SEQ ID NO: 16557 - protein, 81 aa, Phascolarctos cinereus
FQESVTFQDVGVDFTLEEWRCLGPVQRALYKNVMLENLESLISLGLPVSILEVVSLLERGGAPGMPKVVDPRRLWPVTFLG

SEQ ID NO: 16558 - protein, 81 aa, Phascolarctos cinereus
QASVTFRDVAVDFTGEEWRCLEPAQRALYRDVMLETYENLVFLGLSVPISKLDLIFLLERGGALSRPMGRVPSDSCPDSFI

SEQ ID NO: 16559 - protein, 81 aa, Phascolarctos cinereus
MKSVTFKDVAVDFSQEEWGLLDPSQKELYKDVMLEISQSLLSLGLPVPKADLISQVDQAETPWMLKQVDTKNSGLDGETKP

SEQ ID NO: 16560 - protein, 81 aa, Phascolarctos cinereus
MLENYRNLVWLGLTASRPGVIDQLERVEVPWVPEGEAPEVSCPDFETRPETTQLFPELGLSMEVSSHEKFLTGDPYVSPLG

SEQ ID NO: 16561 - protein, 81 aa, Oryctolagus cuniculus
SKAPVTFGDLAIYFSQEEWEWLSPIQKDLYEEVMLENYQNLVSLGLSFRRPNVITLLEKGKAPWMVELLRRHRGPALPPQE

SEQ ID NO: 16562 - protein, 81 aa, Oryctolagus cuniculus
QAQEVLMFDDVAVRFTWEEWQLLNPAQKALYRDVMLENYRSLVSVGWRASKPDLLSQLERGEPWTIEGENHCGTPPEIWKA

SEQ ID NO: 16563 - protein, 81 aa, Oryctolagus cuniculus
AGGPVTFSDVSVDFSQEEWECLDPTQRDLYRDVMLENYSNLVAMGLYIPKPQVISLLEQGKEPWMIGKELTRGLCSDLESM

SEQ ID NO: 16564 - protein, 81 aa, Ailuropoda melanoleuca
RPGAVSFADVAVYFSPEEWGCLRPAQRALYRDVMRETYGHLGALGFAGPKPALISWLERKKEVWSPEAEDPEEGARHPGSG

SEQ ID NO: 16565 - protein, 81 aa, Gorilla gorilla
FEELVTFEDVFVDFSPEELSSLSAAQRNLYREVMLENYRNLVSLGHQFSKPDIISRLEEEESHAMETDSRHTVICQGESHD

SEQ ID NO: 16566 - protein, 81 aa, Ailuropoda melanoleuca
QDWGTFEDVAVYFSREEWELLDETQRHLYHDVMLENLALVASLGLKTFRSCAVAHLEQDKEPWEPERVDISPYTAREGGRG

SEQ ID NO: 16567 - protein, 81 aa, Ailuropoda melanoleuca
SRVVFEDVAIYFSQEEWGLLDEAQRFLYHAVMLENFALLSSLGATSVLTSSSGEDPGHLVRGPYCASGKRHSEVHGPGVRE

SEQ ID NO: 16568 - protein, 81 aa, Lynx canadensis
PRVSLTFEDVAVLFTREEWRKLGPSQRNLYQDVMLENYSNLVSLGLLFSKPKVISLLQQGEDPWKVEKESPGGPSLGYKRS

SEQ ID NO: 16569 - protein, 81 aa, Ailuropoda melanoleuca
VKDSVTFKDVAIDFTLEEWRLMDPSQRNLHKDVMLENYRNLVSLGLAVSKPDMISHLEDGKGPWVVVREMARAPYPELETK

SEQ ID NO: 16570 - protein, 81 aa, Lynx canadensis
MVQNYENLVSLGLSIPKPYVISLLEDGKEPWMVQKKLSKDWESRWENKELLMKEDIYDEDSPQMVIIEKITKQSHEFSNFN

SEQ ID NO: 16571 - protein, 81 aa, Lynx canadensis
VQEPVTFKDVAVDFTQEEWGQLDPIQRTLYRDVMLETYGHLLSVGNQIAKPEVISLLEQGEEPWSVEQAYPQSTCPEWMRN

SEQ ID NO: 16572 - protein, 81 aa, Lynx canadensis
DTTVYLDVAIEFSQEEWGCLNQSQRELYRDVMLETYGHLLFLGEDNSFQTSQTSLAENHFESNKGEEVFYPNSKYTNSKST

SEQ ID NO: 16573 - protein, 81 aa, Lynx canadensis
SGKPGALSFADVAVYFSSEEWGCLRPAQRALYRDVMRETYGHLGALGPKPALISWMERKKEAWSPEAEDPEDRARHPGYGI

SEQ ID NO: 16574 - protein, 81 aa, Phyllostomus discolor
AWVPALFDEVAIYFSDEEWEVLTEPQKALYREVMRMNYETVLSLEFPFPKPDMISRLDGEAESQSPDAWQLQGGSFAEHEE

SEQ ID NO: 16575 - protein, 81 aa, Phyllostomus discolor
SRKARSGLTSRTVSSASRTLPFLETKRRKMTKFREAVTFMDVAVVFTEEELGLLDSVQRKLYRDVTLENFRNLVLVGFRTP

SEQ ID NO: 16576 - protein, 81 aa, Phyllostomus discolor
SQELVTFEDVAVYFIRKEWKRLEPAQRNLYRDVMLENYGNVFSLDGETRTEHDQEISEDTGSHGALLGRFQKDISQGLKLE

SEQ ID NO: 16577 - protein, 81 aa, Phyllostomus discolor
TKFREAVTFMDVAVVFTEEELGLLDSVQRKLYRDVTLENFRNLVLVGCLVASLTSAHYFKASGPLRDQSFPVCLQVETRRF

SEQ ID NO: 16578 - protein, 81 aa, Macaca fascicularis
AQESVMFSDVSIDFSQEEWECLNDDQRDLYRDVMLENYSNLVSMGHSISKPNVISYLEQGKEPWLVDRELTRGQWPVLESR

SEQ ID NO: 16579 - protein, 81 aa, Macaca fascicularis
SYQDSVTFDDVAVDFTPEEWALLDTAEKYYRDVMLENYMNLASVEWEIQPRIKGSSLQQGFLKNPIFNGIQMTRNYSGWKL

SEQ ID NO: 16580 - protein, 81 aa, Macaca fascicularis
QESVTFKDVAVDFTLEEWGWLEPDQRELYRDVMLENYRNLLSLGAGLPGSKPDVISRLERGEEPRPEEREAWRVTCPDLET

SEQ ID NO: 16581 - protein, 81 aa, Macaca fascicularis
DTVAFEDVAVNFTQEEWALLGPSQKNLYRYVMQETIRNLDCIRCHMLERFSESKDSSQCGETFSLIRGSIVNNSICPGEDP

SEQ ID NO: 16582 - protein, 81 aa, Macaca fascicularis
QTDSISLEDVAVNFTLEEWALLDPGQRNIYRDVMRATFKNLACIGEKWKDQDVEDDPKNQGRKPSSPMVETLCENKEDRLC

SEQ ID NO: 16583 - protein, 81 aa, Macaca fascicularis
HQELVKFRDVAVVFSPDEWDHLNPEERNLHRDVMLDNCKYLASLGNWTYKAHVMSSLKQGKEPWMMEREVTGVPCPACQPA

SEQ ID NO: 16584 - protein, 81 aa, Phascolarctos cinereus
SQESLTFKDVAVDFTPEEWGQLYPAQRDLYREVMLENYRNLVSLGHQVSKPHLISQLEQRKEPWMMERKIPRGNFPDWETR

SEQ ID NO: 16585 - protein, 81 aa, Phascolarctos cinereus
YKESVTFKDVAVDFTQEEWEQLNPFQRDLYRDVMLENYGNLVSLGLSISKPQVIFQLEQGKEPWIHKLQRTNVKHVPKIIS

SEQ ID NO: 16586 - protein, 81 aa, Phascolarctos cinereus
FQVLVTFTDVTVNFTHEEWSLLNPAQRGLYKDVMLENYENVVSLGFPVCEPDVISYLEQGEEAWVLDMQEAEEKEIMRGDC

SEQ ID NO: 16587 - protein, 81 aa, Phascolarctos cinereus
SWASSLGVCSSIISNMEEWTHLDPAQRELYGDVMLENYGNLVSLGLPVFKPDVISQLKLGGESWVLNDPGIKEKEIFRGVS

SEQ ID NO: 16588 - protein, 81 aa, Phascolarctos cinereus
FQASMMFEDVAVYLTREEWSHLGPAQRNLYKDVMLENYGNVVSLGFPVSKPNVISQLERGEEPWILDIQEAEGREMLRGDC

SEQ ID NO: 16589 - protein, 81 aa, Phascolarctos cinereus
MAAALLTARPQEEWGLLDPAQRRLYRDVMLENYGNVASLGLPVSKPDLISQLERTDLPLVPRLPQTEIEDLFDEKLDITFI

SEQ ID NO: 16590 - protein, 81 aa, Phascolarctos cinereus
FQESVTFKDVAVDFSWEEWGQLGPAQKELYREVMLENYRNLVCLGLAVSKPDVISQLERGGAPWIPEGEGPRCWCADWKTG

SEQ ID NO: 16591 - protein, 81 aa, Phascolarctos cinereus
CQETLTFKDVVVDFTRGEWQHLDPAQKDLYKEVMLDNYKNLVSLEFLSQMARYATAESTENPSFSPEESSKEGAETGGSWE

SEQ ID NO: 16592 - protein, 81 aa, Phascolarctos cinereus
MLDNYKNLVSLGIQVSKPDVIFQLERGESPSMLEGKDPSDPCLEFLSQMARYATAESTENPSFSPEESSKEGAETGGSWEY

SEQ ID NO: 16593 - protein, 81 aa, Phascolarctos cinereus
GKESVTFQDVAVEFSLEEWIHLNLSQKNLYRDVMLENYKNLVFLGSKGFTEEKFYKCGECGKTFRSKTQLTMHQSIHTGKI

SEQ ID NO: 16594 - protein, 81 aa, Myotis lucifugus
AAGPPGMAAPEPGGRAGEWEQLDPAQRSLYKDVMLENYSNLTSMGYQAAKPDMISKLEKGEEPCLGKRKRPRQGGPSEIAR

SEQ ID NO: 16595 - protein, 81 aa, Myotis lucifugus
ESVSFTDVTVDFTQEEWEQLDPSQRILYMDVMLENYSNLLSVEVWKADDQVQREHSDPEEQARPFIICKNQTPIEERSDLF

SEQ ID NO: 16596 - protein, 81 aa, Myotis lucifugus
LQVSVSLEDVTVDFSREEWQQLNSTQRRLYQEVMLENYSHLLSVGYEVPKPEVIFKLEQGEEPWILEGETPHQSCADGKFG

SEQ ID NO: 16597 - protein, 81 aa, Myotis lucifugus
DMIFDDLAITFSQDEWGLLDEDQKLLYCDVMLEVFALLSSVEDEHHKMDEKEAPRQSVSVGESQDRASKMAPATQKTYLCK

SEQ ID NO: 16598 - protein, 81 aa, Puma concolor
GRVTFEDVAVYFSGEEWGLLDEAQRCLYQDVMLETLAHITSLGCWHGAGDEDAPEQSVSVQGVSRGRTSKAAVSSQKAPPR

SEQ ID NO: 16599 - protein, 81 aa, Puma concolor
SQEPVTFEDVAVYFTQNQWTSLDPMQRALYREVMLENYANMTSLGAFPFPKPELILQLERGEAPWGLDPWTPMGGEAPGDV

SEQ ID NO: 16600 - protein, 81 aa, Sapajus apella
TARSQETVTFKDVAMDFTPEEWGKLDPAQRDVMLENYRNLVSLWLPVSKPENYTLENGKEPLKLERKAPKNSYSDMKTRPE

SEQ ID NO: 16601 - protein, 81 aa, Sapajus apella
GAVSFADVAVYFSPEEWGCLRPAQRALYRDVMRETYGHLGALGDAPNMKEEEPEEGPRSKAPRKAPMESPEVLVGRKPDLA

SEQ ID NO: 16602 - protein, 81 aa, Sapajus apella
SQGRVTFEDVTVNFTKGEWQQLNPEQRNLYRDVMLENYSNLVSVGQEETTKPNVILRLEQGKEPWSEEEEVLRRGHPEKNW

SEQ ID NO: 16603 - protein, 81 aa, Sapajus apella
MDSVVFEDVAVDFTLEEWALLDSAQRDLYRDVMLETFQNLASVDDETQFKASGSVSQQDIYGEEISKESKIAEFTRNVSWA

SEQ ID NO: 16604 - protein, 81 aa, Sapajus apella
SQGLVTFGDVAIDFSQEEWEWLSPIQRNLYRKVMLENYRNLASLGLCVSKPDVISLLEQGKEPWTVKRRMTRAGCPDLKAV

SEQ ID NO: 16605 - protein, 81 aa, Sapajus apella
AQESVTFEDVAVNFTDREWQCLTYAQRHLYKDVMLENYGNMVSVGFLFPKPPLISHLERGVEPCVQDPQDRESLSCSCLVS

SEQ ID NO: 16606 - protein, 81 aa, Sapajus apella
VTFGDVAVHFSREEWQCLDPGQRALYREVMLENHSSVAGLDSTIRTDNEQACEDMDILKSESSGTVVRISPQDFAQNPCFG

SEQ ID NO: 16607 - protein, 81 aa, Sapajus apella
MGPLTFRDVAIEFSLEEWQCLDTAQQDLYRKVMLENYRNVAFLGIAVSKPDLITCLEQGKEPWNMKRYEMVDEPPATCSYF

SEQ ID NO: 16608 - protein, 81 aa, Sapajus apella
AQMLVTFKDVAVTFTQEEWRQLDLAQRTLYQEVMLETCGILVSLGYWVPKPELVHLLEHGQELWTVKRGRSHPTCVGDKAQ

SEQ ID NO: 16609 - protein, 81 aa, Sapajus apella
GTVTFEDVAVNFSREEWSLLSEVQRCLYHDVMLENWVLISSLGCWYESEDEEAPSKQNISIQRVSQVSTRRAGVSLKKAHP

SEQ ID NO: 16610 - protein, 81 aa, Ailuropoda melanoleuca
AEGPVSFRDVAVDFTQEEWQQLEPDEKTTYRDVMLENYSHLVSVGYDSTKPNVILKLEQGEEPWVAEGELPCQSHPEEVWK

SEQ ID NO: 16611 - protein, 81 aa, Ailuropoda melanoleuca
ESVTFEDVAVDFTQEEWALLDRSQRRLFRDVMLENISHLVSIGRQLYKSDTISHLEPGEQLSKGIGLLQCQSLDREDDLKK

SEQ ID NO: 16612 - protein, 81 aa, Ailuropoda melanoleuca
DNSYEGSVSFRDVAVDFSREEWQHLDLAQRSLYRDVMLETYSHLLSVETGFEVPQPEVFMLEQGKEPWALQGESPHQNCPG

SEQ ID NO: 16613 - protein, 81 aa, Gorilla gorilla
GQLTFKDVAIEFSQEEWTCLDPAQKTLYRDVMLENYRNLVSLDISCKCVNTDLPPKGKNDMGEAFYTVKLERLESCDTAGL

SEQ ID NO: 16614 - protein, 81 aa, Gorilla gorilla
LGPVTFEDVAVLFTEAEWKRLSLEQRNLYKEVMLENLGNLVSLAESKPEVHTCPSCPLAFGSQQFLSQDELHNHPIPGFHA

SEQ ID NO: 16615 - protein, 81 aa, Gorilla gorilla
TGGDVTFSDVAIDFSHEEWACLDTAQRDLYKDVMVQNYENLVSVGLSVTKPYVIMLLEDGKEPWMMEKKLSKDWESRWENK

SEQ ID NO: 16616 - protein, 81 aa, Ailuropoda melanoleuca
HQDLVTFKDVAVYFTRTEWAGLYPAQKALYRSVMLENYGNLTSLGYPVPKPALISLLEGGNLPWGLEAQDNPSAERTKDIC

SEQ ID NO: 16617 - protein, 81 aa, Lynx canadensis
KPGALSFADVAVYFSSEEWGCLRPAQRALYRDVMRETYGHLGALGFAGPKPALISWMERKKEAWSPEAEDPEDRASRIRAK

SEQ ID NO: 16618 - protein, 81 aa, Phyllostomus discolor
AVTFKDVAVVFTEEELGLLDPSQRMLYREVTLENLRNLVSVGHWNQNKVESLQEVALRYLLHEDLVCWQIWDQLLSKLSGN

SEQ ID NO: 16619 - protein, 81 aa, Phyllostomus discolor
SQPPVSFKDVVVSFTREEWGQLDTVQRTLYRDVTLETCGHLVSLGLLLPNLDVISHLENGEDPWRAEQEPPTQDWKTTLEK

SEQ ID NO: 16620 - protein, 81 aa, Phyllostomus discolor
AAASVTFEDVAVHFSWEEWRLLDEAQRRLYLCVMLENFSLISSLGCCCGRKDVETPIKQNVSVRVSQTKNPKAASSSQKTH

SEQ ID NO: 16621 - protein, 81 aa, Macaca fascicularis
EKGPLTFRDVAIEFSLEEWQCLDTAQQGLYRKVMLENYRNLVFLAGIAVTKPDLITCLEQQKEPWNIKRHEMVAKPSVICS

SEQ ID NO: 16622 - protein, 81 aa, Macaca fascicularis
RVQSCVTFEDVFVYFSREEWELLEEAQRFLYRDVMLENFALVATLAFIFPVPCSCPVGRGRKPWVPDRADTTAATVKETCR

SEQ ID NO: 16623 - protein, 81 aa, Macaca fascicularis
QESVTLEDVAVDFTWEEWQLLGPAQKDLYRDVMLENYSNLVAVGYQASKPDVFFKLEQGEPPWTTEDGIHSGACSEIWKVD

SEQ ID NO: 16624 - protein, 81 aa, Macaca fascicularis
MGPLQFRDVAIEFSLEEWHCLDTAQRNLYKNVMLENYSNLVFLGIVVSKPDLITRLEQGKKPLTVKRHEMVAKPPGPGVIV

SEQ ID NO: 16625 - protein, 81 aa, Phascolarctos cinereus
FQESVTFKDVAVDFTWEEWGYLDTSQKELYWEVMLENYRNLVSLGLADSNVNIISQLESGEAHGIPVDRVLRSCWPDGDTR

SEQ ID NO: 16626 - protein, 81 aa, Macaca fascicularis
MLENYSNLVSVGYQLSKPSVISQLEKGEEPWMAEKEGPGDPSSDLKSKMETIESSAKSAISQECLYHGIMMERFMRDDIIY

SEQ ID NO: 16627 - protein, 81 aa, Phascolarctos cinereus
SARSQESVAFKDVVMDFTQEDLPQKDPYEDLMLEKYSNLVLLGLPVSKPDVNSELEQGEDSWIPRKEDPGSTCSDWETVPK

SEQ ID NO: 16628 - protein, 81 aa, Phascolarctos cinereus
QRESVTFSDVAVEFTCEEWRHLAPPQKELYRDVMLENYRNLVRLGLTVSKPDVISQLERREAPWTPGGIQRSSCPDWEATC

SEQ ID NO: 16629 - protein, 81 aa, Phascolarctos cinereus
MLENYRNLVFLGFAVSRPDVIYQLEKKETSWMPEPDIPRSSCLESREFTGHKPLECNECGKAFTCKTNLTRHQIIHAGEEP

SEQ ID NO: 16630 - protein, 81 aa, Phascolarctos cinereus
MLENYRNLVSVGHQVYKPNLISQLEQGEEPWIIDREIPRGAFPDWEIRPETKKSTAKQDISEEKLSQKVTVERFPKHSMWP

SEQ ID NO: 16631 - protein, 81 aa, Phascolarctos cinereus
PQESVTFKDVAMDFTWEEWGYLDTSQKELYWEVMLENYRNLVSLGLSDSSLDVISQLESGEAHGIPVDSVLRTCWPDWNAR

SEQ ID NO: 16632 - protein, 81 aa, Phascolarctos cinereus
AQELVTFKDVIVDFTPEEWGLLNHSQKELYKEVTLENAQNLLSLRIPVPREGSISHFGQGEAPWMLELEDLRTSCPDEETR

SEQ ID NO: 16633 - protein, 81 aa, Phascolarctos cinereus
TSKEPVTFRDVAVDFTPEEWGQLGPSQRQLYWDVMLETYWNLVSLGLSIPKPTAISHLEPEEPRTAEGETPSGPHPDWNTR

SEQ ID NO: 16634 - protein, 81 aa, Phascolarctos cinereus
AQELVTFKDVSVDFTQEEWGLLDHPQKELYKEVVVENAHNLLSLGRPVPRKDLMSYFEEKEAPWLLEQEGLRSCCPEGEIR

SEQ ID NO: 16635 - protein, 81 aa, Phascolarctos cinereus
CQESVTFKDIAINFTQEEWGQLSPAQRNLYKDVMLENYRNLISLGFSISKPDVIFKLEQGKDPWIFNLQRSEEEDMPKNSL

SEQ ID NO: 16636 - protein, 81 aa, Phascolarctos cinereus
PQESVTFEDVAVDFTWEEWGYLDTSQKELYWEVMLENYKNLVSLGFVVAKPDAISQLEQEEAPWRPEVLFPRSSCSDLDTK

SEQ ID NO: 16637 - protein, 81 aa, Phascolarctos cinereus
QEDPVTFQDVAVVFTQEQWGYLDPSQKELYRDVMLENYQNLLCLGLAVSKPEVICQLEQGEAPWRPEGRVPGSSHPDGEVR

SEQ ID NO: 16638 - protein, 81 aa, Myotis lucifugus
GLLFSKPKVISLLQQGEEPWKTEEESPGGAPLGWKSNHKTTKSTQTQDSLFQELIMKRSKRNGPWVFKSEKTCIYEDRLEK

SEQ ID NO: 16639 - protein, 81 aa, Myotis lucifugus
MNFEDLAIAFSQEEWNLLDEDQRLLYCEEMLEVFALVSSVGCWHKMDEEEVPPEQSVSVGESQDRASKTAPATQKTYLCKW

SEQ ID NO: 16640 - protein, 81 aa, Myotis lucifugus
LQVPLTFEDIAIYFSEQEWQDLEAWQKELYRRVMRTNYEILVSLDGGLPKPELISQIEQGRELFRNLGEPQKSGNVIFNPA

SEQ ID NO: 16641 - protein, 81 aa, Myotis lucifugus
MNFEDVAIAFAQEEWEILDEAQRRLYCDVMLEVFSLVSFVGPWRKMDDVEAYSQHSVSIGDSQVRASRTAAATQRTHLCKP

SEQ ID NO: 16642 - protein, 81 aa, Puma concolor
APVTMTFDDVALYFSEQEWEILEKWQKEMYQQVMKTNYETLDSLGGVFSKPDLITWMEQGRTLLIRDQGPLEKRMTLSPSA

SEQ ID NO: 16643 - protein, 81 aa, Sapajus apella
MGPLTFRDVKIEFSLEEWQCLDTAQRNLYRDVMLENYRNLAFLGIAISKPDLITWLEQGKEPWNMKSHAMVAKPPVIWSHF

SEQ ID NO: 16644 - protein, 81 aa, Sapajus apella
MGPLTFRDVTVEFSLEEWQFLDAAQQNLYRDVMLENYRNLVFLSIFSKPDMITCLEQGIQPWNIKRHEMVAKPPFTCSHFA

SEQ ID NO: 16645 - protein, 81 aa, Sapajus apella
MVENFKNLVAVGHLPFQPDMVSQLEAEEKLWMMEAETQRSSKHQNKMETLQKFALKYLSNQELSCWQIWKQVANELTRCLQ

SEQ ID NO: 16646 - protein, 81 aa, Sapajus apella
MELLTFRDVAIEFSLEEWQCLDTAQQNLYRNVMLENYRNLVFLGIAACKPDLITCLEKAKEPWKMKRHAMVDEPPGIFPHF

SEQ ID NO: 16647 - protein, 81 aa, Sapajus apella
SQELLTFKDISIDFTQEEWGQLTPAHQNLYREVMLENYSNLVSVAGYQLSKPVVISQLEKGEEPWMTEKEGPGDPSSDLKS

SEQ ID NO: 16648 - protein, 81 aa, Gorilla gorilla
QEPLSFKDVAVVFTEEELELLDSTQRQLYQDVMQENFRNLLSVGERNPLGDKNGKDMEYIQDEELRFFSHKELSSCKIWEE

SEQ ID NO: 16649 - protein, 81 aa, Gorilla gorilla
HLTFMDVAIEFSQEEWKSLHPGQRALYRDVMLENYRNLVFLGRSCVLGSNAENKPIKNQLGLTLEPHLSELQLFQAGRKIY

SEQ ID NO: 16650 - protein, 81 aa, Ailuropoda melanoleuca
QESLTFQDVAVNFTREEWDQLYPAQKNLYRDVMLENYRNLVALGHQLYKPEVISQLEQEEQWVMERGRALDTHADGESRPE

SEQ ID NO: 16651 - protein, 81 aa, Gorilla gorilla
PVTFRDVTVIFTEAEWKRLSPEQRNLYKEVMLENYRNLLSLAEPKPEFYTCSSCLLALSCQQFLSQHVLQVFLGLCAENHF

SEQ ID NO: 16652 - protein, 81 aa, Phyllostomus discolor
MAFKDVAVDFTQEEWMLLSPAQRSLYREVMLENYSNLVSLGIPFSKPKLITQLEQGKETWREERKCPPATCLGQPKPELHL

SEQ ID NO: 16653 - protein, 81 aa, Macaca fascicularis
MDSVVFEDVAVDFTLEEWALLDSAQRDLYRDVMLETFRNLASVDNKTHFKASGSVSQQDTYREEKSKEQTIPNFTRNNSCA

SEQ ID NO: 16654 - protein, 80 aa, Macaca fascicularis
VFQGPLTFMDVVIKFSPEEWQFLDTAQQNLYRDVMLENYRNLIFLDKTGIAVSKPDLMTCLEQGKEPWNMKRHEMMAKAP

SEQ ID NO: 16655 - protein, 81 aa, Macaca fascicularis
SPPESVSFKDVTVDFSRDEWQQLDLAQKSLYREVMLENYFNLISVGCQVPKPEVIFSLEQEEPCMLDGEISGQSHPDGDIG

SEQ ID NO: 16656 - protein, 81 aa, Macaca fascicularis
PQLPESLEDVAMYISQEEWGHQDPSKRALSRDTVQESYENVDSLESHIPSQEVPGTQVGQGGKLWDPSVQSCKEGLSPRGA

SEQ ID NO: 16657 - protein, 81 aa, Macaca fascicularis
SKGSVMFRDVSIDFSQEEWECLDSGQMNLYKEVMLENFSNLVSVGLSNSKPAVISLLEQGKEPWMVDRELTRGLCSDLESM

SEQ ID NO: 16658 - protein, 81 aa, Macaca fascicularis
SQASVSFKDVTIEFTQEEWQQMAPVQKNLYRDVMLENYSNLVSVGYCHFKPEVIFKLEQGEEPWFSEEEFSNQSHPKDYRG

SEQ ID NO: 16659 - protein, 81 aa, Phascolarctos cinereus
AQELVSFRDVAIHFTQEEWSHLHPTQKDLYWHVTLENCENLVSLGLPVSKLDVLSLLGRGNASWKPEGEESPQSTCPDSLN

SEQ ID NO: 16660 - protein, 81 aa, Phascolarctos cinereus
PQELVTFQDVAVDFTPEEWALLDHPQKKLYKDVMLENARNLLSLGLPVPREYGISYFEERERPLMLEQEGLRSSCPEGEMK

SEQ ID NO: 16661 - protein, 81 aa, Phascolarctos cinereus
LFPELVTFEDISVDFAKKEWKTSAPAQRAFFRDLMLENYRDVVSLGFPFSKPTGISRREEEPWGLNRQGPLDLEGGRSTCT

SEQ ID NO: 16662 - protein, 81 aa, Phascolarctos cinereus
QQELVTFKDVAVDFTPEEWGNLDSSQKALYKDVMLENYRNLVFLGLTVWKPDVISHLEEGEAPWMQDREVPKTINPDLETR

SEQ ID NO: 16663 - protein, 81 aa, Phascolarctos cinereus
GKESVTFQDVAVEFSLEEWIHLNLSQKNLYRDVMLENYKNLVFLGFAVSKPDVIYQLERKETSWMPEADIPRSNCPGSKGF

SEQ ID NO: 16664 - protein, 81 aa, Phascolarctos cinereus
RQGSLTFRDVAVKFTQKEWRHLAPFQKELYRDVMLENYRNLVCLGLTVSKPDVISQLERREAPWTPGGIQRSSCPDWEAAH

SEQ ID NO: 16665 - protein, 81 aa, Phascolarctos cinereus
APVPVTFDDVTMYFTEQEWRSLEEWQKELYKHVVKTNYETLVSLGCAFPKPDLITWIEQGEEPFIRGQGNLGTKDLAIGPR

SEQ ID NO: 16666 - protein, 81 aa, Phascolarctos cinereus
PQESVTFKNVAVAFGQEEWGHLDPTQKDVYRDVILEKYRHLVSMGLPISKPDVISQLERKEDPWMLGREVSRDAYPDWETK

SEQ ID NO: 16667 - protein, 81 aa, Phascolarctos cinereus
AQHPVTFRDVAVHFTREEWSHLGPAQRALYREVMLETFENLVSLGSPVSKPQVICQLERGEAPCLPETEAPRPESLNSGTK

SEQ ID NO: 16668 - protein, 81 aa, Phascolarctos cinereus
SVESVTFKDVAVEFTQEEWVQLNPSQKKLYRDVMLENYRNLVSLGFAVSKPNVICQLERKEASLLPEADIPRSSCPETREF

SEQ ID NO: 16669 - protein, 81 aa, Phascolarctos cinereus
WQESLTFKDVAVDFTQEEWGLLDHSQKKLYREVMLENSQSLLFVGIPVLREDLIFHFEEREASWILDQIGPRNSCPDADTR

SEQ ID NO: 16670 - protein, 81 aa, Myotis lucifugus
LVTFKDVLVNFTREEWKFLDAAQQVMYRDVMLENYRNLVSLGHRLPKPDVILQLEKGEEPWLVERGTHQGAHPDWDTAVEI

SEQ ID NO: 16671 - protein, 81 aa, Myotis lucifugus
MFQESLTFQDVAVDFTGEEWDQLCPSQKNLYRDVMLENYRNLVALGHQLYKPEVITQLEQEEQWMMERDSPLDTRPDAENR

SEQ ID NO: 16672 - protein, 81 aa, Myotis lucifugus
FEDVAIAFSQEEWGLLDEDQRHLYCDVMLEVFALVSSVGCWHKKEEEEECSDGSVSVQVESKFMASKTVPPTQKTHLCKHC

SEQ ID NO: 16673 - protein, 81 aa, Puma concolor
RPRAVKFADVAVYFSTEEWGCLHPAQRALYRDVMRETYGHLGALGCAGPKPALISWLERNTDDWEPAALDPQECPRGVAVQ

SEQ ID NO: 16674 - protein, 81 aa, Puma concolor
KSQRFVSFKDVTVDFTWEEWQQLDSAQRNLYRDVMLENYSNLVSVGYQYLKSDVVLLKQGEPWMEGGEISNWAYPDFETGM

SEQ ID NO: 16675 - protein, 81 aa, Sapajus apella
KVPVTFVDIAVYFSEDEWKNLDEWQKELYNNLVKENYKTLMSLDADGPVPKPDAPAQAEAREEPCVWEQRHPEEREIPMDP

SEQ ID NO: 16676 - protein, 81 aa, Sapajus apella
TKGCVTFEDIAIYFSQEEWGLLDEAQRILYLEVMLENFALVASLGCGHGTEDKKTPSEQNVSIGVSQSKAGSSTQNTQPCE

SEQ ID NO: 16677 - protein, 81 aa, Sapajus apella
CEISVSFEDVTVDFSKEEWQHLDPAQRRLYWDVTLENYNHLLSVGYQVPKSEATFKLEQGEGPWTLEGEAPHQSCSGEAIG

SEQ ID NO: 16678 - protein, 81 aa, Sapajus apella
VYVFQGVLTFMDVAIEFSLEEWQCLNTAQQNLYRNVMLENYRNLVFLGIAASKPDLITCLEQGKEPWNVTRHEMVAEPPGR

SEQ ID NO: 16679 - protein, 81 aa, Sapajus apella
VQESVTFRDVAVFFSPDEWLHLDCAQRALYREVMLENYSSLVSLGWESLFETIVSEEENQEVMKKLIIDGPFDFKLEKTYI

SEQ ID NO: 16680 - protein, 81 aa, Sapajus apella
MLENYRNLAFLGIAVSKADLITCLQQGKDPWNMKRHSVAAKPPVLCSNFGQDLWPRLGIKDSFQKVILRENGKCGHKDLQL

SEQ ID NO: 16681 - protein, 81 aa, Sapajus apella
ETGPLTFRDVAIEFSLEEWQCLNPAQQDLYRKVMLENYRNLVFLGLAVSTPDWITCLEQGKDPWNMKRHSMVATPPVLCSH

SEQ ID NO: 16682 - protein, 81 aa, Sapajus apella
KPGAVRFGDVAVYFSREEWGCLRPAQRALYRDVMRETYSHLGALGVGGSKPALISWVEEEAELWVPAAQDPEVAKRPTEAD

SEQ ID NO: 16683 - protein, 81 aa, Oryctolagus cuniculus
AQVSVTFKDVALTFTQEEWGQLDVAQRTLYQEVMLETCELLVSLGCPLSQPELIHQMEHNPEVWMAMKELSQSFCPGENTK

SEQ ID NO: 16684 - protein, 81 aa, Oryctolagus cuniculus
PQESFSFEDLSVGFTRKEWQLLDPQQKKLYKDVMLENFSNLVSLGYEVMKPDVIFKLEQGEEPWIEDGEMPLPDSAEEVWQ

SEQ ID NO: 16685 - protein, 81 aa, Canis lupus
SKDLVTFGDVAVDFSQEEWEWLNPGQRNLYRKVMLENYRSLVSLAGVSVSKPDVISLLEQGKEPWMVKKEGTRGPCPDWEY

SEQ ID NO: 16686 - protein, 81 aa, Canis lupus
FQEPVMFKDVAVVFSEEELGLLDSTQRKLYRDVMLENFRNLVSVGHSSSKPDVISQLEREEKLCTKEFHTQGGGRNQKEME

SEQ ID NO: 16687 - protein, 81 aa, Canis lupus
CELSVSFEDVTVDFSREEWQQLDSTQRRLYQDVMLENYSHLLSVGYEVPKPEVIFKLEQGEEPWILERKTPHQSCSDLLNR

SEQ ID NO: 16688 - protein, 81 aa, Muntiacus muntjak
ISGSLSFRDVTVGFTQEEWQHLDPAQRMLYRDVMLENYSHLISVGYCIPKPEVILKLEQGEEPWILEEEYSSQSVPELINS

SEQ ID NO: 16689 - protein, 81 aa, Canis lupus
SQGSVLFEDISVDFTQKEWQLLDPAQRLLYRDVMLENYRHLVSLGHCVTKPELIFKLEQGEEPWVPKKELPSQSCPEVQEA

SEQ ID NO: 16690 - protein, 81 aa, Canis lupus
LQKPITFEDVAVNFTQEEWMCLDASQRVLYQDVMSETFRNLMSVAQNLSNPDLIIKLGQEESQQRAEFQAPVIPASRAGRP

SEQ ID NO: 16691 - protein, 81 aa, Muntiacus muntjak
DCVVFEDVAVYFSQEEWGLLDEAQRHLYRAVMTENLALVTSLGCWHGAQGEEPSSEQGVSIGMSEVRTAKPDPSSRKAQPS

SEQ ID NO: 16692 - protein, 81 aa, Muntiacus muntjak
FQVPLTFSDVSIDFSQEEWECLNSDQKNLYRDVMLETYTNLVSLDFDFTTENNKLSSEKSSFEVNSYHWETMKSKTFNLMG

SEQ ID NO: 16693 - protein, 81 aa, Muntiacus muntjak
MAFRDVAVDFTQDEWVLLSPAQRSLYREVMLENYSNLVSLGIPFSKPKLITQLEQGKETWREERKCSPVSCVEPKPELHLC

SEQ ID NO: 16694 - protein, 81 aa, Ailuropoda melanoleuca
FQESVTFKDVIVDFTQEEWKQLDPVQRDLFRDVTLENYTHLVSIGLQVSKPDVISQLEQGTEPWIVEPGIPVGTLGDYETR

SEQ ID NO: 16695 - protein, 81 aa, Macaca fascicularis
WSQMPVTFEDVALYLSREEWGRLDHTQQNFYRDVLQKRNGLSLGFPFSRPFWAPQALGKGEASGSSRQTGDEKEEWRGAYS

SEQ ID NO: 16696 - protein, 81 aa, Macaca fascicularis
KKKPVTFEDVAVNFTQEEWDCLDASQRVLYQDVMSEIFKNLASVARIFLHKPELITKLEQEEEQWREFVHLPNTEGLSEGK

SEQ ID NO: 16697 - protein, 81 aa, Macaca fascicularis
KPRTVSFADVAVYFSREEWGCLRPAQRALYRDVMRETYGHLGALGVGGSKPALISWVEEEAELWDPAAQDPEVTKCPTETD

SEQ ID NO: 16698 - protein, 81 aa, Macaca fascicularis
GSVTFEDVAIYFSQEEWGLLDEAQRLLYRDVMLENFALITALVCCHGMEDEETPEQSVSVERVSQVRTPEASPSTQKTQSC

SEQ ID NO: 16699 - protein, 81 aa, Macaca fascicularis
PQGLLTFRDVAIEFSQEEWKCLDPAQRTLYRDVMLENYRNLVSLAISSKCMMKFSSTGQGNTEVIHTGTLQRQASHHIGDI

SEQ ID NO: 16700 - protein, 81 aa, Macaca fascicularis
FQEMVTFKDVAVVFTEEELGLLDSVQRKLYRDVMLENFRNLLLVAHQPFKPDLISQLEREEKLLMVETETPKDGCSGRKNQ

SEQ ID NO: 16701 - protein, 81 aa, Macaca fascicularis
FSREPVCPFEEKTKVERMVEDYLANSYQDSVTFDDVAVEFTPEEWVLLDTTQKYLYRDVMLENYMNLASVADKKLQWMETL

SEQ ID NO: 16702 - protein, 81 aa, Phascolarctos cinereus
PKVPLTFDDVAVYFSEQEWGKLEEWQKELYKHVMRGNYEMLVSLDYAVSKPDILSQIERGEKPCLKDQWGSDEEVSCPGKL

SEQ ID NO: 16703 - protein, 81 aa, Phascolarctos cinereus
MLENYRNLVCLGLAVSKPRVIYQLEQGKVPWMPEGDIPRTPYPDWDTGPETMESAPKMDISMEKSFQEKFERSSLFLSKFE

SEQ ID NO: 16704 - protein, 81 aa, Phascolarctos cinereus
PQELVTFQDVAVDFTPEEWVFLDHPQKELYKEVMLENARNLLSLGLPVSREYWISCFDERKAPWMLEQEGLRSCCPEGEIR

SEQ ID NO: 16705 - protein, 81 aa, Phascolarctos cinereus
FQESVAFKDVAVDFTQEEWGQLDPAQRDLYRDVMLENYGNLVSLGFPVSKPYVISQLEQGEEPWVVEREVSRGICLDLGTR

SEQ ID NO: 16706 - protein, 81 aa, Phascolarctos cinereus
QESVTFRDVAVDFTQEEWGLLGPDQKELYREVMLENYWNLVCLGWESMFETKVSILTPEQSSQKRLTRDGLCASNLEESWK

SEQ ID NO: 16707 - protein, 81 aa, Phascolarctos cinereus
FQESLTFKDVAVEFTWEEWRHLDPAQRTLFREVMLENYGNLVSLGLTVTKPDVIFQLERGEAPWMLEIKVPSSTPAECLNL

SEQ ID NO: 16708 - protein, 81 aa, Myotis lucifugus
MNFEDLAIAFSPGEWGILDEAQRLLYCKVMLEVFALGSSVGYWHEKDDYEACSNQSVSVEGESQVRASETAPATQKNHPCK

SEQ ID NO: 16709 - protein, 81 aa, Myotis lucifugus
QDMNFEDVAIAFSQEEWGLLDEAQRHLYCDVMLEVFALVSFIGHCHKIDDVEAYSEHSVSVGESQVRASRTAAATQRTHLC

SEQ ID NO: 16710 - protein, 81 aa, Myotis lucifugus
VTLEDVAVHFSREEWRLVDEAQRRLYLRVMLENFALVSSLGCCCGADDVEAPGEQRVSVGMSQGKNPQTASSSQKRHPCES

SEQ ID NO: 16711 - protein, 81 aa, Myotis lucifugus
EPVTFKDVAVVFSEEELGLLDSVQRKLYRDVTLENFQNLVSVGHLFSKPDVISQLEREEQLWMTEIQTQRGGRNENEMETL

SEQ ID NO: 16712 - protein, 81 aa, Gorilla gorilla
FLLWLCSFQPFPRAAENEQVPGYHVNKPNAVFKLKQGKEPWILEVEFPHRGFPEDLWSIHDLEARYQESQAGNSRNGELTK

SEQ ID NO: 16713 - protein, 81 aa, Ailuropoda melanoleuca
QDSVVFEDVAVDFTQEEWALLDLAQRSLYRDVMLENFQNLASLALTGYPLHTPYLISQWKQEEDLETVERGPIQGEHQEGF

SEQ ID NO: 16714 - protein, 81 aa, Ailuropoda melanoleuca
QGLLTFKDVAIEFSQEEWGCLSHTQRELYRDVMLENYGHLLFLETGFILSKPDLITFLEQEKQLWDVKRKETVAFHPGRET

SEQ ID NO: 16715 - protein, 81 aa, Gorilla gorilla
SVAFEDVAVNFTQEEWALLSPSQKNLYRDVTLETFRNLASVGIQWKDQDIENLYQNLGIKLRSLVERLCGRKEGSEHRETF

SEQ ID NO: 16716 - protein, 81 aa, Lynx canadensis
QKFQGSVSFKDVTVGFTQEEWQCLDSSQRSLYRDVMLENYSHLVSVGKDCFYIIPSSIYFLPWRLDKKSKSKGRRQENQRK

SEQ ID NO: 16717 - protein, 81 aa, Lynx canadensis
FQELVTFQDVAVDFSLEELTYLSAAQRNLYREVMLENYRNLVSLGYQFSKPDIISQLEEEESHVMEADSDTEMHHGESSPD

SEQ ID NO: 16718 - protein, 81 aa, Lynx canadensis
GLLDPTQRKLYREVMLENFGNLVSVGHQPFKRDMVHLVREGKFWMMKLATQGKGSSGKIQTIPKVEPHEELSCWQIWQHIA

SEQ ID NO: 16719 - protein, 81 aa, Lynx canadensis
RPESVTFEDVAVYFSENEWIGLAPAQRVLYRDVMLENYGVVASLAFPFPKPALISQLERGEAPWCKAPQGALDGECPRGVS

SEQ ID NO: 16720 - protein, 81 aa, Lynx canadensis
GCVTFEDVFVYFSREEWELLEEAQRLLYRDVMLENFALVASLDGWREADNGETPEQNVFVGVSQLRTPESGLFIQKAHPCE

SEQ ID NO: 16721 - protein, 81 aa, Lynx canadensis
SQGTVTFRDVAIDFTQEEWQQLDLAQRNLYRNVMLENYNNLITVGCPFTKPDVIFKLEQEEEPWVVEEEVLRRHCPGEVWG

SEQ ID NO: 16722 - protein, 81 aa, Lynx canadensis
TQDSVVFEDVAVDFTQEEWALLDLAQRNLYRDVMLENFQNLASLGYPLHTPYLISQWKQEEDLETVERGPIQGEHQEGFET

SEQ ID NO: 16723 - protein, 81 aa, Lynx canadensis
FEGSVSFEDVAVDFTRQEWHRLDPAQRTMHKDVMLENYSNLASVGLCVAKPEMIFKLERGEELWILEEESSGQGFPGSLSL

SEQ ID NO: 16724 - protein, 81 aa, Lynx canadensis
LKPAQRNLYRDVMLENYSNLVTVGYQVTKPDVIFKLEQEEEPWVIEEEMLGRHCPEVWEVDEQQIKKQQEALVRKVTSISK

SEQ ID NO: 16725 - protein, 81 aa, Lynx canadensis
LLQESVTFKDVVVLFTQDEWAQLSPTQRALYRDVMLENYSNLVSLGLLGPQPDVLSQLGKGEEWMLEDTSAGFCLDWMTMP

SEQ ID NO: 16726 - protein, 81 aa, Phyllostomus discolor
AQLSLTFRDVSVDFSGEEWECLDPAQQKLYMDVMLENYKNLVSLGLTLSKPILVTCLEQMKECWDVNRKQTISVHPAMSSK

SEQ ID NO: 16727 - protein, 81 aa, Lynx canadensis
SSGSLSFRDVAVGFTRKEWQHLDPAQRTLYRDVMLENYSHLVSVGCQVTKPAVISRLERGQEPWMEEEELVRWSFPEAILQ

SEQ ID NO: 16728 - protein, 81 aa, Lynx canadensis
TARSQASVTFKDVAMDFTPEEWGKLDPAQREVMLENYRNLVSLWLPVSKSENYSLESGKEPLMLERKAPKSSYSDLEAKPE

SEQ ID NO: 16729 - protein, 81 aa, Lynx canadensis
LQSPVTFEDVAVYFSKEEWGLLDAGQRDLYHNVMLENFELMTSLGCWHGVEDEGAHSKQNASIQGMLQVRIPTANPSTQKA

SEQ ID NO: 16730 - protein, 81 aa, Lynx canadensis
GCLNQSQRELYRDVMLETYGHLLFLGLIVSKPHLVIFLEQKRELWDVKREKTVSTDWNDVPFFVICYLSAISSHGSQSFLP

SEQ ID NO: 16731 - protein, 81 aa, Phyllostomus discolor
WSQMPVTFEDVALYLSREEWGRLDHPQQSFYRDVLQKRNGLALGFPLSRTFWASQVQGKGEASSWCLQMGEEEKRGMADVR

SEQ ID NO: 16732 - protein, 81 aa, Phyllostomus discolor
SQECLTFKDVSVDFSWEEWGCLDPAQRKLYSDVMLENYSNLVSLGLVVSKPVLVTFLEQMQESWDVSRKKSISTAPAVSSV

SEQ ID NO: 16733 - protein, 81 aa, Phyllostomus discolor
LVAFEDVSVKFTLEEWALLDSSQKKLYRDVMRETFRNLASIGEICKDRDIEDHYKHHGTNLSHKVERLGKSKQGSQCGENF

SEQ ID NO: 16734 - protein, 81 aa, Phyllostomus discolor
PKVPVTFDDISIYFSTPEWEKLEEWQKELYKNIMKGNYESLISMDYAMNQPDVLSQIQPEGEHNTEDQAGPEESAIPTDPS

SEQ ID NO: 16735 - protein, 81 aa, Desmodus rotundus
RVTFEDVVVYFSWEEWGLLDETQRCLYHDVMLENFALVTSLGSWYGMEEEALSVQSVSVAQTSPSQTPDSDPAVQEDHPCE

SEQ ID NO: 16736 - protein, 81 aa, Phyllostomus discolor
AEVGVTFADIALYFSGEEWCLLNEDQRCLYLDVMLDNFELASSLGCCCGAEDVETPIEQTVPVAVSQAKNLKVALSSVKSL

SEQ ID NO: 16737 - protein, 81 aa, Macaca fascicularis
KPGAVSFADVAVYFSPEEWGCLRPAQRALYRDVMRETYGHLGALGFPGPKPALISWMEQETEAWSPAAQDPEKGERLGGAR

SEQ ID NO: 16738 - protein, 81 aa, Macaca fascicularis
PAQGMTFEDVAIYFSQEEWELLDESQRFLYCDVMLENFAHVTSLGYCHGTENEVIASEQSVSTQVRTSKGDTPTQKSLSEI

SEQ ID NO: 16739 - protein, 81 aa, Macaca fascicularis
VKIEEVADVAVSFILEEWGHLDQSQKSLYRDDRKENYGSITSMGYESRDNMELIVKQISDDAESHWVAPEHTERSVPQDPD

SEQ ID NO: 16740 - protein, 81 aa, Macaca fascicularis
IQSQISFEDVAVDFTLEEWQLLNPTQKNLYRDVMLENYSNLIFLEVWLDNPKMWLRDNQDNLKSMERGHKYDVFGKIFNSN

SEQ ID NO: 16741 - protein, 81 aa, Macaca fascicularis
VTFEDVTIIFTWEEWKFLDSSQKRLYREVMWENYTNVMSVENWNKSYKSQEEKFRYLEYENFSCWQGWWNAGAQMCENQNY

SEQ ID NO: 16742 - protein, 81 aa, Macaca fascicularis
CQESVTFEDVAVVFTDEEWSHLVPIQRDLYKEVMLENYNSIVSLGLPVPQPDVIFQLKRGDKPWVVDLHGSEERERPESVS

SEQ ID NO: 16743 - protein, 81 aa, Macaca fascicularis
VAFEDVAIYFSQEEWELLDETQRLLYHDVMLENFAVMASLGCWCGAEDEGAPSAESISVSELSQGRTPKADTSTDKSHPCE

SEQ ID NO: 16744 - protein, 81 aa, Phascolarctos cinereus
PQEAVTFKDVVVDFTQEEWKCLDSSQKEFYRDVMLENYSNLVSLGLAFPKPYVIDQLERREAPWIPEGDIPRISHPERKKK

SEQ ID NO: 16745 - protein, 81 aa, Phascolarctos cinereus
SQKSLTLKDMAVEFTREEWEQLDPAQRNLYRDVMLERYRNLVLLGLPISKPDVISQLEREKEPWMLERKDPKGGHLDWDIR

SEQ ID NO: 16746 - protein, 81 aa, Phascolarctos cinereus
PRGLVTFKDVAVDFTQEEWGLLDHNQKELYKEVMLENARNLLSLGLPVPREDVISYFEQREAPWMLEQEGLRSRCLEGEIR

SEQ ID NO: 16747 - protein, 81 aa, Macaca fascicularis
IVLFQISFEDVAVDFTLEEWQLLNPTQKNLYRDVMLENYSNLIFLEQQDPWIIEVWLDNPKMWLRDNQDNLKSMERGHKYD

SEQ ID NO: 16748 - protein, 81 aa, Phascolarctos cinereus
PALTAGPRKESVTFKDVAVEFTQEEWVQLNPSQKKLYRDVMLENYKNLVSLALPSVAFALPQEDSLEEEGMASAPKPGPGK

SEQ ID NO: 16749 - protein, 81 aa, Phascolarctos cinereus
LQTSLMFKDVAVYLTREEWGCLGPAQRGLYRDVMLENYGNLVSLGFSVSKPDIISQLEKGEEPWVLDTQGAGGRDIMKSDY

SEQ ID NO: 16750 - protein, 81 aa, Phascolarctos cinereus
SVTFQDVAVTFTPEEWGRLAAPQKELYREVMLENFGHLACLDLEVIFETKASTPKLDISIEESSLERIKRELPCVSKLGET

SEQ ID NO: 16751 - protein, 81 aa, Phascolarctos cinereus
KQGLVRFRDVAVDFTPEEWGCLAPSQKELYRDVMLENYLNLACLGLAVSKPAVICQLEQGAAPWLPEGDASVRCCPDWEIN

SEQ ID NO: 16752 - protein, 81 aa, Phascolarctos cinereus
PQEAVTFNDVAVDFTQAEWRHLDPSQKELYRDVMLENYRNLVSLVGLPVSKPEVISQLEQGERPWIMESEELRDWKTRSKT

SEQ ID NO: 16753 - protein, 81 aa, Phascolarctos cinereus
TAGPGKESVTFKDVAVEFTQEEWVQLNSSQKKLYKDMMLENYRNLVSLDVIYQLERKEASWMPEADIPRSSCPERRGFTGD

SEQ ID NO: 16754 - protein, 81 aa, Phascolarctos cinereus
ALESVTFKDVAVDFTQEEWGWLDPSQRELYKEVMLENYRNLLSLGFPVPKPDVISQLERGAAPGMLEREGPRASRPDWETR

SEQ ID NO: 16755 - protein, 81 aa, Phascolarctos cinereus
MELVFFEDVAVYLTREEWGLLDPAQKQLYKDVMLENYWILISLGFPISKPEVICQLEQGKEAWVLDIQVPKESMLSRNTYR

SEQ ID NO: 16756 - protein, 81 aa, Phascolarctos cinereus
GKETVTFKDVAVEFTWEEWVHLNPSQKTLYKDVMLENYRNLVSLGFGISKPDVIYQLERKEATWMQEPDILRSSWPGREEF

SEQ ID NO: 16757 - protein, 81 aa, Phascolarctos cinereus
GQESVTFTDVAVDFTLEEWAYLDHFQKELYKDVMLENYRNLLCLGLAVSKPDVISQLEQGDAPWMSEGGVPRSIYSDWETR

SEQ ID NO: 16758 - protein, 81 aa, Phascolarctos cinereus
CQVSLTFQDVAVDFSQEEWGLLEPAQKDMYRDVMLENYENFISLGLPISKPSILSQLERRETPWIAEEKVSLSAYLGSLGQ

SEQ ID NO: 16759 - protein, 81 aa, Canis lupus
GSVSFTDVTVDFTQEEWEQLDPSQRILYMDVMLENYSNLLSVEVWKADDQMERDHSNPDEQARPFIIFKNQTPIEERGNLF

SEQ ID NO: 16760 - protein, 81 aa, Canis lupus
MLENYGNLVSVGYQLSKPGVISQLEKGEEPWLIKRVISGSPSSALLSQDAKTQGESSKDGFTSRLPAAESQELLTFQDVSV

SEQ ID NO: 16761 - protein, 81 aa, Canis lupus
MTFEDVAIDFTLEEWALLNSHQRKLYRDVMLENYRNFASLGKTPHQSLHPGKVLGDCSQLNPRESILSRENDCKKDKNTFI

SEQ ID NO: 16762 - protein, 81 aa, Muntiacus muntjak
MLENYGHLVSLGLNISKPDVVSLLEQGKEPWLGNGDVSRELFPASKPNGEIKAFSPKNVIFEDNSSQYLMMERFLSQGSEY

SEQ ID NO: 16763 - protein, 81 aa, Muntiacus muntjak
KVESVKFRDVAVVFSPDQWVHLSPEKRELYRDVMLDTCDHLVSLGRWAYKAEVMSSLRQGKEPWMLEREVTSAPCPACQPA

SEQ ID NO: 16764 - protein, 81 aa, Muntiacus muntjak
RLLTFRDVTIDFTLEEWGCLDLSQRELYRDVMLENYRNLASLGLVVVKPDLVIFLEQRKHLWDVRRMETTATYPDNDSKSN

SEQ ID NO: 16765 - protein, 81 aa, Canis lupus
SHGPLSFEDVAVAFTKEEWQQLDPAQRTLYRDVMLENFSHLVSLGHPVSKPDVISKLEQGEEPWIIKRDIPNWIYPERENR

SEQ ID NO: 16766 - protein, 81 aa, Canis lupus
SQESVTFQDVAVDFTEKEWPLLDSSQRKLYKDVMLENYSNLASVGYQVGKPSLISHLEQEEELRTEERELHQATSPDWETP

SEQ ID NO: 16767 - protein, 81 aa, Muntiacus muntjak
YCFTKPELIFMLEQGADPWLLEKEFINRSSPEESQPDELLEESLENQGKRLRQVLFINKSLTVEQEISGKPCTLDINIFPA

SEQ ID NO: 16768 - protein, 81 aa, Muntiacus muntjak
MMFSDVAVDFSHEEWECLDLEQRHLYSDVILENYSNLVSLGLCFYHPEVFSLLEKEREPWMALKDETCPDIQCRCQTKKLS

SEQ ID NO: 16769 - protein, 81 aa, Desmodus rotundus
VSFRDVAVDFTQEEWQQLDPVEKTTYRDVMLENYSHLVSVGYDSTKPNVIVKLEQGEEPWVAEGDFPCQSCPEEIWKADDV

SEQ ID NO: 16770 - protein, 81 aa, Macaca fascicularis
SYEGSVSFRDVAIDFSREEWRHLDPSQRNLYRDVMLETYSHLLSVGYQVPKPEVVMLEQGKEPWALQGERPRQSCPGEKLW

SEQ ID NO: 16771 - protein, 81 aa, Macaca fascicularis
QGLLTFRDVAVEFSLEEWQRLAAAAAAAAAAAAAAAAAAAAAAIAVSKPDLITCLEQEKEPLTMQRHEMVDEPPVMCSHFA

SEQ ID NO: 16772 - protein, 81 aa, Macaca fascicularis
MAQVTFSDVAIDFSHEEWAWLDSAQRDLYKDVMVQNYENLVSVGLSITKPYVIMLLEDGKEPWMVEKKLSKGMIPDWESRW

SEQ ID NO: 16773 - protein, 81 aa, Macaca fascicularis
ALRSVMFSDVSIDFSPEEWEYLDLEQKDLYRDVMLENYSNLVSLGCFISKPDVISLLEQGKEPWKVVRKGRRQYPDLETKY

SEQ ID NO: 16774 - protein, 81 aa, Macaca fascicularis
MELLTFRDVAIEFSPEEWKCLDPAQQNLYKDVMLENYRNLVSLAMCSPFSQDLSPVQGIEDSFQKLVLRRYEKCGYENLQL

SEQ ID NO: 16775 - protein, 81 aa, Phascolarctos cinereus
RAGLVTFEDVSVDFSRSEWKQLKPAQRDLYKDVMLENYKNLVSLGLQSFKPEVISRLEQGEVPWILADHVPKDSLHHKTIC

SEQ ID NO: 16776 - protein, 81 aa, Phascolarctos cinereus
MLENYSNLLYLGLVISKPDVIHQFEQEAPWRPDRRVPGSVCPAEETGPECKESTPKWNISVEHSSPNRLTSSGLCVFSLKE

SEQ ID NO: 16777 - protein, 81 aa, Phascolarctos cinereus
SQELVTFEDVAVYFIRKEWKRLDPAQRDLYRDVMLENYGNVFSLGFPFPNPEIISHLDGEEEPWVLDLKGAESQGLQSASC

SEQ ID NO: 16778 - protein, 81 aa, Phascolarctos cinereus
CQEPVTFRDVAVDFTPEEWGQLGLAQRELYQDVMLENYRNLVSLGLPVSTPKVICHLEPRDEPWRAQGAAPPSTWSDWESK

SEQ ID NO: 16779 - protein, 81 aa, Phascolarctos cinereus
QKESVTFKDVTVHFTQEEWGNLDPSQKELYKDVMLENYKNLVFLGLTVWKPDVISHLEEGETPWIQDSEVLWSTSPDWMTG

SEQ ID NO: 16780 - protein, 81 aa, Phascolarctos cinereus
SQKSLTFKDVAVDFTKEEWRQLNPSQRDMYRDVMLENYKNLVFLGLLGSQPDVISQLEKGEMPWMPEGEVPRSPCLDSLIQ

SEQ ID NO: 16781 - protein, 81 aa, Phascolarctos cinereus
PQELVTFKDVTVDFTWEEWGCLYPSQKKLYHDVMLENYRNLICLGLEVSEPHVIYQLEHGEAPLKLEGDIPRTSRPGRGMS

SEQ ID NO: 16782 - protein, 81 aa, Phascolarctos cinereus
AQESVTFKDVAVEFTEEEWRHLDPAQRNLFRAVTLENYRNLVSLGQRITKSDLIFLLERGEAPWTEWSQAPGGSNSNSLIL

SEQ ID NO: 16783 - protein, 81 aa, Gorilla gorilla
QGRLTFRDVAIEFSLAEWKFLNPAQRALYREVMLENYRNLEAVDISSKCTMKEVLSTGQGNREVIHTGMLQRHESHHIGDF

SEQ ID NO: 16784 - protein, 81 aa, Ailuropoda melanoleuca
VKIEDVADVAVSFILEEWGHLDQSQKSLYRDDRKENYGSITSMDYESGHDNVELAVKQISDDTEPHWMTSGSPERNVPQSQ

SEQ ID NO: 16785 - protein, 81 aa, Ailuropoda melanoleuca
QESLTLEDVAVDFTWEEWQLLAPAQKELYRDVMLENYSNLVSVGYQASKPDALSKLERGEEPWAKQEEVPSGTRPGHWENP

SEQ ID NO: 16786 - protein, 80 aa, Ailuropoda melanoleuca
HVLQGLLTFGDVAIEFSQEEWRCLSHTQRELYRDVMLENYRHLVFLETGLIVSKPDLVSFLEQEKQLWGVKRKETVAFHP

SEQ ID NO: 16787 - protein, 81 aa, Gorilla gorilla
EPVTFEDVAVDFTQEEWQQLNPAQKTLHRDVMLETYNHLVSVGCSDIKPDVIFKVEHGKDPWIIESELSRWIYPDRVKGLE

SEQ ID NO: 16788 - protein, 81 aa, Ailuropoda melanoleuca
GQISISKIAISFEDVAVDFTSEEWQLLNPTQKSLYRDVMLENYSNLVFLGKNIHMMCPLCTELVMACTSFPIQRHKLVATI

SEQ ID NO: 16789 - protein, 81 aa, Ailuropoda melanoleuca
YQELVTFRDVAVDFSQEEWDCLNSSQRHLYSNVMLENYRILVSLGLCFSKPSVILLLEQGKEPWMVKRELAKGLCSGWESM

SEQ ID NO: 16790 - protein, 81 aa, Ailuropoda melanoleuca
STEPVIFRDVAMYFTQKEWQLLEPTQKDLYREVMLENYGNLASLGYRLFKPKLITRLEQGDEPCVKERDIPRAPQQGDAGI

SEQ ID NO: 16791 - protein, 81 aa, Ailuropoda melanoleuca
LQGLLTFGDVAIEFSQEEWRCLSHTQQELYRDVMLENYGDLLFLDFILLKPDLIMVLEQEKQLWDVKRKETVAFHPGRETS

SEQ ID NO: 16792 - protein, 81 aa, Ailuropoda melanoleuca
SKVPVTFGDLAIYFSQEEWEWLSPIQKDLYEDVMLENYQNLVSLGLSFRRPNVITLLEKGKAPWMVEPVRKRRGVDSGSKC

SEQ ID NO: 16793 - protein, 81 aa, Ailuropoda melanoleuca
YQRPVSFKDVVVGFTQEEWHRLNPAQRALYRDVMLETYSNLVSVGYEGTKPYVILKLEQEEAPWICEAACSGCPCQENISQ

SEQ ID NO: 16794 - protein, 81 aa, Lynx canadensis
RPRAVKFADVAVYFSTEEWGCLRPAQRALYRDVMRETYGHLGALGCAGPKPALISWLERNTDDWEPAALDPQECPRGVAVQ

SEQ ID NO: 16795 - protein, 81 aa, Lynx canadensis
GSPLACGSTVPPSRQGCVTFEDVFVYFSREEWELLEEAQRLLYRDVMLENFALVSSLGLAVSRTHVVSQMQPEGNAGCLRR

SEQ ID NO: 16796 - protein, 81 aa, Lynx canadensis
LQGLVTFEDVAVYFSREEWGLLNLTQRSLYRDVMLENFALIGSLGFASSRCHVVAQLQSEEEFWVPSMVDLTLVSRVEARS

SEQ ID NO: 16797 - protein, 81 aa, Lynx canadensis
SYEGSVSFRDVAVDFSREEWQHLDLAQRNLYRDVMLETYSHLLSVGYEVPQPEVFMLEQGKEPWALQGESPHQSCSGEKLW

SEQ ID NO: 16798 - protein, 81 aa, Lynx canadensis
CWGLLSFKDISMEFTWDEWQLLDSAQKYLYRDVILENYSHLVSVGYHGTKPDLIFKLEQGEEPWIINAKVSRQSCPEDWKE

SEQ ID NO: 16799 - protein, 81 aa, Lynx canadensis
FQESLSFEDVAVYFTREEWDKLDWAQKDLYRDVMLENYRNMILLGFQFPKPEVICLLEQWEEPWILDLPRTGTRKASSSAC

SEQ ID NO: 16800 - protein, 81 aa, Phyllostomus discolor
MLETCRILVSLGHPVPRPELVHLLEHGQELWTVKRGSPRHTCPGDGAKLQTREPSTIQPVLSEGALLQGSRTLELSRDPRL

SEQ ID NO: 16801 - protein, 81 aa, Lynx canadensis
LLTFRDVAIEFSQEEWGFLNQSQRELYRDVMLETYGHLLFLAISSHGSQSFLPKPCIEASSQNVSLGTWKHHALENLHLMI

SEQ ID NO: 16802 - protein, 81 aa, Lynx canadensis
MLETYNHLVSLEIPFSKPKLISQLEQGEEPWIEEKRCPLVLCPGSKLEIQPYPPCPLAFSSQRGLSQHVWLRHLPQLFSSY

SEQ ID NO: 16803 - protein, 81 aa, Lynx canadensis
RKAIVPLSPPYPLERNEEWPLLSHAQRLLYRYVMLENYSNLVFLGIPFPKPTLVIVLEQGEEPWREERECLWIVRGLLETN

SEQ ID NO: 16804 - protein, 81 aa, Phyllostomus discolor
KALGSVAFRDVIVDFTQEEWQQLKPAQKDLYREVMMENYWNLVSLDLETRPDLKELDPQEDNWGGRPSIAVTSGPMRNGTQ

SEQ ID NO: 16805 - protein, 81 aa, Phyllostomus discolor
AQGSVTFKDVTVDFTQEEWQHLDPAQKTLYMDVMLENYCHLISVGCHMTKPDVILKLEQGEEPWIPLTSHTCLEQNWSAED

SEQ ID NO: 16806 - protein, 81 aa, Phyllostomus discolor
VTFKDVAVDFTQEEWGQLDSPQRALYRDVMLENYQNLLALEWEPRLEVKEESCQQQDPYKGEPSQEPVVEGPARSGLHSPS

SEQ ID NO: 16807 - protein, 81 aa, Phyllostomus discolor
DPMQVTFEDVFMHFSQEEWGLLDEAQRLLYRDVMLENLALTASLGYASSMPRGVAPLELCNESWLSNWAHMTTAMTREAQG

SEQ ID NO: 16808 - protein, 81 aa, Phyllostomus discolor
TQEFLTFRDVAVDFTLEEWQLLDSDQKDLYRDVMLENYSNLVSVGYESSNPDVFSKLDHGEAPWTKEGEIHCGNHSEIWKL

SEQ ID NO: 16809 - protein, 81 aa, Phyllostomus discolor
TAGPVTFKDVTMAFTQKEWEQLDPAQRSLYKDVMLENYSNCASVGCQAAKPDMISKLEKGEEPCLGKGKRPRQGGTPRETP

SEQ ID NO: 16810 - protein, 81 aa, Desmodus rotundus
VQEPVTFKDVAVDFTQEEWGQLDPVQRTLYRDVMLETFGHLLSVGNQIAKPEVISLLEQGGEPWLVEQTDPQGTCAEMARN

SEQ ID NO: 16811 - protein, 81 aa, Desmodus rotundus
MASPSPPLEPKEEWDYLDPAQRSLYKDVMMENYGNLVSLDVLNRDKDEEPTVKQEIEEIEEEVESKGIIVTRIKSETDQDP

SEQ ID NO: 16812 - protein, 81 aa, Macaca fascicularis
QGLLTFRDVAIEFSQEEWKCLDPAQRALYRDVMLENYRNLVFLGICLPDLSIISMLEQRRDPRNLQSEVKIANNPDGRECI

SEQ ID NO: 16813 - protein, 81 aa, Macaca fascicularis
GRLTFRDVAIEFSLAEWKCLDPVQRALYTAVMLENYRNLEFVDSFLKFMMEFSSTGHSNTREGFHTGTLERHKSHPIGDFC

SEQ ID NO: 16814 - protein, 81 aa, Macaca fascicularis
LTFRDVAIEFSQEEWKCLDPAQRTLYRDVMLENYRNLVSLAISSKCMTRKFSSTGQGNTEVIHTGTLQRQASHHIGESCFQ

SEQ ID NO: 16815 - protein, 81 aa, Macaca fascicularis
FQEPVTFEDVAVSVTQNEWASLHPMQRALYREVMLENYANVTSLSAFPFSKPDLIFQLEQGEAAWGPDPWTLAGGEALRGM

SEQ ID NO: 16816 - protein, 81 aa, Macaca fascicularis
LDSMTFEDIVVDFTREEWALLDTSQRKLFQDVMLENISHLVSIGESLYIYYVCMYICIHSLTCFSLIHSFILHVSRTAFSS

SEQ ID NO: 16817 - protein, 81 aa, Macaca fascicularis
MLENYRNLVFLGIAAFKPDLIIFLEQGKEPWNVKRYEMVEEPPVICSHFAQDLWPEQGIEDSLQKVILRKYEKCGRENLQL

SEQ ID NO: 16818 - protein, 81 aa, Phascolarctos cinereus
WQELLTFKDVAVDFTQEEWGLLDHSRKELYKEVMLENSQNLLSLGIPVLREDLISHFEEREASWILDRIDLRNSCPEKPSL

SEQ ID NO: 16819 - protein, 81 aa, Macaca fascicularis
GLVTFGDVAVDFSQEEWEWLNPNQRNLYRKVMLENYKNLASLGKGDCISVWTPDVISSLEQGKEPWTVKRKMTRAWCPDLK

SEQ ID NO: 16820 - protein, 81 aa, Macaca fascicularis
DSVAFEDVAVNFTQEEWALLDSSEKNLSRKVMQETCRNLAFVEIIWYRDCVKAKKVVSMMDKLSAKFQILISMRTFLLDEN

SEQ ID NO: 16821 - protein, 81 aa, Phascolarctos cinereus
MQESVTFKDVAVDFTQEEWKQLDPAQRDLYRDVMLENYRNLVSLGLPVFKPDVISQLEKGEAPWTPEVPRSTCSGSFSQEA

SEQ ID NO: 16822 - protein, 81 aa, Myotis lucifugus
SQQDMDFEDVAIAFSQEEWRLLDEAQRLLYCDVMLEVFALVSSAGCWHKTVDEETCSGQSVSVHGESQVRAPKTEPATQRT

SEQ ID NO: 16823 - protein, 81 aa, Puma concolor
QGTVIFKDLTVYFSWEEWGLLDEAQMCLYHNVMLENLALMTSLAVNLYNQTSYVLMNYGGGTEQHIGEKHFRSNMGGALLL

SEQ ID NO: 16824 - protein, 81 aa, Bos mutus
KPLAVRFADVAVYFSPEEWGCLRPAQRALYRDVMQETYGHLGALGFPGPKPALISWMEQESEAWSPAAQDPEEGESLGGAL

SEQ ID NO: 16825 - protein, 81 aa, Neophocaena asiaeorientalis
QGPVSFEDVTVGFTQEEWQHLDPAQRTLDRDVMLENYSHLISVGRDCIIFDLMEKSQEKEDQHWWKVDFVNNRTLTKERNS

SEQ ID NO: 16826 - protein, 81 aa, Nomascus leucogenys
FQESVTFQDVAVDFTAEEWQLLDCAERTLYWDVMLENYRNLISVGCPITKTKVILKVEQGQEPWMVEGVNPDQSSPENDCP

SEQ ID NO: 16827 - protein, 81 aa, Nomascus leucogenys
VHGSVTFRDVAIDFSQEEWECLQPDQRTLYRDVMLENYSHLISLAGSSISKPDVITLLEQEKEPWMVVRKETNRRYPDLES

SEQ ID NO: 16828 - protein, 81 aa, Nomascus leucogenys
PVTFRDVTVIFTEAEWKRLSPEQRNLYKEVMLENYRNILSLAEPEPEIYTCSSCLLAFSCQQFLSQHVLQIFLGLCAENHF

SEQ ID NO: 16829 - protein, 81 aa, Muntiacus muntjak
PQEPVTFADVAVLFTPEEWLFLDSAQKSLYRDVMLENYRNLASVGDQLCKTRMSSHMEQREELCVTERGVFPGAHLGPHLQ

SEQ ID NO: 16830 - protein, 81 aa, Canis lupus
NFWILRLPPGSKGEVPKEWGKLDEWQKELYKHVMRGNYETLVSLDYAISKPEVLSQTEQGKEPCSWRRPGPKVPDVPVDPS

SEQ ID NO: 16831 - protein, 81 aa, Gorilla gorilla
VPLTFSDVAIDFSQEEWEYLNSDQRDLYRDVMLENYTNLTDFTTESDKLSSEKRNYEVNAYHQETWKINKTFNLMRFIFRT

SEQ ID NO: 16832 - protein, 81 aa, Gorilla gorilla
MLENYRNLLSLGLPFTKPQVISLLQQGEDPWEVEKEGSGVSSLGSKSSHKTTKSTQTQDSSFQGLILKRSNRNVPWDLKLE

SEQ ID NO: 16833 - protein, 81 aa, Phyllostomus discolor
VSFEDVAVYFSRTEWSLLDAAERRLYLHVMLENFGLISSLGCCCGVADVEAPTDQNLSVRVAQAKDPKAALSSKKSHPCDS

SEQ ID NO: 16834 - protein, 81 aa, Desmodus rotundus
AEANVTLEDVAVHFSGEEWRLLGEAQRRLYLRVMLENFSLISSLGCCCGPEDVEVSQARNAKAASSPQKSHPCEACGTVLR

SEQ ID NO: 16835 - protein, 81 aa, Macaca fascicularis
QGSVTFRDVAIDFSQEEWECLQPDQRTLYRDVMLENYSHLISLGSSISKPDVITLLEQEKEPWIVVRKETSRWYPDLESKY

SEQ ID NO: 16836 - protein, 81 aa, Canis lupus
GFASVSFKDVTVDFTQEEWQHLDPAQKTLYMDVMLENYCHLISVGCHMTKPDVILKLERGEEPWTSFTGHTCLEENWKEED

SEQ ID NO: 16837 - protein, 81 aa, Muntiacus muntjak
SQGLVTIKDVSLCFSQEEWRSLDPSQTDFYGEYVMQENCGIVVSLRFPIPKLDMLSQLEGGEEQWVPEPPDLEERDILKVT

SEQ ID NO: 16838 - protein, 81 aa, Muntiacus muntjak
SQESVTFKDVIVDFTQEEWKQLDSVQRGLFRDVTLENYTHLVSIGLQVSKPDVISQLEQGTEPWIVEPSIPVGTPGDGVTR

SEQ ID NO: 16839 - protein, 81 aa, Canis lupus
RTGLLTFRDVAVEFSQEEWRCLNHTQRELYRDVMLENYGHHLFVGLIISKPDLVSFLEQRKEPWDLKTKNTVAIHPDDEGD

SEQ ID NO: 16840 - protein, 81 aa, Muntiacus muntjak
MISFEDVAITFTGEEWRHLDLAQRTLYQEVMLETCSLLVSLGHPVPKAELIHLLEYGPGLWMVKRGLSRNTCIGEKANPKT

SEQ ID NO: 16841 - protein, 81 aa, Muntiacus muntjak
MDSVTFADVAVYFTQEEWTLLNPFQRKLYRNVMLENYKNLTTAAFKPNLISWLENKTIRGSSTFGAQTRSHSGQELYDCEQ

SEQ ID NO: 16842 - protein, 81 aa, Muntiacus muntjak
QGSVTFEDVAMYFSWEEWCLLDEAQIQLYLDVMLENFALVCMLGTWRGVQDEETPSEQSESVEGVSQIRTPRAGLSPEKVQ

SEQ ID NO: 16843 - protein, 81 aa, Muntiacus muntjak
IDELVTFKDVAVDFTEEEWEHLDPSQRHLYREVMLENFGNLISLAGHLLSEPEMIFHFEQEDDVWMEETIPRSSYSGVRDE

SEQ ID NO: 16844 - protein, 81 aa, Muntiacus muntjak
MGWLMFQDVAIEFPQEEWECLDLGQRDLYRDVMLETYGNLASLGLVFSKPDLITFLEQMKNPWDVRRTDTTATYPVWKIFH

SEQ ID NO: 16845 - protein, 81 aa, Canis lupus
SQESVKLRDVAVIFSPDQWACLNPEERQLYKDVMLDNCDYLVSLGHWTYKAEVISTLKKGKDIWMMEKEVMSAPCPACQPA

SEQ ID NO: 16846 - protein, 81 aa, Gorilla gorilla
MVFEDVAIYFSQEEWGILNDAQRHLHSNVMLENFTLLSSVGCWHGAKDEEVPSKQCVSVRVLQVTTALSTLKAQPCKTCSS

SEQ ID NO: 16847 - protein, 81 aa, Gorilla gorilla
PQVSLTFEDVAVLFTRDEWRKLAPSQRNLYRDVMLENYRNLLSLGLPFTKPQVISLLQQGEDPWEVEKEGSGVSSLGSKSS

SEQ ID NO: 16848 - protein, 81 aa, Gorilla gorilla
RRESVTFEDVAVYFSENEWIGLGPAQRALYRDVMLENYGAVASLAFPFPKPALISQLERGETPWCSVPRGALDGEAPRGIS

SEQ ID NO: 16849 - protein, 81 aa, Gorilla gorilla
NIVTVTFDDVALYFSEQEWEILEKWQKQMYKQEMKTNYETLDSLGYAFSKPDLITWMEEGRMLLISEQGCLDKTRRTTSPP

SEQ ID NO: 16850 - protein, 81 aa, Gorilla gorilla
MEFTWDEWQLLDSTQKYLYRDVILENYHNLISVGYHGTKPDLIFKLEQGEDPWIINAKISRQSCPDGWEEWYQNNQDELES

SEQ ID NO: 16851 - protein, 81 aa, Gorilla gorilla
MSNVTFSDVAIDFSHEEWACLDTAQRDLYKDVMVQNYENLVSVAGLSVTKPYVIMLLEDGKEPWMMEKKLSKAYPFPLSHS

SEQ ID NO: 16852 - protein, 81 aa, Gorilla gorilla
IMEEAVTFKDVAVVFTEGELGLLDPAQRKLYRDVMLENFRNLLSVGHQPFHQDTCHFLREEKFWMMGTATQREGNSGGKIQ

SEQ ID NO: 16853 - protein, 81 aa, Ailuropoda melanoleuca
TVTFKDVAVVFTEEELALLDKAQINLYQDVMLENFRNLVSVGDRIKNNISHLQGKGLSYLSQEVLYCWQIWKQRISELTVS

SEQ ID NO: 16854 - protein, 81 aa, Ailuropoda melanoleuca
FRDVSVNFSQEEWECLDSGQMNLYKEVMLENFSNLVSVGLSNSKPAVISLLEEGKEPWMVERELTRGLCSDLESMCETKIL

SEQ ID NO: 16855 - protein, 81 aa, Phyllostomus discolor
GSLGSVAFRDVIVDFTQEEWQQLKPEQKDLYRDVMMEIYWNLISLDLETERNMNEVDPEEESWEDRPSIAMVVEELMKNGA

SEQ ID NO: 16856 - protein, 81 aa, Phyllostomus discolor
SQGSVTFRDVAIDFSQEEWEWLQPAQRDLYRRVMLENYGHLVALGLNMSKPDVVSLLEQGKEPWLGKDVRTDFFSVSGSNG

SEQ ID NO: 16857 - protein, 81 aa, Myotis lucifugus
MNFEDVAIAFSPGEWGILDEAQRLLYYKVMLEVFVLGSSVDSWCGLDDEVVCSNQSVAIEGESQVRASKTAPATEKNHPFK

SEQ ID NO: 16858 - protein, 81 aa, Canis lupus
MDTVAFEDVTVNFTLEEWALLNPSQKKLYRDVMQETFRNLASIGEKWEDCNSKSLYKHHQTNLRHVIERPCKNKEGSKCGE

SEQ ID NO: 16859 - protein, 81 aa, Canis lupus
EGIQSISFEDVAVDFTLEEWQLLNPTQKNLYRDVMLENYSNLVFLGYHIIRPDAIFKREQEEPWMVQKEVLSQSFAEEVWL

SEQ ID NO: 16860 - protein, 81 aa, Muntiacus muntjak
SHTLVTFKDILVNFTREEWKLLDTAQQIMYRDVMLENYRNLVSLGHQLPKPDVILRLEKGEEPWLVEREIHQETHPDLETP

SEQ ID NO: 16861 - protein, 81 aa, Muntiacus muntjak
DTVTFKDVAIDFTQEEWQQLDPAQRNLYRNVMLENYNNLITVGCPFTKPDVIFKLEQEEEPWVMEEKVLKKHCPGEIWGMD

SEQ ID NO: 16862 - protein, 81 aa, Muntiacus muntjak
QLTSEDVAIKFTQEEWEFLDPAQRALYRDVMLETYRNLLSVDISPTHVIKHLQPKANSDKRELFQTLMLGRSESCEIKHFY

SEQ ID NO: 16863 - protein, 81 aa, Canis lupus
YQEFVTFEDVAVHLTREEWGCLDPVQRDLYREVMLENYGNVVSLGFPFSKPDGISQLEQDLQVFDLETKNREVLRDDCSDG

SEQ ID NO: 16864 - protein, 81 aa, Ailuropoda melanoleuca
LVTFEDVAVDFTPEEWQYLNPPQKTLYREVMLETYSNVVSVGPQATKPDLVLKLEVEEPRPAETKISCWSFPEAACQIDEQ

SEQ ID NO: 16865 - protein, 81 aa, Muntiacus muntjak
QGGVTFPDVAVCFSQREWRLLDETQRRLYLDVMLENYTLVSSLGCCCGAEGEETPCGKTVPVGVSWTGSPTAAPFSQKTHP

SEQ ID NO: 16866 - protein, 81 aa, Macaca fascicularis
RDSVAFEDVDVNFTQDEWALLDPSQKNLYRDVMQETFRNLASVGKKWKDQKIEDEYKNSRRNLRGLMGERLLESKKDHQHG

SEQ ID NO: 16867 - protein, 81 aa, Macaca fascicularis
MELLTFRDMAIEFSPEEWKCLDPSQQNLYRDVMLENRNLVSLGVTISNPDLVTCLEQRKELYNFKIHEAAARPSVYRESRC

SEQ ID NO: 16868 - protein, 81 aa, Macaca fascicularis
GPLQFRDVAIEFSLEEWHCLDIAQRNLYRDVMLENYRNLVFLGIVVSKPDLITCLEQGKKPLTMKRHEMIAKPPVICSHFA

SEQ ID NO: 16869 - protein, 81 aa, Macaca fascicularis
LYEAVTFKDVAVVFTEEELELLDPAQRKLYRDVMLENFRNLLSVGKIQTEMETVPEAGTHEEFSCKQIREQIASDLTRSQD

SEQ ID NO: 16870 - protein, 81 aa, Macaca fascicularis
FEGSVSFEDVAVDFTRQEWHRLDPAQRTMHKDVMLETYSNLASVGLCVAKPEMIFKLERGEELWILEEESSGHRYSGSLSL

SEQ ID NO: 16871 - protein, 81 aa, Macaca fascicularis
SQHLVTFEDVAVDFTQEEWTLLDQTQRDLYRDVMLENYKNLIILAGSEFCKPSLMSGLEQMEELRTGVTGVLQELDLQLKT

SEQ ID NO: 16872 - protein, 81 aa, Phascolarctos cinereus
FQESVTFKDVAVDFTWEEWGYLDTSQKELYWEVMLENYRNLVSLGLADSNVNMISQLESGEAHGISVDSVLRSCWPDGDTR

SEQ ID NO: 16873 - protein, 81 aa, Phascolarctos cinereus
MLETYWNLVSLGLSIPKPTAISHLEPEEPRTAEGETPSGPHPDWNTRPETRESAPRWDISEGGTSHGMMMTRFAQDGPWNP

SEQ ID NO: 16874 - protein, 81 aa, Phascolarctos cinereus
TRESVTFKDVAVAFTLEEWRQLGPSQKDLYRDVMLENYRNLVGLGLAISKPYVICQLEQGEAPWMPEGDIPQRHCADWEVI

SEQ ID NO: 16875 - protein, 81 aa, Phascolarctos cinereus
SQGLATFKDVTLSFSQEQWGDLDPTQKEFYGEYVLQEDCGIVVSLTFPIPRLDEVSQVEEEEESWVPDLEYPQDPEDAEIL

SEQ ID NO: 16876 - protein, 81 aa, Phascolarctos cinereus
KKPSVTFRDVAVDFTRAEWERLDSTQRDLYRDVMLENYKNLISLGFPISKPKVISKLERGGAQWMLGRKVPRRPFPGRLCQ

SEQ ID NO: 16877 - protein, 81 aa, Phascolarctos cinereus
QESVMFEDVAMYLTPEEWGQADPTQRALCRDRMLESCRNDVVLDDGSETENMESLSNLEVSEDVESEEKLSSEFPIALPQG

SEQ ID NO: 16878 - protein, 81 aa, Phascolarctos cinereus
PQESVTFKDVAVDFTWEEWGYLDTSQKELYWEVMLENYRNLVCLSLADSNKDVISQLELGEAYGIPTGSVLRVVWPDWDTR

SEQ ID NO: 16879 - protein, 81 aa, Gorilla gorilla
GRPLEMAVSEPEASAAKEWKQLDPAQSNLDNDVMLENYSNQASMGCQAPKPDMISKLEKGEAPWLGKGKRPSQGCPSKIAR

SEQ ID NO: 16880 - protein, 81 aa, Ailuropoda melanoleuca
QKPVTFDDVAVNFTQEEWVCLDAGQKVLYQDVMSETFRNLMSVVRIFLSNPDLIIKLEQEEKQWRAELQLRPPNGEGLPSG

SEQ ID NO: 16881 - protein, 81 aa, Gorilla gorilla
FQKPVTFEDVAVNFSQEEWDCLDASQRVLYQDVMSETFKNLTSVARIFLHKPELITKLEQEEEQWRETRVLQASQAGPPFF

SEQ ID NO: 16882 - protein, 81 aa, Ailuropoda melanoleuca
QDNVTLEDVAVYFSWEEWGLLDEAQRRLYHDVMLENLALITSLGKALTPTTVPWVQSISVEVSHSISKAGSSTQMAHPCDI

SEQ ID NO: 16883 - protein, 81 aa, Ailuropoda melanoleuca
MVFEDVIVDFTQEEWALLNPAQRRLYKDVMLETFRNLVSVDDDTQLKTNGSISQQDIFGKKLSNEQKIARFIKNDFWTSLF

SEQ ID NO: 16884 - protein, 81 aa, Lynx canadensis
GPWTLLTFRDVAIEFSQEEWGCLNHSQRELYRDVMLETYGHLLFLGLVSKPDLVILLEQKKELWGVKRKETVASHPGRWEI

SEQ ID NO: 16885 - protein, 81 aa, Lynx canadensis
PLDSVTFTDVAIDFSQEEWEWLNLAQRTLYKKVMLENYRNLVSLGLCISKPDVISLLEQGEDPWMMKGERTGGLCPDTLKM

SEQ ID NO: 16886 - protein, 81 aa, Lynx canadensis
NHQGFKFKDVAIYFSQKEWECLHPSQKGLYRDVMLENYNNLISLGLSDSKPNVISLLEQGKEPWLVKSKETKEWCPELSCL

SEQ ID NO: 16887 - protein, 81 aa, Lynx canadensis
FQEPVMFKDVAVVFSEEELGLLGPTQRKLYRDVMLENFRNLVSVGHSSSKPDVISQLEREEKLCMKEIHTQRGGRNQNEKE

SEQ ID NO: 16888 - protein, 81 aa, Lynx canadensis
THGSMPFSSVTVAFTQNGWRHLIPAPKDRFKEGIPENTRNLVLLGLPVSQPGMNSQLEQREEGPWMLEGGGLRSTCTDWKI

SEQ ID NO: 16889 - protein, 81 aa, Lynx canadensis
ESLSFEDVAVYFTREEWDKLDWAQKDLYRDVMLENYRNMILLGSEARWKMKKPTPGQKIFKDLESCKTSAVKQQTAKGSSE

SEQ ID NO: 16890 - protein, 81 aa, Phyllostomus discolor
MDSVILEDVAVIFTLEEWALLNPSQKKLYRDVMRETFRNLASVGKVWEDHDIEDQYKNQKRKRRRHMSERICEGKNVGQCG

SEQ ID NO: 16891 - protein, 81 aa, Macaca fascicularis
MCGPLQFRDVAIEFSLEEWHCLDTAQRNLYRDVMLENYRNLVFLGIIVSKPDLITRLEQGKKPLTMKRHEMVGKPPVLCSH

SEQ ID NO: 16892 - protein, 81 aa, Macaca fascicularis
MDQESVTFKDVAVLFTQEEWGQLSPAQRALYRDVMLENYSNLVSLGLLGPKPDMFSQLEKREVWMPEDTPGGFCPDWMTLP

SEQ ID NO: 16893 - protein, 81 aa, Macaca fascicularis
FQGSVTFEDVAIAFSQQEWESLDSSQRGLYRDVMLENYRNLVSMGHSLSKPHVIALLERWKEPKVTDRKDGRRWCTDLQLE

SEQ ID NO: 16894 - protein, 81 aa, Macaca fascicularis
QETLTFRDVAVEFSLEEWECLNPAQQNLYRNVMLENYKNLVFLAGIDISKQDPITSLEQEKEPWNMKRHEMVDESPGERYK

SEQ ID NO: 16895 - protein, 81 aa, Phascolarctos cinereus
QNPVTFRDVAVDFSLEEWKCLSPAQRALYRDVMLENYENLASVGPRLPFSKPYVISQLERGEAPWMPEEEVPRDHWPDLFN

SEQ ID NO: 16896 - protein, 81 aa, Phascolarctos cinereus
MLENYENFVFLVGMPVFKPSVISKPERRETSWMREEEAAFSFEDSLIQKTRSETKKSTPKQDICRERSSKERLKKDGPWDS

SEQ ID NO: 16897 - protein, 81 aa, Phascolarctos cinereus
GKESVTFKDVAVEFTQEEWVQLNPSQKKLYRDVMLENYKNLVFLGFAVSKPDVIYQLEKKETSWMPEPDIPKSNCPALPSV

SEQ ID NO: 16898 - protein, 81 aa, Phascolarctos cinereus
SQIPLTFQDVAVDFTWEEWGLLEPSQKDMYWDVMLENYENFVSLGGLPICLPDVISRMERIEAPWMAEGGVLVSTFLGSLS

SEQ ID NO: 16899 - protein, 81 aa, Phascolarctos cinereus
GVFLTFEDVAITFSQEEWEMLAAWQQQLYWDVMKENYETLSSLSAGRLGALPELFTTLGQVFETWEDQQNLLRRDNLESSY

SEQ ID NO: 16900 - protein, 81 aa, Phascolarctos cinereus
SLESVTFQDVAVDFTQEEWGRLEPAQKDLYREVMLENYQNFVSLGGLPAPKPHVISQLERGEAPWITEREALGGICQDSVI

SEQ ID NO: 16901 - protein, 81 aa, Myotis lucifugus
LQESVTFKDVAVLFTQDEWAQLSPAQRALYRDVMLENYSHLVSLGLLGPKPDLFAQLGKGEEWTPEDTSRGFCLDWMTIPV

SEQ ID NO: 16902 - protein, 81 aa, Myotis lucifugus
VKESVTFKDVAIDFTLEEWRLMDPTQRGLHRDVMLENYRNLVSLGLTVSKPDMISRLEDKKGPWVVMREISRAPYPELETK

SEQ ID NO: 16903 - protein, 81 aa, Myotis lucifugus
ELPVVFEEVAVYFTREEWGVLDQRQKELYRDVMRMNYELLASLAIGPVATKPDLISKLEHRAAPWIKDPKGTKSGKGRSPG

SEQ ID NO: 16904 - protein, 81 aa, Myotis lucifugus
CEVSLSFEDVTVDFSRDEWQHLDPAQRCLYWDVTLENYSHLLSVGYQVPKPEVIFKLEQGEGPWTLKGEIPYQSCSDKNIG

SEQ ID NO: 16905 - protein, 81 aa, Myotis lucifugus
ESQDMKFEDVAIAFSQEEWGLLDEAQRHLYCDVMLEVFTLVSFIGHWHKMDDVEAYSEHSVSVGESQVRASKTAVATQRTH

SEQ ID NO: 16906 - protein, 81 aa, Puma concolor
AHETVTFKDVAVDLTQEEWQQLKPAQRNLYRDVMLENYSNLVTVGYQVTKPDVIFKLEQEEEPWVIEEEMLGRHCPEVWEV

SEQ ID NO: 16907 - protein, 81 aa, Puma concolor
SQESVTFQDVAVDFTEKEWPLLDSSQRKLYKDVMLENYSNLASVGYQVGKPSLISHLEQEEELRTEERGRHRATSPDWETP

SEQ ID NO: 16908 - protein, 81 aa, Puma concolor
LLSFSDVAVDFTCEEWELLDPVQKNLYRDVMLENYSNLMSLAQYSEHNFCVKTFSMVKNLKRHHRIHTEGKPYECSECPKS

SEQ ID NO: 16909 - protein, 81 aa, Puma concolor
VLGPVKFEDVAVIFTEAEWKKLALEQRNLYKEVMLENFRNLVGLKSNPEVHPWPSCPLAFDEQQFLSQHELRSRPIPDLHS

SEQ ID NO: 16910 - protein, 81 aa, Puma concolor
GQCDFGGRGRVFSWEEWGLLDEVQRRLYHNVMLENLALITSLDYFCGIDNEEAPSGQNVSLGRTPPSRTSGPNLSTQKLHL

SEQ ID NO: 16911 - protein, 81 aa, Puma concolor
EELPVVFEDVAVYFTREEWGMLVKRQKELYRDVMRMNYELLASLGPAAAKPDLILKLERRAAPWIKDPNGPKWGKGRPPGK

SEQ ID NO: 16912 - protein, 81 aa, Puma concolor
ASREVEEDGSILLLVSTDVWSGMAEADKQQQFLAAPVTFKDVVVTFTQEEWELLDLSQRTLYWRVMRETCGLLLSLVISPD

SEQ ID NO: 16913 - protein, 81 aa, Puma concolor
AQESLTLEDVAVDFTWEEWQLLAPAQKDLYWNVMLENYRNLVSLGYQACQPDSLSELEQEEPPWIVKDEVQSQTHPEIERV

SEQ ID NO: 16914 - protein, 81 aa, Canis lupus
VNFEDVAVYFSPEEWGLLDEAQRLLYRDVMLENLALMASLGCWHGTEGEEIAFKQNISVGMSQIKTPKTGPATQKAHPCET

SEQ ID NO: 16915 - protein, 81 aa, Canis lupus
SVAFQDLAVRFSEEEWQLLGEGQRALYRDVMRENYETLRSLGTAERLPLSAFLSPTEPGGTMEGRSYAGEGQEPPRGGGPL

SEQ ID NO: 16916 - protein, 81 aa, Canis lupus
SQESVTFADVAVDFTQEEWTLLDRSQRQLFRDVMLENISHLVSIGKQLYKSDTISHLEPGVQLSKEGISLLQCQSLDKEDG

SEQ ID NO: 16917 - protein, 81 aa, Canis lupus
HQEPVTFEDVAVYFTQNEWVILDPSQRALYREVMLENYANVASLAFLFTRPVLVSQLERGELPWGLEPWEPVGREALRGIC

SEQ ID NO: 16918 - protein, 81 aa, Muntiacus muntjak
SFKDMAVTFTKEALGLLDLAQRKLYHEVMLENFWNLVSMGYQPFTLDILQLGREEQLWVMEPETRGDECSGHRNQNEIETL

SEQ ID NO: 16919 - protein, 81 aa, Muntiacus muntjak
VTFEDVFVYFSREEWELLEEPQRLLYRSVMLENFAHVAALGNSEEAPSEQSAFAELVSEFRALGSCAPILKSHPCETDDLL

SEQ ID NO: 16920 - protein, 81 aa, Muntiacus muntjak
WGSLVAFEEVAMHFSREEWELLDEAQRQLYHTVMLETLELVTSLGSWPVVEGEELPSEKNASGEVVAQVRTPSVPPSMQKA

SEQ ID NO: 16921 - protein, 81 aa, Canis lupus
MKPGVISHAPDSVAPAAFPFPKPDLIFQLERGEAPWGLDPWIPIEGEALGGVHPGGKNKTENEEQTPRLNISEDSVVHRLM

SEQ ID NO: 16922 - protein, 81 aa, Muntiacus muntjak
SVSFKDVTVDFTQEEWQQLDPAQKALYRDVMLENYCHLISVEEDWKAEDVLVKCKEYQDRHSRSVISVNHKRLIKERSNIW

SEQ ID NO: 16923 - protein, 81 aa, Ailuropoda melanoleuca
EELPVVFEDVAVYFTREEWGMLVKRQKELYRDVMRMNYELLAALGPAAAKPDLISKLERRAAPWIKDPNRPKWGKGRPLGK

SEQ ID NO: 16924 - protein, 81 aa, Gorilla gorilla
AQESLTLKDVAVDFTWEEWQLLGPAQKHLYRDVMLENYSNLVSVGYQAGKPDALTKLEQGEPLWTLEDEIHSPAHPEIEKA

SEQ ID NO: 16925 - protein, 81 aa, Ailuropoda melanoleuca
LVTFEDVAVEFTQEEWALLDPSQRTLYRDVMRENCRNLASLGYHVDKPNLISQLEQEDKVTTEEQGILPGTCPDLETVLKA

SEQ ID NO: 16926 - protein, 81 aa, Ailuropoda melanoleuca
QLVMFRDVVVDLSQEEWECLDLEQRHLYRDVMLENYSNMISLGLCIYQPDVFSLLEKGKEPWMVLQDETRGPCPGEGLSWH

SEQ ID NO: 16927 - protein, 81 aa, Ailuropoda melanoleuca
MTFEDVAVEFTQWEWGQLDPAQQDLYREVMLENFKNLASLGLPVSKPYVITQLEEGKDPCVLDGEISTEYLSPPPDWEKRP

SEQ ID NO: 16928 - protein, 81 aa, Ailuropoda melanoleuca
QGSVTFEDVVVYFSWEEWGLLDETQRCLYHDVMLENFALVISLGCWYGMEDEEAVSVQQMSLGRTPSPESPLWKVQPCEKC

SEQ ID NO: 16929 - protein, 81 aa, Gorilla gorilla
VAFEDVAIYFSQEEWELLDEMQRLLYRDVMLENFAVMASLGCWCGAVDEGAPSAESVSVEELSQGRTPKADTSTDKSHPCE

SEQ ID NO: 16930 - protein, 81 aa, Gorilla gorilla
TQESLTLEDVAVEFSWEEWQLLDTAQKNLYRDVMVENYNHLVSLGYQTSKPDVLSKLEHGQEPWITDAKIQNKNCPGIGKV

SEQ ID NO: 16931 - protein, 81 aa, Ailuropoda melanoleuca
LLTFRDVAIEFSQEEWRCLSHTQRELYRDVMLENYGHLLFLGFILSKPDLIMFLEQEEQFWDVNRTGTSSHDTQCFLPKLS

SEQ ID NO: 16932 - protein, 81 aa, Gorilla gorilla
MNLYKEVMLENFSNLVSVGLSNSKPAVISLLEQGKEPWMVDRELTRGLCSDLESMCETKILSLKKRHFSQVILTREDMSTF

SEQ ID NO: 16933 - protein, 81 aa, Phyllostomus discolor
MFQVTFSDVAIDFSYEEWEWLDSAQRSLYKDVMVQNYENLVSLAGLFIPKPYVITLLEDGKEPCMVQKNLTKDMFSDWKLR

SEQ ID NO: 16934 - protein, 81 aa, Phyllostomus discolor
SVTFRDVAIDFSQEEWEWLQPAQRDLYRRVMLENYGHLVALVSGSNGVIREFSPNNVIYENDSSQHLIKERILNYSPEHSC

SEQ ID NO: 16935 - protein, 81 aa, Phyllostomus discolor
AEASVTFEDVAVHFSWEEWRLLDEAQRRLYLRVMLENFSLISSLGCCCGAEDVEVSQTRNAKAASSPQKSHPCEGCGTVLR

SEQ ID NO: 16936 - protein, 81 aa, Phyllostomus discolor
SVTLEDVVVYFSWEEWGLLDEAQRRLYYDVMLENLALISSLGCLCGLEIEKAPSGQIVSLERLPQVRTPKLDLSIQTAPVS

SEQ ID NO: 16937 - protein, 81 aa, Desmodus rotundus
AEVGVAFADIALYFSREEWRLLDEAQRRLYLDVMLQNFELVSSLGCCCGAEDVEELIEQNISVRVVKAEIPKVALCSRKSH

SEQ ID NO: 16938 - protein, 81 aa, Desmodus rotundus
PVTFEDMAMYLTREEWRPLDPTQRDLYRDVMQENYGNVVSLDFEIRSENEVNPKQEISEDVEFGTAPERPVGNAEENPESE

SEQ ID NO: 16939 - protein, 81 aa, Macaca fascicularis
MLDNYRNLVFLGIAVSKPDLIICLEQGKEPCNMKRHAMVAKPPVVCSHFAQDLWPKQGLKDSFQKVILRRYGKYGHENLQL

SEQ ID NO: 16940 - protein, 81 aa, Gorilla gorilla
AQELLTLEDVTVEFTWEEWQLLGPFQKNLYRDVMLEIYSNLLSMGYQVSKPDALSKLERGEEPWTMEDERHSRICPENNKV

SEQ ID NO: 16941 - protein, 81 aa, Ailuropoda melanoleuca
GWVPALFDEVAIYFSDEEWEVLTEQQKALYREVMRMNYETVLSLEFPFPKPDVISRLEGDEESQNSDEWQLQGGTFAEQEE

SEQ ID NO: 16942 - protein, 81 aa, Ailuropoda melanoleuca
PDLVTFEDVAVEFTQEEWALLDPSQRTLYRDVMRENCRNLASLGIGYHVDKPNLISQLEQEDKVTTEEQGILPGTCPDLET

SEQ ID NO: 16943 - protein, 81 aa, Ailuropoda melanoleuca
QGLLTFGDVAIEFSQEEWRCLSHTQRELYRDVMLENYRHLVFLGLIVSKPDLVSFLEQEKQLWGVKRKETVAFHPAISSPD

SEQ ID NO: 16944 - protein, 81 aa, Ailuropoda melanoleuca
WQGQVNFEDVAVYFSQEEWGLLDEAQRLLYRDVMLENLALMASLGCFHGMEDEEIAFEQNIPVGVSQVRTPKTGPSTQKAR

SEQ ID NO: 16945 - protein, 81 aa, Phyllostomus discolor
IGSDLFRDVAVVFSREEWEQLTPAQRDLYRDVMLEIYSILLSLGPDLAVSKPDVISFLEQGKEPWRVEEAVTGGLCPVLES

SEQ ID NO: 16946 - protein, 81 aa, Phyllostomus discolor
VAVGVTFADIALYFSGEEWCLLSDKQRCLYLGVMVENFELVSSLGCCCGAEDVETPIEQTVPVAVSQAKNLKVALSSVKSL

SEQ ID NO: 16947 - protein, 81 aa, Phyllostomus discolor
AVMFKDVAVIFTEEELGLLDPSQRKLYQDVTLENLRNLISVGHWNQNEIEIVHEVALRYLFHVDLVCWQIWDQLLSKLTRN

SEQ ID NO: 16948 - protein, 81 aa, Macaca fascicularis
LQGLVMFEDVAVYFSREEWGLLNVTQKGLYRDVMLENFALVSSLGLAPSRSPVFPQLEKDEQLWVRSWVDVTPVSRAEARR

SEQ ID NO: 16949 - protein, 81 aa, Desmodus rotundus
LMEAVTFGDVAVHFSREEWQCLDPGQRALYKEVMLENHSSVAGLAGFLLFKPELISRLEQGEEPWVLDLQGTERGELPRTP

SEQ ID NO: 16950 - protein, 81 aa, Macaca fascicularis
FQDSVAFEDVAVSFTQDEWALLDPSQKNLYRDVMQETFKNLTSVGKTWKIQNMEDKYKNPRRNLSLMREKLFESKESHHCG

SEQ ID NO: 16951 - protein, 81 aa, Macaca fascicularis
VQESVTFRDVAVFFSQDEWLHLDSAQRALYREVMLENYSSLVSLGIPFSMPKLIHQLQQGEDPCLEEREVPSDTCLGFKTW

SEQ ID NO: 16952 - protein, 81 aa, Macaca fascicularis
MLENYGNVASLGFPLLKPAVISQLEGGGELGGPSPLAAGTGLWGLRTGKEVDIQTDNDLTKEMYEGKENVSFELQRDFSQE

SEQ ID NO: 16953 - protein, 81 aa, Phascolarctos cinereus
IKVSMVFEDVAVYLTQEEWGHLGPAQRDLYRDVMLENYSNLIFLGFPASNPDMISQLEQGDEPWVLDTQAAEGKDILSNDC

SEQ ID NO: 16954 - protein, 81 aa, Phascolarctos cinereus
ARGPVSFADVAVYFSPEEWGRLRPAQRALYRDVMRETYGHLGALGFPGPKPALMCWMDEETEVWGPDARDPEEAGEKGTEN

SEQ ID NO: 16955 - protein, 81 aa, Phascolarctos cinereus
QDLVTFKDVSVDFTREEWMRLDHPQRALYRDVMLENYRNLVLVSLGHPISKPDVISRLEQGGVPWVLKKGATGRAFSDRET

SEQ ID NO: 16956 - protein, 81 aa, Phascolarctos cinereus
FQESVTFKDVAVEFTQEEWRQLDPAQRSLFKDVMLENYRNLVSLGLAVNKPGIISHLERGRAPWIPERAVSGGTFPECLNL

SEQ ID NO: 16957 - protein, 81 aa, Phascolarctos cinereus
SQEAVTFRDVALDFTWEEWGCLSAAQRELYRDVMLENYRNLVSLGLLGPKPDLISWLEQGEETEIWDPLGCLARCTCLCEG

SEQ ID NO: 16958 - protein, 81 aa, Phascolarctos cinereus
GKESMTFKDVAVEFTWEEWRQLDHAQRDLYRNVMMENYENLISMGIFVSKPDVISLLERGEASWISEGEVSRSTYSDSLNL

SEQ ID NO: 16959 - protein, 81 aa, Phascolarctos cinereus
KALVTFVDVAVNLTQEEWHLLGPDQRSLYRDVMLENYGNIVSLDCETQTESEDLSPKQEISDELKCQSLILHRLRGLLPQA

SEQ ID NO: 16960 - protein, 81 aa, Phascolarctos cinereus
SQESLSFKDVAVDFTQEEWGRLDPDQRYLYKDVMLENYRNLVSVGHQVYKPNLISQLEQGEEPWIIDREIPRGAFPDWEIR

SEQ ID NO: 16961 - protein, 81 aa, Phascolarctos cinereus
SQKLLTFQDVAVDFTREEWGLLEPAQKDLFRDVMLESYENFVSLGLPDSKEDVISALEKTEEPGPPEGEVIPGNTYTDFLH

SEQ ID NO: 16962 - protein, 81 aa, Phascolarctos cinereus
LQESVTFNDVAVDFTAEEWGHLRPLQKELYRDVMLENYQNLVCLGLAISKPDVICQLERGETPRLPEGDIPQSGYAVRSHT

SEQ ID NO: 16963 - protein, 81 aa, Phascolarctos cinereus
PQESVTFKDVAVDFTWEEWGYLDTSQKELYWEVMLENYRNLVSLGLADSNVDMISQLESGEAQGIPVDSVLTSCWPDGDRR

SEQ ID NO: 16964 - protein, 81 aa, Phascolarctos cinereus
QESVTFTDVAVDFTLEEWAYLDHFQKELYKDVMLENYRNLLCLDWETRPETKESTVKLVISTEESFQGRLRRDDPSVSRLG

SEQ ID NO: 16965 - protein, 81 aa, Phascolarctos cinereus
LFQAVTFQDVAVYFTRKEWKHLDSFQRHLYRDVMLENYGNLLSLGFPVSKPDLISQLEQREELWVLDLQGTEKKETLRGSC

SEQ ID NO: 16966 - protein, 81 aa, Myotis lucifugus
QGLVTFEDVAVYFSREEWTLLTPTQRSLYREVMLENFALTVSLGKALRLRPQTGRLWLERETSMMRENPAGSQVQRLRDSL

SEQ ID NO: 16967 - protein, 81 aa, Myotis lucifugus
QESVTFKDVAVDFTQEEWHHMAPAQRRLYRDVMLENYSNLVSLGYQVSKPEVIFKLEQGEEPWLSEGEIQRSVCPDWKTRP

SEQ ID NO: 16968 - protein, 81 aa, Canis lupus
MLENYSHLLSVGYEVPKPEVIFKLEQGEEPWILERKTPHQSCSDGRFGIKTPQKRISGKASFHNEMDGEDTRDDSLYSILE

SEQ ID NO: 16969 - protein, 81 aa, Muntiacus muntjak
LPGLVSFKDVAVDFTQEEWQQLDPAQKTLYRDVMLENYSHLVSMGHPVSKPDVISKLEQGEDPWIIKRDIPNWICPYEVQT

SEQ ID NO: 16970 - protein, 81 aa, Muntiacus muntjak
KPLAVRFADVAVYFSPEEWGCLLPAQRALYRDVMRETYGHLGALGFPGPKPALISWMEQESEAWSPAAQDPEEGESLGGAL

SEQ ID NO: 16971 - protein, 81 aa, Canis lupus
ASVTFQDVAVDFTPEEWQLLECTQRKLYWDVMLENFIYLFNKFIFYWCSIFTKTKVIFKAEQGQEPWMAEGEKPHALSLCQ

SEQ ID NO: 16972 - protein, 81 aa, Gorilla gorilla
TFKEAVTFKDVAVVFTEEELGLLDPAQRKLYRDVMLENFRNLLSVGNQPFHQDTFHFLRKEKFWMMKTTSQREGNSGGKIQ

SEQ ID NO: 16973 - protein, 81 aa, Ailuropoda melanoleuca
ELVSFEDVAVNFSWEEWQHLDDAQRALYRVVMLETYSSLVSLAVIAQESTHIGEDHCRCNEWGNTFCAKPTQSNLHRADFE

SEQ ID NO: 16974 - protein, 81 aa, Ailuropoda melanoleuca
FQDPLTFKEVAVYFTNQEWQWLGPHQRQFSWAVTLENYGNMASLGEDYRQPSLPEVLRLKVENLLCVSDLTGDGCEDGEPS

SEQ ID NO: 16975 - protein, 81 aa, Ailuropoda melanoleuca
PGLLTFRDVAIEFSQKEWGCLNLVQRELYRDVMLENYGNLLFLETGLVVSKPDLVIFLEQKRELWDVKGKETVAIHPALVI

SEQ ID NO: 16976 - protein, 81 aa, Gorilla gorilla
DSVAFEDVAINFTCEEWALLGPSQKSLYRDVMQETIRNLDCIGMIWQNQDIEEDEYKDLRRNLRCHMVERSCEIKDDSQCG

SEQ ID NO: 16977 - protein, 81 aa, Ailuropoda melanoleuca
HGSPPFSNVTVAFTQDGWKHLIPAPRGTPKFMEGIPENARNLVLLGLPVSQPDMNSQLEQREEGPWMLEGGGLRSTCPDWK

SEQ ID NO: 16978 - protein, 81 aa, Lynx canadensis
ESCVTFEDVAVYFSQEEWGLLDEAQRFLYHDVMLETFALTTSLDCWCGAENEEVPSEQSVSVERVSQVRTSKTGSSIQKTH

SEQ ID NO: 16979 - protein, 81 aa, Lynx canadensis
SQELVTYEDVAVDFTQEEWQRLDPAQKILHRDVMLEIYSHLVSVGCSGISPGIIFKLEHEEDPWTMKSELSRWIHSDREKS

SEQ ID NO: 16980 - protein, 81 aa, Lynx canadensis
QPPVSFKDVAVTFTREEWGQLDPAQRTLYRNVTLETCSHLAFLDWKNTLEKEESASKEDTAVEEPFHNIEMKCCIQEEGPW

SEQ ID NO: 16981 - protein, 81 aa, Lynx canadensis
REESLTLEDVAVDFTWEEWQLLAPAQKDLYWNVMLENYRNLVSLGYQARQPDSLSELEQEEPPWIFKDEVQSQTHPEIERV

SEQ ID NO: 16982 - protein, 81 aa, Lynx canadensis
FQGLVSFEDVAVNFTWEEWQDLDDAQRTLYRVVMLETYSSLVSLGHCITKPEVIVKLEQGAEPWTVEEPLEQSLPGLSVHT

SEQ ID NO: 16983 - protein, 81 aa, Lynx canadensis
AQKSLTLEDVAVDFSREEWRLLAPAQKDLYRDVMLENYRNLVSVGHQASKPDVLAKLERGEEPWAIEEEVRSGTSPETGKV

SEQ ID NO: 16984 - protein, 81 aa, Lynx canadensis
MLQVTFSDVAIDFSHEEWGWLDSAQRDLYKDVMVQNYENLVSLGLSIPKPYVISLLEDGKEPWMVQKKLSKDWESRWENKE

SEQ ID NO: 16985 - protein, 81 aa, Lynx canadensis
HQELVTFEDVAIYFTGTEWTCLSPGQKALYRSVMLENYGNLTSLGYQVPRPALISLLEAGNLPWGLEAQDNLSAERTKDIC

SEQ ID NO: 16986 - protein, 81 aa, Lynx canadensis
MFQEQVTFEDVVVDFTQEEWGQLEPAQRTLYRDVMLETFRLLVSVGKPDVVSLPEQEEPWAVDGGVPRGVYLETRPQTKVS

SEQ ID NO: 16987 - protein, 81 aa, Phyllostomus discolor
FHEPVIFEDVTLGFDPEEWGLLDLEHKSLYREVILENYRNLVSVEHQLSKPDVVSQLEEEEELLSVERGIPQDTFSECPKT

SEQ ID NO: 16988 - protein, 81 aa, Phyllostomus discolor
SQGTVTFKDVAIDFTQEEWQQLDSSQRNLYWNVMLENYNNLITVGCPFIKPYVIFKLEQEEEPWVVEEEEVLRRHCPGEIW

SEQ ID NO: 16989 - protein, 81 aa, Phyllostomus discolor
GSVTFDDVAVYFSWEEWDLLDEAQRRLYQDVMLENLALITSLGCWYGAEDEAPEQSVSVETVSQVRIPKAGLSSQRAHPCD

SEQ ID NO: 16990 - protein, 81 aa, Phyllostomus discolor
VTFEDVVVDFTQEEWGQLEPAQRTLYCSVMLETFRLLVSVDLETRSKTKLPAAKQDISEKISNNVLVERFLWYGLPGYKPE

SEQ ID NO: 16991 - protein, 81 aa, Phyllostomus discolor
SVESLTFKDVSVDFSWDECKCLDPAQRKLYSDVMLENYSNLVSLGLDVSKPVLVTFLEEMRERCNVCMKKAISDPPGKPSL

SEQ ID NO: 16992 - protein, 81 aa, Phyllostomus discolor
AEVVVTFEDVAVYFSRTEWLLLDEAQRCLYLNVMLDNYALISSLGCCCGVENLEAPTEQNITVRVSKAMNLKSTLSSQESH

SEQ ID NO: 16993 - protein, 81 aa, Phyllostomus discolor
MNSVAFEDVAVSFSLEEWALLHPAQKKLYRDVMQETLRNLASIGTRWEEHNIEKYQNQGRKLRSQVIEKVCESKEGSQCGE

SEQ ID NO: 16994 - protein, 81 aa, Phyllostomus discolor
MLENYHSLVSLGILFSKPKVIFQLQQGEDPWMVGNGLSYGARLGWGSLFETTFSKEDYQEVMSKLIGDGTFNFKLEKIYIN

SEQ ID NO: 16995 - protein, 81 aa, Phyllostomus discolor
QVSVTFKDVAVDFTLEEWGQLGPGQRELYRDVMLENYQNLLSLGSGLLGSKPDVISRLERGEEPRMEKREAQQVTCPDLET

SEQ ID NO: 16996 - protein, 81 aa, Phyllostomus discolor
SPTLVTFKDIHVNFTREEWNLLDAAQQIMYKDVMLENYKNLVSVGHQLPKPDVILQLEKGEEPWLVERGVRQDTRPDWDTA

SEQ ID NO: 16997 - protein, 81 aa, Phyllostomus discolor
YKESVMFRDVAVDFSQEEWECLDPAQRDLYRDVMLENYSNLLSMGLYIPKPQVISLLEQGKEPWMVGRELTRGLCSDLESM

SEQ ID NO: 16998 - protein, 81 aa, Phyllostomus discolor
SQEAVSFEDVAVNFTREEWALLDASQRRLFTDVMLESISHLLSTGSWLHKSDVISQWKEGEQLSRDGTGALQGQSPVISDR

SEQ ID NO: 16999 - protein, 81 aa, Phyllostomus discolor
SEESVTFKDVAVDFTQEEWGQLDSPQRALYRDVMLENYQNLLALAGPPVCKPDVISHLERGEEPWQVPRKVPGGARPEWEP

SEQ ID NO: 17000 - protein, 81 aa, Myotis lucifugus
EDMNFEDVAIAFAQEEWEILDEAQRRLYCDVMLEVFSLVSFVGPWRKMDDVEAYSQHSVSLGDSQLRASRTATSTQRTHLC

SEQ ID NO: 17001 - protein, 81 aa, Canis lupus
GWVPALFDEVAIYFSDEEWEVLTEQQKALYREVMRMNYETVLSLEFPFPKPDMITRLEGDEESQNSDEWQLHGGTFAENEE

SEQ ID NO: 17002 - protein, 81 aa, Canis lupus
FQESVTFEDVAVIFTDEEWRHLVPIQRDLYKEVMLENYKSIVSLGLPVPCPEVIFQLKRGDEPWIVDLHGSEERECPENIS

SEQ ID NO: 17003 - protein, 81 aa, Canis lupus
TVTFKDVAVVFTEEELALLDKTQISLYQDVMLENFRNLVSVGDRIKNNISHLQGKGLSYLSQEVLYFWQIWKQRISELPVS

SEQ ID NO: 17004 - protein, 81 aa, Canis lupus
MYFSQEEWELLDPTQKALYNDVMRENYETVISLALFVLPKPKVISYLEQGEEPWVQGPLEFKDSLGELPTGLKLKTDTENH

SEQ ID NO: 17005 - protein, 81 aa, Canis lupus
SQELLTFKDIFVDFTQEEWGQLAPAHRNLYREVMLENYGNLVSVAGYQLSKPSVISQLEKGQEPWMTEKKGPGDPSPDLKN

SEQ ID NO: 17006 - protein, 81 aa, Muntiacus muntjak
SQDSVTFADVAVNFTQEEWTLLDCFQRKLYRDVMLENYKNLTTAGYQVFKPTLISWLEEEELSTVETGILQEWGMQLKAKD

SEQ ID NO: 17007 - protein, 81 aa, Muntiacus muntjak
MEMETLTFKDMFVDFTQEWQQLDTAQKNLHRDVMLENYSHLVSMGYLVTQPHGIFRLGQGEEAAGIAAGESPLWSCPVLQR

SEQ ID NO: 17008 - protein, 81 aa, Gorilla gorilla
CQESVTFEDVAVVFTDEEWSHLVPIQRDLYKEVMLENYNSIVSLGLPVPQPDVIFQMKRGDKPWMVDLHGSEEREWPESVS

SEQ ID NO: 17009 - protein, 81 aa, Phyllostomus discolor
AEVVVTFEDVAVYFSRTEWHLLDEAQRCLYINVMLENYALISSLGCCCGTEEVEAAIQENVSAGDSKAKNIKSALSSQKSH

SEQ ID NO: 17010 - protein, 81 aa, Macaca fascicularis
MTLKDVIVEFTKEEWKLLTFAQRTLYKDVMLENYSHLVSVGYHVNKPNAVFKLKQGKEPWILEVEFPHRVLPCELEEIISH

SEQ ID NO: 17011 - protein, 81 aa, Macaca fascicularis
PLTFRDVAIEFSQEEWKSLDPVQKALYWDVMLENYRNLVFLGILPKCMTKELPPMGNSNTGEKFQTVMLERHECYDIENFY

SEQ ID NO: 17012 - protein, 81 aa, Macaca fascicularis
MLENYRNLVSLGIAVSKPDLITCLEQRNEPWNVKKHETIGRHPAVSSHFTQDLLPEHGIKDSFQKVILGRYGSCGTENLDL

SEQ ID NO: 17013 - protein, 81 aa, Macaca fascicularis
MQEDVAVNFSQEEWSLLSEVQRCLYHDVMLENWVLISSLGKFLTPSPIFFFLRRSLTLSPRLECSGQISAHCNLWTPHLNH

SEQ ID NO: 17014 - protein, 81 aa, Macaca fascicularis
AGRPLEMAVSEPETSATEWKQLDPAQRNVYHDVMLENYSNQASMGYQAPKPDLISKLEKGEAPWLGKGKRPSQGCPSKIAR

SEQ ID NO: 17015 - protein, 81 aa, Macaca fascicularis
DSVAFEDVAINFTCEEWALLGPSQKSLYRDVMQETIRNLDCIGMIWQNHDIEEDQYKDLRRNLRCHMVERSCEIKDNSQCG

SEQ ID NO: 17016 - protein, 81 aa, Macaca fascicularis
REDPGTSESQEMEEWALLDIFQKNLYREVMLETFRNLTSIGKSWKDQNIEYEYQNPRRNFRSLIEEKVNEIKEDSHCGETV

SEQ ID NO: 17017 - protein, 81 aa, Phascolarctos cinereus
VREMISLNKKSVTFKDVAVDFTEDEWRQLNPTQRQLYRDVMLENYRNLIFLEGGEEPWTVEREIPGSPGADWETNPEAREL

SEQ ID NO: 17018 - protein, 81 aa, Phascolarctos cinereus
ARGPVSFADVAVYFSPEEWGRLRPAQRALYRDVMRETYGHLGALGFPGPKPALISWMEQETEAWGPAAQDPEEWGGDVRTA

SEQ ID NO: 17019 - protein, 81 aa, Phascolarctos cinereus
MLENYRNLVFLGFAASRPNDSDQLERKEVSSLPEADIPRSSCPESREFAGDKPLECNGYGNAFWSKEHLAVCQIIRTGEKP

SEQ ID NO: 17020 - protein, 81 aa, Phascolarctos cinereus
SQESVICSGMSRNLSHKKWGHLNPAHKNFCRDIMKENYRNMVSLGIPISTAKKMSQLARGKKPWVLALQGSNKRHVLRGIH

SEQ ID NO: 17021 - protein, 81 aa, Phascolarctos cinereus
ARIPVTFDDVAMYFSEQEWRNLEDWQKDLYKNIMKSNYETLVFLGCANSKPDLITWIERGQEPFIRDLGSLERKDLAISTR

SEQ ID NO: 17022 - protein, 81 aa, Canis lupus
SLESDLFRDVAVVFSQEEWEQLVPTQRDLYRDVMLETYNNLVSLGLAISKPDVISFLEQGKEPWMVEKAATGGLCPVLESR

SEQ ID NO: 17023 - protein, 81 aa, Canis lupus
RPRAVKFADVAVYFSPEEWGCLRPAQRALYRDVMRETYGHLGALGFRGAKPALISWVEEEADLWGPDARDPEVGECVTETD

SEQ ID NO: 17024 - protein, 81 aa, Canis lupus
MFQVTFSDVAIDFSHEEWGWLDSAQRDLYKDVMVQNYENLVSVDWESRWENKELLMKEDIYDEDSPQMVKIEKAIKQSHEF

SEQ ID NO: 17025 - protein, 81 aa, Muntiacus muntjak
WQAVVTFEDVAVYFTQTEWAGLSPAQRALYRSVMLEICGNLMSLGYPIPKPTLVSLLERGDLLAGLETQDNPPAQGTKDIY

SEQ ID NO: 17026 - protein, 81 aa, Canis lupus
ENFSIIMRDVAVEFSPEEWRCLNHTQRELYRDVMLENYGHLLFVGLMVSKPDLVSFLEQRKEPWDLKTKKTVAIHPVLFCL

SEQ ID NO: 17027 - protein, 81 aa, Muntiacus muntjak
MGRLMFRDVAIDFTQEEWECLDFGQRDLYRDVMLETYGNLASLGLVVSKLDLVTFLEQMKNPWGVRRTDTTATYPVWNIFH

SEQ ID NO: 17028 - protein, 81 aa, Muntiacus muntjak
MTFQDVTVAFTQEEWECLDLGQRELYRDVMLENYGNLACLGLVVSKPDLVTFLEQMKDPWDVRGMETAIHPVVSSHDTQGL

SEQ ID NO: 17029 - protein, 81 aa, Muntiacus muntjak
LTESLSFEDVTVGFTQEEWQKLDPAQRTLYRDVMLENYSHLISVGFCMPKPELIFKLERGEQPWVLKRQSLQARSTQVTEK

SEQ ID NO: 17030 - protein, 81 aa, Muntiacus muntjak
AQGSVMFTDVSIDFSQEEWEFLNPDQRELYRDVMLENYSNLVSMGLYIPKPQVISLLEQGKEPWMIGRELTRGLCSALESM

SEQ ID NO: 17031 - protein, 81 aa, Canis lupus
ASGLVMFKDVAIDVSQEEWECLNPTQRNLYKDVMLENYSNLVSLGLSISKPAVISSLEQGKEPWMVEREVTGGWCTDLVSR

SEQ ID NO: 17032 - protein, 81 aa, Muntiacus muntjak
LQETLTFKDMAMVFSREELALLDSAQINLYQDVMLENFRNLVSLEDRIENPNLMNLWGKGLSYLSPEVLYFWQIWNQRISE

SEQ ID NO: 17033 - protein, 81 aa, Muntiacus muntjak
MLETCGLLVSLGHPVPKPELTHLLEHGQKLWTGARGLPRGTGPGDRAKCQTREPSNSQPVLSEEALLRGSLTLGSSWDSRL

SEQ ID NO: 17034 - protein, 81 aa, Gorilla gorilla
MCESVTFEDVAVEFIQEWALLDSARRSLCKYRMLDQCRTLASRGTPPCKPSCVSQLGQRAEPKATERGILHATGVGEYQLW

SEQ ID NO: 17035 - protein, 81 aa, Gorilla gorilla
EDVAVKFTQEEWNLLSEAQRCLYHDVTLENLALMSSLGCWCGVEDEAAPSKQSIYIQRETQVRTPMAGVSPKKAHPCEMCG

SEQ ID NO: 17036 - protein, 81 aa, Ailuropoda melanoleuca
SPGAVSFADVAVYFSPEEWGCLRPAQRALYRDVMRETYGHLGALGFSGPKPAFISWVEGEVEAWSPEAQDPEGESPAAVIR

SEQ ID NO: 17037 - protein, 81 aa, Gorilla gorilla
KEALMAFRDVAVAFTQKEWKLLSSAQRTLYREVMLENYSHLVSLGIAFSKPKLIEQLEQGDEPWREENKHLLDLCPEPRTE

SEQ ID NO: 17038 - protein, 81 aa, Ailuropoda melanoleuca
RLTFRDVAIEFSQEEWECLDPAQRALYRDVMLENYRNLVSLDSSARFMIKELLPKKERNNRELCQPVVLGGHESHGLKDFD

SEQ ID NO: 17039 - protein, 81 aa, Gorilla gorilla
GTVSFADVAVYFSPEEWGCLRPAQRALYRDVMQETYGHLGALGDVPNRKEEEPEEVPRAKGPRKAPVKESPEVLVERNPDP

SEQ ID NO: 17040 - protein, 81 aa, Ailuropoda melanoleuca
SDLFRDVAIVFSQEEWEQLTPAQRDLYRDVMLETYSNLVSLGLAISKPDVISFLEQGMEPWMVEKAARGGLCPVLESRCDT

SEQ ID NO: 17041 - protein, 81 aa, Ailuropoda melanoleuca
REGLLTFKDVAIEFSQEEWGCLSHTQRELYRDVMLENYGHLLFLGFILSKPDLITFLEQEKQLWDVKRKETVAFHPAVSSH

SEQ ID NO: 17042 - protein, 81 aa, Ailuropoda melanoleuca
QGLLTFRDVAIEFSQEEWRCLSHTQRELYRDVMLENYGHLLFLGLIASKPDLVSCLEQKKEPWDLKRKKTVAIHPATSSHD

SEQ ID NO: 17043 - protein, 81 aa, Lynx canadensis
LQGLLTFRDVAIEFSQDEWGCLNQSQRELYRDVMLETYGHLLFLGLIVSKPHLVIFLEQKRELWDVKRKKTVRTQKGENTS

SEQ ID NO: 17044 - protein, 81 aa, Lynx canadensis
PKVPVTFDDVAVYFSEQEWGKLDEWQKELYKHVMRGNYETLVSLDYAISKPEVLSQTEQGKEPCSWRRTAPKVPDVPVDPS

SEQ ID NO: 17045 - protein, 81 aa, Phyllostomus discolor
AEASVTFEDVAVHFSREEWRLLDEAQRRLYLRVMLENFSLISSLGCCCGAEDVEVSQTRNAKAASSPQKSHPCEGCGTVLR

SEQ ID NO: 17046 - protein, 81 aa, Phyllostomus discolor
PEKSLTFKDVSVDFSWEEWECLDPAQRKLYSDVMLENYSNLVSLAMSSADNQDFSLRSGREDLFFEATLKIHTSKKPYECT

SEQ ID NO: 17047 - protein, 81 aa, Phyllostomus discolor
QVPIAFQDLAVRFSEEEWQLLGEGQRALYRDVMQENYEALVSLGTAELVPLSAFLSPAEPGGARSSSKAGEGQAPPGGGAL

SEQ ID NO: 17048 - protein, 81 aa, Neophocaena asiaeorientalis
LEGSVTLQDVAVEFTPEEWQLLDCDQRTLYWDVMLENFRNLISMGCPVTKTKVIFKVEQGQEPWMVEGENPRWRSPEADCP

SEQ ID NO: 17049 - protein, 81 aa, Bos mutus
LQVSVSFEDVTVDFSREEWQHLDSAQRRLYQDVMLENYSHLLSLGYEVPKPEVIFKLEQGEEPWALKEKTLHHSCSDDTTL

SEQ ID NO: 17050 - protein, 81 aa, Neophocaena asiaeorientalis
LLQGSLSFKDVAVVFTWEEWQLLDRVQKNLYQDVMLENYINLVSVGYQVTKTDAFYRLEQETPRIIEEESQSQIHPEDTWQ

SEQ ID NO: 17051 - protein, 81 aa, Bos mutus
MRALLCSSRVTLGLAWPSGESGELGFRGEARCPVPRPELIYRLEHGQELWTVKRDLSRSTCAGDKGKPKTRESTTSEPSLF

SEQ ID NO: 17052 - protein, 81 aa, Neophocaena asiaeorientalis
AHGSVTFRDVAIDFSQEEWEFLDSAQRDLYRDVMWENYSNFISLGPSISKPDVITLLDEGKEPWMVVREGTRRHHPDLESR

SEQ ID NO: 17053 - protein, 81 aa, Bos mutus
VPVTYEDVAVTFTQEEWGHLGPMQRTLYWEVMLETCRLLVSLAHSLAAQGCSVVFVCDNTKPETPQPAPSHPAPSEEVSPQ

SEQ ID NO: 17054 - protein, 81 aa, Bos mutus
MDFTSENWEQLGQGQGDLFWDTALDNYWNLFLLNPPGPNLTFHPDGGEKLEALVKESPESTDTAREGQGQLGSHSFSVVRQ

SEQ ID NO: 17055 - protein, 81 aa, Bos mutus
AECFPEMAVSGPGGSAAEWEQLDPAQKSLYKDVMLENYSNLASMGYQALKPDMISKLEKGEEPWLGKGKGSRQGGSSEIAR

SEQ ID NO: 17056 - protein, 81 aa, Bos mutus
QVSVTFEDVAVLFTRDEWRKLAPSQRNLYQDVMLENYSNLVSLGLPFSKPEVISLLQQGEDPWKVEKESPGDSSLGEWVGN

SEQ ID NO: 17057 - protein, 81 aa, Nomascus leucogenys
GHLTFRDVAIEFSQAEWKCLDPAQRALYKDVMLENYRNLVSLGSSYALGSNAEDKPIKKQLGVSFHLHLSEVELFPDERVI

SEQ ID NO: 17058 - protein, 81 aa, Nomascus leucogenys
RPGAVSFADVAVDFSPEEWGCLRPAQRALYRDVMRETFGHLGALGFSGPKPAFISWMEGEVEAWSPEAQDPYRESSAAFSR

SEQ ID NO: 17059 - protein, 81 aa, Nomascus leucogenys
QGHVTFEDIAVYFSQEEWGLLDEAQRCLYHDVMLENFSLMASVAGLSQSNHKDSCLQQKVPVSLNYCVAQCSPDDGHYNPK

SEQ ID NO: 17060 - protein, 81 aa, Canis lupus
QALVSFKDVAVTFTGEEWRHLDLAQRTLYREVMLETCGLLVSLGEKAKPETTELTASQLAFTEEAPFEEQVTQGVARDSRL

SEQ ID NO: 17061 - protein, 81 aa, Canis lupus
RPGAVSFADVAVYFSPEEWGCLRPAQRALYRDVMRETYGHLGALGFADAKPVLIAWLERKAEVWTPEAEDPEEGARHPGSG

SEQ ID NO: 17062 - protein, 81 aa, Canis lupus
AQESLTFDDVAVDFTWEEWQLLAPAQKDLYWDMMLENYRNLVSVGYQASKPDALSKLERGGELSMIEDEIHSRICPEIRKA

SEQ ID NO: 17063 - protein, 81 aa, Canis lupus
IQEALSFEDLFVDFTQKEWQLLDARQKDLYKDVMLENYSSLVSLGYEVVKPDVIFRLEQGEEPWIGAGELSSLDCPEQVLQ

SEQ ID NO: 17064 - protein, 81 aa, Muntiacus muntjak
MGLLTFQDVTVDFTQEEWECLDLGQRELYRDVMLENYGNLACLGVLVSKPDLVTFLEQMKHPWDVRRMETAIHPGMCLLNI

SEQ ID NO: 17065 - protein, 81 aa, Canis lupus
FAGSVSGQDMAMDLTLEEWQKLDSALRTAFRDVMLEKDRNLTSVGCPVSMSNVIFKLEPGEELWMVGEGTLPPACLGDVWE

SEQ ID NO: 17066 - protein, 81 aa, Muntiacus muntjak
KSWGHLSFMDVFVDFTWEEWQLLDSAQKHLYRSVMLENYRNLVSLGYQYTKPSIIFQLEQEELWMMHSPSLDQSDEVWEID

SEQ ID NO: 17067 - protein, 81 aa, Muntiacus muntjak
LQDLVTFKDVTVEFNQEEWALLDSSQQKLYRDVMLENYGNLASLGYHVDKPSLISQLEQEDKVMTEEGGILPGTCPDLETV

SEQ ID NO: 17068 - protein, 81 aa, Muntiacus muntjak
MGWLTFRDVTIDFTQEEWECLDLGQQELYRDVLLENYGNLASLGLVSKLDLVTFLEQLKDPRNIRRMETTAFYPGILGMGF

SEQ ID NO: 17069 - protein, 81 aa, Canis lupus
QGLLSFKDVAEVFTWEEWQLLDPVQKNLYQDVMLENYSNLVSVDDIWHVDCHTDWHQENKGNLETMENHHKNTAFRKILSL

SEQ ID NO: 17070 - protein, 81 aa, Bos mutus
FQATELEFLSVNYTLKNWKGTALSQRALYWNIMLENCCSLAPLAGENRMASSQLSPKQDISEESKSADRTSGILCGLILRG

SEQ ID NO: 17071 - protein, 81 aa, Neophocaena asiaeorientalis
PKVPVTFDDVAVYFSEPEWGKLDEWQKELYKHVMRGNYETLVSLDYAISKPDILTRMERGEEPCPEGPRGREEGSDREEAR

SEQ ID NO: 17072 - protein, 81 aa, Neophocaena asiaeorientalis
FQGLVTFRDVAIEFSQEEWKCLEPAQKDLYKDVTLENFSNLVSLGLSLSKPDVISLLEQGKEPWMVVNDMTGPWCPDLESR

SEQ ID NO: 17073 - protein, 81 aa, Bos mutus
SVMFRDVAIDFSQEEWDCLDSAQRDLYRDVMLENYSNLVSLGLSQWEMSARLENCDLENSSSRDYLEVKGTLEKQQEQAYF

SEQ ID NO: 17074 - protein, 81 aa, Neophocaena asiaeorientalis
ACVTFEDVAIYFSQEEWELLDEAQRFLYHDVMLENFELTTSLAVCETSNSFTPLSIPVQERSMGAEMTELRSSEWRCPRCT

SEQ ID NO: 17075 - protein, 81 aa, Nomascus leucogenys
EMGLLTFRDVAIEFSLEEWQCLDTAQQNLYRNVMLENYRNLAFLGIAVSKPDLITCLEQGKEPWNMKRHEMVDEPPDGVLL

SEQ ID NO: 17076 - protein, 81 aa, Nomascus leucogenys
VGLQFQGSVTFEDVAIAFSQQEWERLDSSQRGLYRDVMLENYRNLVSMGHSLSKPHVIALLEQWKEPEVTVRKDGRRWCTG

SEQ ID NO: 17077 - protein, 81 aa, Nomascus leucogenys
IQGPLTFGDVAVAFTWIEWRHLDAAQRALYRDVMLENYGNLVSVGLLSSKPKLITQLEQGAEPWTEVREAPSGTHAVQDYW

SEQ ID NO: 17078 - protein, 81 aa, Bos indicus
FQEPVSFKDVAVVFTEEELGLLDSAQRRLYQEVMLENFQNLLSVGNQPFKPELIFQLEREERLMMESQRGGCSGTKSPHNM

SEQ ID NO: 17079 - protein, 81 aa, Bos indicus
SQGLVTFEDVAVYFSLEEWERLDAEQRELYKEVMRENYGILVSLGYPVPKPDLIFRLEQGEEPWVPDSPRPEEGDIVTGVY

SEQ ID NO: 17080 - protein, 81 aa, Bos indicus
LQELVTFKDVAVDFTEEEWQHLDPSQRHLYREVMLENFGNLISLGHLLSEPEMIFHFEQEDDVWMEETIPRSSYSGVRDEN

SEQ ID NO: 17081 - protein, 81 aa, Bos indicus
PQDLMTFEDVAVEFTWWEWGQLDPTQKDLYREVMLENFKNLASLGFPVSKPYMICQLEEGEEPCILEREISTGVHSDWDRR

SEQ ID NO: 17082 - protein, 81 aa, Bos indicus
FQEPVSFKDVAVVFTEEELGLLDSAQRRLYQEVMLENFQNLLSVGNQPFKPELIFQLEREERLMMESQRGTKSPHNMESIQ

SEQ ID NO: 17083 - protein, 81 aa, Canis lupus
SQELVAFEDVLVDFTPEEWQYLNSSQKTLYREVMLETYGNLVSVEEACQVDEQIERQHQVDQDRYLLMQVGFPDKTIITKT

SEQ ID NO: 17084 - protein, 81 aa, Muntiacus muntjak
MTFKDVAVEFSQEEWECLDPAQRAFYMDVMVETLRNLMSVDISHIHVVKKLQPTSSSDTGDAFQTVTLERQKIPEMKYFCF

SEQ ID NO: 17085 - protein, 81 aa, Canis lupus
SQELLTFKDIFVDFTQEEWGQLAPAHRNLYREVMLENYGNLVSVAGYQLSKPGVISQLEKGEEPWLIKRVISGSPSSDLEN

SEQ ID NO: 17086 - protein, 81 aa, Muntiacus muntjak
EPVSFKDVAVVFTEEELGLLDSAQRKLYQEVMLENFRNLLSVGNQPFKPELIFQLEREELLMMETQRGGCSGTKSPHNMES

SEQ ID NO: 17087 - protein, 81 aa, Muntiacus muntjak
GSVTLQDVAVEFTPEEWLLLDCDQRTLYWDVMLENFRNLISVGTGCPVTETTVIFKVEQGQEPWMVEGENSRWSSPEADCP

SEQ ID NO: 17088 - protein, 81 aa, Muntiacus muntjak
GLFTFKDVAVEFTQEEWECLDPTQRALYRDVMLETYRNLLSLGSYSATFAIKELSSPKEDISKGELCHLMTLEKNETYGIK

SEQ ID NO: 17089 - protein, 81 aa, Muntiacus muntjak
ELLTLEDVAVEFNWEEWQLLDSAQKDLYWDVMLENYNNLVSLGYQGTKPDMLSKLEHGKEPCIIENKMQNRICPGIGKGDS

SEQ ID NO: 17090 - protein, 81 aa, Muntiacus muntjak
PKVPVSFEDVAVYFTKAQWKLLDHRQRKLYKQVMLDNYHNLVSLGFSSSKPQLVIQLEQGEKPWVADVQRMRITTGMQEGD

SEQ ID NO: 17091 - protein, 81 aa, Muntiacus muntjak
QLTFKDVFIDFTPEEWECLDPAQRNLYKDVMVETLRNLLSVDMSHMHTIKKLQAKANSVKGEIFQRVMFGRAESLDIKDFH

SEQ ID NO: 17092 - protein, 81 aa, Muntiacus muntjak
EAPKVPFDDVAVYFSEQEWGKLDEWQKELYKHVMRGNYETLVSLDYAISKPEVLSQIEQGKEPCSWRRTGPKVPDVPVDPS

SEQ ID NO: 17093 - protein, 81 aa, Muntiacus muntjak
DVAIDFTQEEWECLDLGQRELYTDVMVENYRNLASLGLVVSKPDLVTFLEQMKDLRNIRRMQTAGIYPGRREWMEPMTQSH

SEQ ID NO: 17094 - protein, 81 aa, Muntiacus muntjak
TSEPVSFADVAVYFSPEEWGCLQPAQRALYRDVMRETYGHLGALGFRGTKPALISWVEEEAELWGPDAGPPEMGECLTEAD

SEQ ID NO: 17095 - protein, 81 aa, Muntiacus muntjak
SVTFEDVAVDFTQEEWSLLDMSQKNLFRNVMVETITHLVSVGYQISKSDVISQLEQGKELWTEATGGLQGQSPVMPSVYRK

SEQ ID NO: 17096 - protein, 81 aa, Muntiacus muntjak
WKMWVKKPVTFEDVAVTFTQEEWKCLDASQRVLYQDVISETVRNLMSVDLIAKLEQEEKQWEADLCSPNEEGFHSGGKKEG

SEQ ID NO: 17097 - protein, 81 aa, Canis lupus
AQSLMAFEDVAVYFSQEEWELLDAAQRALYCHVMLENFALVASLGLSASRPRVVMQLERGEEPWVLSETDVMPARNAQRKA

SEQ ID NO: 17098 - protein, 81 aa, Gorilla gorilla
EKGPLTFRDVAIEFSLEEWQCLDTAQQDLYRKVMLENYRNLVFLAGIAVSKPDLITCLEQGKEPWSMKRHAMVDEPPGWSA

SEQ ID NO: 17099 - protein, 81 aa, Gorilla gorilla
QGRLTFRDVAIEFSLAEWKFLNPAQRALYREVMLENYRNLEAVDISSKRMMKEVLSTGQGNREVIHTGTLQRHHSYHIGDF

SEQ ID NO: 17100 - protein, 81 aa, Gorilla gorilla
LVTFRDVAIDFSQEEWECLDPAQRDLYRDVMLENYSNLISLDLESSCVTKKLSPEKEIYEMESLQWENMGKLTNHHLQYNG

SEQ ID NO: 17101 - protein, 81 aa, Mandrillus leucophaeus
SQESVTFQDVAVDFTEKEWPLLDSSQRKLYKDVMLENYSNLTSLGKASERAGLAEKSTEYAHLLEVFGMGPHLTQPMGRHA

SEQ ID NO: 17102 - protein, 81 aa, Sus scrofa
PHTLVTFKDVLVNFSREEWKLLDTAQQVMYKDVMLENYRNLVSLGLQLPKPDVILRLEKGEDLWPVERGIRQEPCPDLDTA

SEQ ID NO: 17103 - protein, 81 aa, Sus scrofa
SLEPVSFKDVAVDFTQEEWRQLDAEQKTTYRDVMLENYSHLVSVGCHIIKPEVITKLEQGEDPWIVEGEFLLQTYPEVWKV

SEQ ID NO: 17104 - protein, 81 aa, Sus scrofa
ARQSVTFQDVAISFSQEEWAFLVPSQRELYTAVMSETYQNLVWVGSQSIQESKESSLSKSIKEETYQHEIVTEKASSVFKK

SEQ ID NO: 17105 - protein, 81 aa, Nomascus leucogenys
HDTVAYEDLSEDYTQKKWKGLPLSQRALHWNMMLENDRSMASLGRNMMESSELTPKQEIFKGSESSNSTSGGLFGVVPGGT

SEQ ID NO: 17106 - protein, 81 aa, Nomascus leucogenys
FEELVTFEDVFVDFSPEELSSLSAAQRNLYRKVMLENYRNLVCLGYQFSKPDIISRLEEEESRAMETDSRHTVICQGESHD

SEQ ID NO: 17107 - protein, 81 aa, Canis lupus
AQESLTLEDVAVDFTWEEWQLLGPAQKNLYRDVMLENYRNLVSVGYQASKPDALSKLERGGELSMIEDEIHSRICPEIRKA

SEQ ID NO: 17108 - protein, 81 aa, Canis lupus
PQDLMTFEDVAVEFTQWEWGQLDPAQKDLYSEVMLENFKNLASLGLPVSKPYVISQLEEGKEPCVLEGEISTDWEKKPKVK

SEQ ID NO: 17109 - protein, 81 aa, Muntiacus muntjak
MVCESVTFKDVAVLFTRDEWAQLSPAQRALYRDVMLENYSNLVSLGLLGPKPDMFSQLGKGEAWMPEDSLGGFCLDWVITP

SEQ ID NO: 17110 - protein, 81 aa, Muntiacus muntjak
TSQGRLTFRDVAIDFTQEEWECLDLGQRELYKDVMLENYGNLASLGLVSKLDLIASLEQLKDPRNIRRLETTAIYPEHQSF

SEQ ID NO: 17111 - protein, 81 aa, Muntiacus muntjak
QAGSDLFRDVAVVFSQEEWEQLAPTQRDLYRDVMLETYSNLVSLGLAVSKPDVISFLEQGKEPWTVEGVATGGLCPVLKSR

SEQ ID NO: 17112 - protein, 81 aa, Canis lupus
VQESVTFKDVVVLFTRDEWAQLNPIQRALYRDVMLENYSNLVSLGLLGPQPDAFSQLGKEEEWMLEDTSGGFCVDWMTTPV

SEQ ID NO: 17113 - protein, 81 aa, Muntiacus muntjak
RLTFKDVAIEFTPEEWECLDLAQRTLYREVMVETLRNLLSVDTSPKRVMKGSAPKQSSHTGGILQTVLSERHKSHDTKDHA

SEQ ID NO: 17114 - protein, 81 aa, Gorilla gorilla
QGLLTFRDVAIEFSQEEWKCLDPAQRTLYRDVMLENYRNLVSLDISSKCMMKEVSSTAQGNREVIHTGTLQRHESHHTGDF

SEQ ID NO: 17115 - protein, 81 aa, Ailuropoda melanoleuca
HLQGSLSFKDVAVVFTWEEWQLLDPIQKNLYQDVMLENYSNLVSVGYQVTTADAFYQLENGTPWITEEEIQSQIHPAQRSH

SEQ ID NO: 17116 - protein, 81 aa, Ailuropoda melanoleuca
ARRDLAQQGHVTFEDVAVYFSWEEWGLLDEAQRLLYRDVMLENFSLMASLGLASSRTHEITQLEWWREPFLPPCGVLTAAM

SEQ ID NO: 17117 - protein, 81 aa, Ailuropoda melanoleuca
HVTFEDVAVYFSWEEWGLLDEAQRLLYRDVMLENFSLMASLGWRHRAEAEEAPREQSVHIEGVLRAKLQHQKLHCGGKPLR

SEQ ID NO: 17118 - protein, 81 aa, Ailuropoda melanoleuca
FQEPVMFKDVAVVFSEEELGLLDSSQRKLYRDVILENFRNLVSVGNQPFKPELIFQLEREEKLLMMEAEAQRGTKSQHNMD

SEQ ID NO: 17119 - protein, 81 aa, Lynx canadensis
AQVPLTFSDVAIDFSQEEWECLNSDQRDLYRDVMLENYTNLVSLDFDFTTETNKLSSEKSSYEVNSYHRETMKRSKTFNLM

SEQ ID NO: 17120 - protein, 81 aa, Phyllostomus discolor
AQGCVVFEDVAIYFSQEEWGLLNKAQRRLYHNVMLENLALLSSIGCWSGAQDEEAPLEQGDSGGGSQVRTPKSALSTQKTQ

SEQ ID NO: 17121 - protein, 81 aa, Phyllostomus discolor
DVVTFEDVTVYFSRTEWRLLDEAQRLLYLDVMLENFALISSLGCCCGAEDVEAPSEQKSKNPKAALSSQKSHPCERCGPVL

SEQ ID NO: 17122 - protein, 81 aa, Phyllostomus discolor
SQECLTFKDVSVDFSWEEWGCLDPAQRKLYSDVMLENYSNLVSLGLVVSKPVLVTFLEQMQESWDVSRKKSISTPPAVSSV

SEQ ID NO: 17123 - protein, 81 aa, Desmodus rotundus
KALESVAFRDVIVDFTEEEWQQLKPAQKDLYRDVMMENYWNLVSLDLETRPDLKESDPQEDNWEGRPSVAVTAEGPRRNST

SEQ ID NO: 17124 - protein, 81 aa, Canis lupus
GQSHVVFEDVAIYFSQEEWGLLDEAQRFLYHAVMMENFALLSSLGCWHGAQDEEAPSEQGVSSGASQVRTPKLGPSIQEAQ

SEQ ID NO: 17125 - protein, 81 aa, Muntiacus muntjak
MGLLTFQDVTIDFTQEEWECLDLGQRELYRDVMLENYGNLACLGLVVSKPDLVTFLEQMKDPWDVRRIETAIYPGMCIISV

SEQ ID NO: 17126 - protein, 81 aa, Canis lupus
SVTFRDVTVDFTQEEWQQLEPAQKDLYRDVMLENYRNLVSLDLETRVEMKQSRPTEDNVEHRPPVGVLGEGPARHGARGMA

SEQ ID NO: 17127 - protein, 81 aa, Muntiacus muntjak
MGRLTFWDVAIDFTQEEWECLDLGQRELYMDVIVENYRNLASLGLVVSKPDLVTFLEQMKDLRNIRRMQTTGIYPELSMCN

SEQ ID NO: 17128 - protein, 81 aa, Muntiacus muntjak
SLGSVSFRDVAVDFTQEEWQHLDPEQKTTYRDVMLENYSHLISVGCHIIKPEVITKLEQGEEPWVVEGEFLLQSRPEVWKV

SEQ ID NO: 17129 - protein, 81 aa, Muntiacus muntjak
AWSQMPVTFDDVALYLSREEWGRLDHTQQSYREVLQKRRGLSLGFPFSRPFWVSQVQGKGEAPGSSRQLGHEEEEKRGAVE

SEQ ID NO: 17130 - protein, 81 aa, Muntiacus muntjak
RLSFQDVAIDFTQEEWECLFLGQRELYRDVMLENYRNLASLQMKNPWDVRRLEMPAIYTAMSSHNTSFMSCSNLSQHQRIH

SEQ ID NO: 17131 - protein, 81 aa, Muntiacus muntjak
LKQGRLTFRDVAIDFIQEEWGCLDLGQRNFYRDVLIENYANLASLGVVSKLDLVAFLEQLKDPRNIRRMETTAIYPETLKS

SEQ ID NO: 17132 - protein, 81 aa, Muntiacus muntjak
LKMSLSFSDVAIDLSQEEWECMSPVQRALYRDVMLENYSNLVSLGCSTPKPDMITLLEQEKEPWMILREGTGSWFTDLESE

SEQ ID NO: 17133 - protein, 81 aa, Ailuropoda melanoleuca
QGLVSFKDVAVDFTQEEWQQLDPAQRTLYRDVMLENFSHLVSIGYAVSKPDVISKLEQGEDPWIIKRDIPNWIYPDENQAD

SEQ ID NO: 17134 - protein, 81 aa, Gorilla gorilla
VHGSVTFRDVAIDFSQEEWECLQPDQRTLYRDVMLENYSHLISLGSSISKPGVITLLEQEKEPWMVVRKETSRWYPDLESK

SEQ ID NO: 17135 - protein, 81 aa, Gorilla gorilla
EPLTFKDVAIEFSLEEWQCLDTAQRDLYRNVLLENYRNLVFLVMSFHFAQDLWPEQNIKDSFQKVTLRRYGKCEYENLQLR

SEQ ID NO: 17136 - protein, 81 aa, Ailuropoda melanoleuca
FQVLVTFKDVAVTFTQEEWGQLDLDQRALYEEVMLETCGLLVSLGHPVPKPELTHLLEHGQELWTGKGGLSHSTCSGRSRQ

SEQ ID NO: 17137 - protein, 81 aa, Gorilla gorilla
AYGSITFGDVAIDFSHQEWEYLNLVQKTLYQEVMMENYDNLVSLAGHSVSKPDLITLLEQGKEPWTIVREETRGECTDLDS

SEQ ID NO: 17138 - protein, 81 aa, Lynx canadensis
APGLLTFRDVAIEFSQEEWGFLNQSQRELYRDVMLETYGHLLFLGLIVSKPHLVIFLEQKRELWDVKRKKTVASPAGFFVL

SEQ ID NO: 17139 - protein, 81 aa, Lynx canadensis
LLTFRDVAIEFSQEELQCLNHSQWELYRDVMLENYGHLLFLVSLMVLHIHSEVFQNLIGSPLLGGLGEISAFLRKSRLMHF

SEQ ID NO: 17140 - protein, 81 aa, Lynx canadensis
SQGLVSFKDVAVDFTQEEWQQLDPAQRTLYRDVMLENFSHVISLGYPVSKPDVISKLEQGEDPWIIKRDVSNWIYTDENQA

SEQ ID NO: 17141 - protein, 81 aa, Lynx canadensis
REDAPVTFDDITVYLLQGEWMLLSQQQKEICGSDKCASPVPDSGPNYANPELFYKFERGPEPWVGSAQGQRNVLSHHPGKN

SEQ ID NO: 17142 - protein, 81 aa, Lynx canadensis
AQGLVTFRDVAIEFSQEEWKCLEPAQRNLYRDVTLENFSNLVSLGLSISKPDLISLLEQGREPWMIANDMTGPWCPELESR

SEQ ID NO: 17143 - protein, 81 aa, Lynx canadensis
VQGQVNFEDVAVYFSREEWGLLDEAQRLLYRDVMLENLALTASLGSWHGTEDEKTAFEQNISVGVSQVRTPKAVPSTQKAH

SEQ ID NO: 17144 - protein, 81 aa, Lynx canadensis
SQELLTFRDVAIEFSQDEWGFLNVVQWELYRDVMLENYGHLLFLGLAVSKPDLVMFLEEKKELCDVNEKETIATPPGFWST

SEQ ID NO: 17145 - protein, 81 aa, Phyllostomus discolor
VLFEDVSVDFTQEEWRLLDSAQRRLYRDVMLENYRHLASLEVQKASNRKERSQENEDKYSRQASFSNNKTLTKERSKTSGM

SEQ ID NO: 17146 - protein, 81 aa, Phyllostomus discolor
VVESVTFGDVAVLFSQDKWLCLDSAQRTLYQEVMLENYHSLVSLGILFSVPEVICLLAAGTDPCTMGRVIPPDTCLDFKTW

SEQ ID NO: 17147 - protein, 81 aa, Phyllostomus discolor
MLENYRNLVLLAGVSVSKPEVISLLEQGKEPWMVKEVETGGTYSDWEYAFKNSEFSSKQVIYEESSKVMRMGRSHFSYNLD

SEQ ID NO: 17148 - protein, 81 aa, Phyllostomus discolor
LQEPVTFEDVAVHFTQNQWASLDPAQRALYREVMLETYANVAALVAFPVPKPALIAQLERGEAPWGPDPWAAEVWSCICPG

SEQ ID NO: 17149 - protein, 81 aa, Phyllostomus discolor
AVVGVTFADIVLYFSREEWCLLDEDQRCLYLNVMLGNFELISSLGCCCGTEDVETLIEQSVLVMVSETKNLSVALSSQQSN

SEQ ID NO: 17150 - protein, 81 aa, Phyllostomus discolor
AAVGVTFADIALYFSRKEWCLLDEDQRHLYLDVMLENFELVSSLGCCCGAEDVEVPIEQNVSVGVSQAKNSKVASSSQKNH

SEQ ID NO: 17151 - protein, 81 aa, Phyllostomus discolor
AEVCVTLEDVAVYFSRTEWRLLDEAQRHLYLDVMLENFALVSSLGCCCGAKDVEAPSEQSIPVGVSQTRTPKEPPSSQKTH

SEQ ID NO: 17152 - protein, 81 aa, Canis lupus
RESGKAPVTFDDITVYLLQEEWMLLSQQQKEICGSDKLVAQLGPTITNPELFYKFERGPEPWLGNVQGQRTLLSHHPGKNK

SEQ ID NO: 17153 - protein, 81 aa, Canis lupus
SQSLLTFEEVAMYFSQEEWELLDPTQKALYNDVMRENYETVISLVVPVHQIPAFFEKTNTKDWTVTPELILPEFQSLLTFE

SEQ ID NO: 17154 - protein, 81 aa, Muntiacus muntjak
MLENYQAVASLDKDLSLWTLPLPFGISWLLLPQKLTCPFPTPALIFQLERGGTPWSLAPQEGLNGEGRRAIFLGREPQCSL

SEQ ID NO: 17155 - protein, 81 aa, Muntiacus muntjak
GQGHVTFEDVAVSFSQEEWGLLGEAQRLLYYDVMLENLSLIASLGCWRGGDTEEASSEQCVSAERVTRDRNPQEDPCILKA

SEQ ID NO: 17156 - protein, 81 aa, Canis lupus
TQDSVVFEDVAVDFTQEEWALLDLAQRSLYRDVMLENFQNLASLGYPLHTPYLISQWKQEEDLETVEQGLIQGKHQEGFKI

SEQ ID NO: 17157 - protein, 81 aa, Muntiacus muntjak
SQGLVTFEDVAVYFSLEEWERLDADQRELYKEVMRENYGILVSLGYPVPKPDLIFRLEQGEEPWVPDSPRPEEGEIVTGVY

SEQ ID NO: 17158 - protein, 81 aa, Muntiacus muntjak
MGLLTFSDVAIGFSQQEWECLDPVQKTLYRDVMMENYGNLVSLGHSISKPNVITLLEQGKEPWLVVREEARSWCTVLKPSL

SEQ ID NO: 17159 - protein, 81 aa, Gorilla gorilla
SQESLTFKDVFVDFTLEEWQQLDSAQKNLYRDVMLENYSHLVSVGHLVEKPDMIFRLGPGEESWMADGGTPVQTCAGEDRP

SEQ ID NO: 17160 - protein, 81 aa, Ailuropoda melanoleuca
QGSVTFRDVAVPFSREWESLSPAQRHLYRDVMLENYSNLVSLAGYSFSKPHVVTFLEQWKEPWMTVRELTTGCLPQFYGGE

SEQ ID NO: 17161 - protein, 81 aa, Ailuropoda melanoleuca
FESDLFRDVAIVFSQEEWEQLTPAQRDLYRDVMLETYSNLVSLGPGLAISKPDVISFLEQGMEPWMVEKAARGGLCPVLES

SEQ ID NO: 17162 - protein, 81 aa, Ailuropoda melanoleuca
KLYRDVMVENFKNLVSVGHLPFKLDMVSQLEAEENLWMMEGETQRSSKNQNEMETLQKVALKYLSHEELSCWQIWKQVASD

SEQ ID NO: 17163 - protein, 81 aa, Ailuropoda melanoleuca
LQVSVSFEDVTVDFSREEWQQLDPAQRRLYQDVTLENYSHLLSVGYRVPKPEVIFKLEQGEGPWTLEGETPHQSCSDEGIG

SEQ ID NO: 17164 - protein, 81 aa, Lynx canadensis
FQGLVSFEDVAVNFTWEEWQDLDDAQRTLYRVVMLETYSSLVSLGHCITKPEVIVKLEQGAEPWTVEEPLEQSLPDVQTAG

SEQ ID NO: 17165 - protein, 81 aa, Lynx canadensis
SHALVTFKDVLVNFTREEWKLLDTAQQIMYKDVMLENYKNLVSLGHQLPKPDVILRLEKGEEPWLVERGTHRETHPDLDTA

SEQ ID NO: 17166 - protein, 81 aa, Lynx canadensis
MFKEAVTFKDVAVVFTEEELGLLDPAQKKLYGDVMLENFRNLLSLEHRLFKHDTFRLEKVKTLWMMLASHRREKSGKSQAG

SEQ ID NO: 17167 - protein, 81 aa, Lynx canadensis
FQESVTFEDVAVYFSENEWIGLAPAQRVLYRDVMLENYGVVASLGYPFLKPAAISHLEQVEEPLNLKLQGEGPSLICTEGV

SEQ ID NO: 17168 - protein, 81 aa, Lynx canadensis
AQASVSFKDVTVDFSREEWQHLDPAQKTLYMDVMLENYCHLISVGCHMTKPDVILKLERGEEPWTSFTGHTCLEENWKDED

SEQ ID NO: 17169 - protein, 81 aa, Lynx canadensis
FQGSVSFKDVTVGFTQEEWQCLDSSQRSLYRDVMLENYSHLVSVGSCATKPEVIFRLEQGEEPWISEEEFPSQSLPEVWET

SEQ ID NO: 17170 - protein, 81 aa, Lynx canadensis
GKPGALSFADVAVYFSSEEWGCLRPAQRALYRDVMRETYGHLGALGEARPPALISWMERKKEAWSPEAEDPEDRARHPGYG

SEQ ID NO: 17171 - protein, 81 aa, Phyllostomus discolor
AEVGVTFADIALYFSREEWRLLDEAQRHLYLDVMLENFELISSLGCCCGTKDVEELIEQNISVRVVEEENPKVPLSSQKSH

SEQ ID NO: 17172 - protein, 81 aa, Phyllostomus discolor
VKDSVTFKDVAIDFTLEEWRLMDPTQRDLHKDVMLENYRNLVSLGLAVSKPDMISHLEDGKGLWVVVREISTSPYPELETK

SEQ ID NO: 17173 - protein, 81 aa, Phyllostomus discolor
QGFVSFKDVTVDFTQEEWQQLDSAQRNLYRDVMLENYSNLVAVAFEIRPKVKELTPQKIISEEVVLHNMIGYSISEDGKLR

SEQ ID NO: 17174 - protein, 81 aa, Phyllostomus discolor
AEVGMTFADIALYFSREEWRLLNEAQRRLYLDVMLENFELVSSLGCCCGTEDVEELMEKNISVRVVQAENLKMTLSSQKSH

SEQ ID NO: 17175 - protein, 81 aa, Phyllostomus discolor
RVTFEDVAVYFSLEEWDLLNEAQRHLYHDVMLENLALITSLGCWHGAQNEEVPSEHRDSLQGVSQVWTRKAGVSPQKAHPC

SEQ ID NO: 17176 - protein, 81 aa, Phyllostomus discolor
GEVLVTFEDVAVSLSRTEWLLLDETQRHLYLNVMLENYALISSLGCCCAAEHVVAPTEQNITIRISKAMNLKSALSFQKSH

SEQ ID NO: 17177 - protein, 81 aa, Phyllostomus discolor
FQRSLTFRDVAVDFSLEEWECLDPAQRKLYMDVMMENYRNLVSLGLVVSKPVLVTFLEKIKERWDVKGKKTCALSAMSSED

SEQ ID NO: 17178 - protein, 81 aa, Desmodus rotundus
LQEPFSFEDLSVDFTQKEWQLLDPSQKDLYKDVMLENYSSLVALGYEFMKPDVIFKLEQGEEPWIGDGEIPSSDSPEQVLQ

SEQ ID NO: 17179 - protein, 81 aa, Nomascus leucogenys
GYVTFEDVAVYFSQEEWRLLDEAQKLLYRNVMLENFSLLASLGCWHGAEAEEAPEQSASVGLLSSNIQQHQKQHCGEKPLK

SEQ ID NO: 17180 - protein, 81 aa, Nomascus leucogenys
MLENYKNLATVGCQLFKPSLISWLEQEESRTVQRGDFQALEWKMQLKTKESALQQDVLGEPTSSGIQMIGSHNGGEVNDVK

SEQ ID NO: 17181 - protein, 81 aa, Muntiacus muntjak
EQLTFKDVAIDFSPEEWECLDPAQRALYRDVIQLQLKSNSDTRKVLQTVLLRRPKSLEIKHFYLREMQENMNDFESQQRCD

SEQ ID NO: 17182 - protein, 81 aa, Muntiacus muntjak
IQDTVVFEDVAVDFTQEEWALLNLTQRNLYRDVMLENFRNLASLGYPLHKPYLISQWKQEEDLETVEKRPIQGEHQEGFKI

SEQ ID NO: 17183 - protein, 81 aa, Canis lupus
LGDVAIEFSQEEWTCLNHTQRKLYRDVMLENYGHLLFLGLIVSKPDLVSFLEQKKEPWSVKRKKRVTIHPAISFRDTQSLL

SEQ ID NO: 17184 - protein, 81 aa, Muntiacus muntjak
SFEALTFKDVAVTFTEEELGLLDLAQRKLYRDVMLENFRNLLSVGHQSSKPDMISQLEREEKLWTTEIQTQRGGRSGGRNH

SEQ ID NO: 17185 - protein, 81 aa, Muntiacus muntjak
EAVTFNDVAVVFTEEEMGLLDLAQRKLYQEVMLENFRNLLSVGHQSFTPDVPSQLEREEKLQMIKTAAQSCCSSVCQMGIW

SEQ ID NO: 17186 - protein, 81 aa, Muntiacus muntjak
QPGLVTFRDVAVEFSQEEWKCLEPAQRDLYREVTLENFGNLVSLGLSISKPDVVSLLEQGKEPWMVVNDVTGPWCPDLESR

SEQ ID NO: 17187 - protein, 81 aa, Muntiacus muntjak
SEMERLTSEDVAIKFTQEEWEFLDPAQRALYRDVMLETYRNLLSVGEDDLLPELPLGICIFPVCPLGGPDVFHLRVLVTRA

SEQ ID NO: 17188 - protein, 81 aa, Canis lupus
SQASLSFEDVAVSFSWEEWQLLTLSQKDLYWDVMLENYNNLVSLGYQASKQDSLFRLEQGGLPWTVEGVAHSQTCPEEIWE

SEQ ID NO: 17189 - protein, 81 aa, Muntiacus muntjak
KFQGSVSFKDVTVGFTQEEWQHLDSTQRSLYRDVMLENYRNLVSVEVCKTDLMKERSQENQPKHIWKVVLINNKSLTKEQG

SEQ ID NO: 17190 - protein, 81 aa, Muntiacus muntjak
LERPVSFKDVVVGFTQEEWHGLNPAQRALYRDVMLETYSNLVSVGYEGTKPYVILRLEQEEAPWICEAACSGCQGRENIWQ

SEQ ID NO: 17191 - protein, 81 aa, Muntiacus muntjak
VLFKDVAIDFSQEEWGYLDLEPKDMHRDVMLENCSNLVSLVSISKPDMLSLLKQGKEPWKVSRCETKKLPSKREIYELEAS

SEQ ID NO: 17192 - protein, 81 aa, Muntiacus muntjak
PQGGVTFEDVALSFSWKEWKLLDAAQRRLYHDVMLENYALIFSLGFWSGEEKVQTSFEQSVSVAVSQARTSKEPSSSQKTH

SEQ ID NO: 17193 - protein, 81 aa, Gorilla gorilla
MSKEAVTFKDVAVIFTEEELGLLDLAQRKLYRDVMLENFRNLLSVGHQPFHQDTFHFLREEKFWMMDIATQREGNSGGKIQ

SEQ ID NO: 17194 - protein, 81 aa, Phyllostomus discolor
SQGLLTFRDVSVDLSWEEWECLDPGQRKLYVDVMLENYRTLVSLGLFVSKPVLVTFLEQMKECWIINREKMVSAPPAVSSE

SEQ ID NO: 17195 - protein, 81 aa, Desmodus rotundus
CQESVTFMDVAVIFTDEEWRHLIPIQRDLYKQVMLENYESIVSLGLPVPQPDVIFQLKREDKPWIVDLHGSDESGNISLDW

SEQ ID NO: 17196 - protein, 81 aa, Macaca fascicularis
LQEPVTFRDVAVYFTQEEWGQLDPTQRILYRDVMLETFGHLLSIGPELPKPEVISQLEQGTELWVAERGTIQGCHPGWEPP

SEQ ID NO: 17197 - protein, 81 aa, Macaca fascicularis
IMEEAVTFKDVAVFFTEEELGLLDPAQRKLYRDVMLENFRNLLSAGHQPFHQDTFHFLREEKFWMMETVTQREGNLGSKIQ

SEQ ID NO: 17198 - protein, 81 aa, Macaca fascicularis
LPAKDSAWPWEGKPRYLGPVTFEDVAVLFTEAEWKRLNLEQRNLFKEVMLENLRNLVSLRLGSLRSGLLHLDMNMNLDLWL

SEQ ID NO: 17199 - protein, 81 aa, Nomascus leucogenys
LLVYLGPLTFIDVAIEFSLKEWQCLDTAQQNLYRDVMLENYRNLVFLGIAFSKPDLITYLEQGKEPWNMKRHETVAKPLGM

SEQ ID NO: 17200 - protein, 81 aa, Bos indicus
TEEPVTFEDVAVYFTQNQWASLDSAQRALYREVMLENYPNITSLTAFPFPKPDLIFWLERGEEPGRLDPWTLVRGEDPRGT

SEQ ID NO: 17201 - protein, 81 aa, Bos indicus
VQGSVSFEDVAVGFSQEEWQILGPSQKALYWDVMLENYCNLVSVGYQAPTPNSLFQLEQGGPPWTVEGAALSPTCSGKKLY

SEQ ID NO: 17202 - protein, 81 aa, Bos indicus
LMEAVTFGDVAVHFSREEWQCLDPGQRALYKEVMLENHSSVAGLGFLVFKPELISRLEQGQDPWVLDLQGAEGREEARTTR

SEQ ID NO: 17203 - protein, 81 aa, Bos indicus
KSWGPLSFMDVFVDFTWEEWQLLDSAQKHLYRSVMLENFRNLVSLGYQYTKPSIIFQLEQEELWMMHSPSQGHSGSKVETW

SEQ ID NO: 17204 - protein, 81 aa, Muntiacus muntjak
NPAFMAFLDVAVGFIQEEWKLLSPAQRTLHREVMLEIYNHLLSLNILLSKPELICMLEQGEEPWIEERQRSLGLCPEIQPC

SEQ ID NO: 17205 - protein, 81 aa, Muntiacus muntjak
MASPSPPPEPKEEWDYLDPAQRSLYKDVMMENYGNLVSLDVLNRDKDEEPTVKQEIEEIEEEMEPQGIIVTRIKSEIDQDP

SEQ ID NO: 17206 - protein, 81 aa, Muntiacus muntjak
GSFSFEDLSVDFTQKEWQLLDPYQKDLYKDVMLENYSSLVSLGYEVMKPGVILKLEQGEEPWTGDGEIPSSDSLDQVFQVN

SEQ ID NO: 17207 - protein, 81 aa, Canis lupus
YQEFVTFEDVAVHLTREEWGCLDPVQRDLYREVMLENYGNVVSLGILLRLPTTRIHSVNSCPALSHTQASAFSGETLAVLS

SEQ ID NO: 17208 - protein, 81 aa, Canis lupus
LLTFKDVVIEFSQEEWECLASAQRALYRDVMLENYRNLVSLDIPTICVRKELPPKDDLNNGELLQTLILERHLSHQFDDFD

SEQ ID NO: 17209 - protein, 81 aa, Muntiacus muntjak
RKRGSLTLEDVAVDFTWEEWQLLAPAQKALYRDVMLENYGNLVFVGYQASKPAALSRLERGEPWPVEDEVHSQLCPEMRKD

SEQ ID NO: 17210 - protein, 81 aa, Canis lupus
SVGPVSFKDVAVDFTQEEWQQLDPEQKTTYRDVMLENYNHLVSVGCHIIKPEVIIKLEQGEEPWIVGGEFLPQSYPEVWKA

SEQ ID NO: 17211 - protein, 81 aa, Muntiacus muntjak
LQGPVSFEDVAVYFSREEWGLLNWTQRSLYRHVMLENFALIGSLDFAPSKSPKVAQMEGEEEAWVPDMVDSVVSRAEARKG

SEQ ID NO: 17212 - protein, 81 aa, Gorilla gorilla
VSLAFRDVSIDLSQEEWECLDAVQRDLYKDVMLENYSNLVSLGTTPIPAPTQKNSIIAFVYSLLFFFADLEYKYITKNLLS

SEQ ID NO: 17213 - protein, 81 aa, Gorilla gorilla
YLGPVTFEDVAVLFTEAEWKRLSLEQRNLYKEVMLENLGNLVSLESKPEVHTCPSCPLAFGSQQFLSQDELHNHPIPGFHA

SEQ ID NO: 17214 - protein, 81 aa, Ailuropoda melanoleuca
QASVSFKDVTVEFTQEEWQQMGPIQRTLYRDVMLENYNNLVSVGNCIFKPAVIVKLEQGEEPWFLEEKFSNQSRQDYCDLW

SEQ ID NO: 17215 - protein, 81 aa, Ailuropoda melanoleuca
DSVVFEDVAVDFTQEEWALLDLAQRSLYRDVMLENFQNLASLGYPLHTPYLISQWKQEEDLETVERGPIQGEHQEGKNPWE

SEQ ID NO: 17216 - protein, 81 aa, Ailuropoda melanoleuca
MYFSQEEWELLDPTQEALYNDVMRENYETVISLALFVLPKPKVISYLERGEEPWVQGPLEFKNSPGDLPAGLKVKTDTENH

SEQ ID NO: 17217 - protein, 81 aa, Gorilla gorilla
AQVSVTFDDVAVTFTQEEWGQLDLAQRTLYQEVMLENCGLLVSLGCPVPRAELIYHLEHEQEPWTRKEDLSQGTCPGDKGK

SEQ ID NO: 17218 - protein, 81 aa, Ailuropoda melanoleuca
FEPLTFRDVAVVFTEEELGLLDPAQRKLYRDVMLENFRNLLSVGNQPFKPELIFQLEREEKLLMMEAEAQREGYLGTKSQH

SEQ ID NO: 17219 - protein, 81 aa, Ailuropoda melanoleuca
EEAVVFADVAVNFTPEEWALLDGGQRRLYRDVMLETCRNLASLVCLPVLNRSHWAEPVCESNEGNPCGETVNQTTGLTVLE

SEQ ID NO: 17220 - protein, 81 aa, Ailuropoda melanoleuca
SWVSVSFEDVTVDFSREEWQQLDPAQRRLYQDVTLENYSHLLSVAGYEVPKPEIIFKLEQGEEPWILERKTPHQSCSDGRF

SEQ ID NO: 17221 - protein, 81 aa, Phyllostomus discolor
KPRAMKFADVAVYFSPEEWECLRPAQRALYRDVMQETYRHLGALETRTRKKTEEKEVFPPKEAPRKGKRGRRPSKPRLIPR

SEQ ID NO: 17222 - protein, 81 aa, Phyllostomus discolor
SQGLVTFEDVAVYFSLEEWGRLDAGQRDLYEEVMRENYGILVSLGYPIPKPDLISRLEHGQEPWVPDSPRPEEGDIVTGVY

SEQ ID NO: 17223 - protein, 81 aa, Phyllostomus discolor
TVMFKDVAVVFTEEELALLDPSQKILYQDVTLENLRNLISVGQWNQNEIETVHEVALRYLFHEDLVCWQIWDQLLSKLIRN

SEQ ID NO: 17224 - protein, 81 aa, Muntiacus muntjak
MGRLTFWDVAIDFTQEEWECLDLGQRELYMDVMVENYRNLASLDLVTFLEQMKDLRNIRRMQTTGIYPVSTVHTLSNHSEH

SEQ ID NO: 17225 - protein, 81 aa, Muntiacus muntjak
MGHVTFEDVAVSFSQEEWGLLGEAQRLLYYDVMLENLSLIASLGCWQGGEAEKAISKQCVSVEQVTRDRNPQPDPSSLKTL

SEQ ID NO: 17226 - protein, 81 aa, Muntiacus muntjak
HCGSVTFRDVAIDFSQEEWEFLDSAQRDLYRDVMWENYSNFISLGPSMSKPDVITLLGEGKEPWMVVREGTGRHHPDLESR

SEQ ID NO: 17227 - protein, 81 aa, Muntiacus muntjak
FQEIATLKDVAMDFTLENWEQLGQGQGDLFWDTALDNYQNLFLLSEPPPRPNLTFHPDGGEKLEALVKESPESTDADIAET

SEQ ID NO: 17228 - protein, 81 aa, Canis lupus
MLENYANVASLAFLFTRPVLVSQLERGELPWGLEPWEPVGREALRGICPGGETRAEKEESTPKGHISKETESHRLTLRGLP

SEQ ID NO: 17229 - protein, 81 aa, Muntiacus muntjak
AQLTFKDVAIEFTQEEWECLDPAQRALYRDVMVETLRNLVSLDISHILVIKKLQLNAKTDRGEEFQTVILGRHERNKIKDF

SEQ ID NO: 17230 - protein, 81 aa, Muntiacus muntjak
ALNRVTFEDVAVYFSQEEWYLLDEAQIQLYLDVMLENFALVCMLGSWSGAGDEDTPFEQSKSVGVSQIGTPRADSSAENVQ

SEQ ID NO: 17231 - protein, 81 aa, Gorilla gorilla
SQHLVTFEDVAVDFTQEEWTLLDQAQRDLYRDVMLENYKNLIILAGSELCKLSLMSGLEQMEELRTGVTGVLQGEKQYCRE

SEQ ID NO: 17232 - protein, 81 aa, Ailuropoda melanoleuca
LVLFKDVAVDFSQEEWECLDLEQKDLYRDVMLENYSNLVSLAGFSISKADVLSLLKQGKEPWKVVQDVTRSQNSDWESKCE

SEQ ID NO: 17233 - protein, 81 aa, Phyllostomus discolor
PTVQESVTFKDVAVDFTQEEWHHMAPAQRRLYRDVMLENYSNLVSLGYQVSKPEVIFKLEQGEEPWLSEGEIQRSFCPEHG

SEQ ID NO: 17234 - protein, 81 aa, Phyllostomus discolor
MDSVAFEDVAVNFSLEEWALLQPAQKKLYRDVMRETFRNLASIGEKWKDPDIEDQYKKQGEKLRSHMVEKLCESKEDSQCE

SEQ ID NO: 17235 - protein, 81 aa, Desmodus rotundus
CVTFEDVDILFSQEEWGLLDEAQRHLYLDVMLENLSLIASLGEQLCPDPWHLVFQVLVCWHTAENEETPEQSVSVEALPRV

SEQ ID NO: 17236 - protein, 81 aa, Desmodus rotundus
SVAFRDVIVDFTQEEWQQLKPAQKDLYRDVMMENYWNLVSLDLETRPDKKESDPQEDDWEDRPSIAVVAEGPMRTGDQGCI

SEQ ID NO: 17237 - protein, 81 aa, Desmodus rotundus
VTFADIALYFSKKEWCLLDEDQRCLYLDVMLENFELISSLGCCCGAEDVKASNEENVSIEVSQAKQPKTPFSPWHCHPCES

SEQ ID NO: 17238 - protein, 81 aa, Macaca fascicularis
GSELFRDVAIVFSQEEWQCLAPAQRDLYRDVMLETYNNLVSLGLAISKPDVISFLEQGKEPWMVERVVSGGLCPVLESRYD

SEQ ID NO: 17239 - protein, 81 aa, Macaca fascicularis
MRDVMLENYRNLVSLGVAISNPDLVTCLEQRKEPYNVKIRKIVARPPAVRSHFTQDRWPVQGIEDSFHNLILRRYEKCRHE

SEQ ID NO: 17240 - protein, 81 aa, Macaca fascicularis
MFKEAMTFKDVAVVFTEEELGLLDLAQRKLYQDVMLENFRNLLSVGHQAFHRDTFHFLREEKIWMMKTATQREGDSGDKIQ

SEQ ID NO: 17241 - protein, 81 aa, Macaca fascicularis
EMGPLTFRDVVIEFSQEEWQCLDTAQQDLYRKVMLENFRNLVFLGIDVSKPDLITCLEQGKDPWNMKRHSMVAAPPVKCSH

SEQ ID NO: 17242 - protein, 81 aa, Macaca fascicularis
WLQEPMTFKDVAVEFTQDEWMMLDSAQRSLYRDVMLENYRNLTSVEYQLCKLTVISPLDQEEIRNVEKRIPQGICPDQKIL

SEQ ID NO: 17243 - protein, 81 aa, Canis lupus
LPDLVTFEDVAVEFSQEEWALLDPSQRTLYRDVMRENCRNLASLGYHVDKPSLISQLEQEDKVMTEERGILQGTCSDLETV

SEQ ID NO: 17244 - protein, 81 aa, Canis lupus
MLENYGHLLFLGLVWKPDFVIFLVEEKQLWDVKRKETVPFHPAVSSSGTQSFLPTLCIEASFQNVAVHRYKHSALENLHFM

SEQ ID NO: 17245 - protein, 81 aa, Muntiacus muntjak
TQLTIEDVDIKFTPEEWECLDPAQRALYWDVMEETYRNLLSVDVSHIHMTKKLQAKGNSGKGEILQRVMFRRTETHETKDF

SEQ ID NO: 17246 - protein, 81 aa, Canis lupus
ETVTFKDVAVIFTEEELGLLDPAQRKLYGDVMLENFRNLLSVGDKNLNDTETLQEIGLKYLPHEELFCSQIWQQVTKELTL

SEQ ID NO: 17247 - protein, 81 aa, Muntiacus muntjak
FQESVTFKDVAVDFTLEEWRLMDPTQRDLHKDVMLENYRNLVSLGLAISKPDMISHLEDGKGPWVVVREISRTPFSELETK

SEQ ID NO: 17248 - protein, 81 aa, Muntiacus muntjak
MGRLTFQDVAIDFTQEEWECLDLGQRELYRDVLLENYGNLASLGLVSKLDLVTFLEQLKDPRNIRRMETTTSYPGVSVFYF

SEQ ID NO: 17249 - protein, 81 aa, Canis lupus
QGSVTFEDVVVYFSWEEWGLLDETQRCLYHDVMLENFALVISLGCWYGMEDEAAVSVQRMSLGKTSSPDPSIWKAQPCEKC

SEQ ID NO: 17250 - protein, 81 aa, Muntiacus muntjak
KVPVTFVDIAVYFSEDEWKNLDEWQKELYNNLVKENYKTLMSLDSEGPVSKPEAPSQAEPREEPCVWEQRDPEEREILMDP

SEQ ID NO: 17251 - protein, 81 aa, Muntiacus muntjak
QPDLVTFGDVAVDFSQEEWEWLNPAQRSLYRTVMLDNYRSLVSLGVSASKPDVISLLEQGKEPWLVKEEGPRGARPDSSPT

SEQ ID NO: 17252 - protein, 81 aa, Ailuropoda melanoleuca
QEPVTFEDVAVYFTQNQWAKLDPTQRALYREVMLENYANVASLVAFPFPKPDLVSQLERGEVPWGPDPWEAEVLRGICPGG

SEQ ID NO: 17253 - protein, 80 aa, Gorilla gorilla
MCGPLQFTDVAIEFSLEEWHCLDTAQRNLYRDVMLENYRNLVFLGIVVSKPELITCLEQGKKPLTMKRHEMIAKPPGRCK

SEQ ID NO: 17254 - protein, 81 aa, Gorilla gorilla
FQEAVTFKDVAVAFTEEELGLLDSAQRKLYRDVMLENFRNLVSVGHQSFKPDMISQLEREEKLWMKELQTQRGDRNQNEMA

SEQ ID NO: 17255 - protein, 80 aa, Ailuropoda melanoleuca
QGWLTFRDVAIEFSQEEWECLDPAQRALYRDVMVENYRNLVSLGISLSDLNIVSFLEQGKEPWTVEGKVKKPNGWEYGIG

SEQ ID NO: 17256 - protein, 81 aa, Ailuropoda melanoleuca
QGSLSFRDVAVGFTRKEWQQLEPAQRMLYRDVMLENYSHLVSVATGCQVTKPAVISRLEQGQEPWMEDIVTNPLIRSQPGN

SEQ ID NO: 17257 - protein, 81 aa, Ailuropoda melanoleuca
LQASVSFKDVTVEFTQEEWQKIGPAQRTLYRDVMLEIFSHLVSVGYCYTTPEVILRLEQAEDACLLEKEFLTRNSSGEERF

SEQ ID NO: 17258 - protein, 81 aa, Phyllostomus discolor
SQDSVTFQDVAVDFTEKEWPLLDSSQRKLYKDVMLENYSNLASVGCQVGKPSLISHLEQEEELRTEERGLLQGTCPDWEIP

SEQ ID NO: 17259 - protein, 81 aa, Phyllostomus discolor
ADTSVTFEDIAMHFSWEEWRLLDEAQRRLYLHVMLDNFTLISSLGCCCGAKDVEAPTEENICVPVSQARNAKTAVSSQKSH

SEQ ID NO: 17260 - protein, 81 aa, Desmodus rotundus
GLFIPKPYVITLLEDGKEPWMVERNLTEDMFSDWNLRWENKELSTKENVYDDDSTQTRISAERKSHEYDIFKKSLLKKSLI

SEQ ID NO: 17261 - protein, 81 aa, Macaca fascicularis
MGPLTFMDVAIEFSLKEWQCLDTAQQNLYRDVMLENYRNLVFLGIAFSKPDLITYLEQGKEPWNMKRHETVAKPLVMCSYF

SEQ ID NO: 17262 - protein, 81 aa, Macaca fascicularis
FQEAVTFKDVAVAFTEEELGLLDSAQRKLYRDVMLENFRNLVSVGHQSFKPDMISQLEREEKLWMKEFQTQRGDRNQNEMA

SEQ ID NO: 17263 - protein, 81 aa, Gorilla gorilla
IGGDVTFSDVAIDFSHEEWGWLNSAQRDLYKDVMVQNYENLVSVAGLSVTKPYVITLLEDGKEPWMMEKKLSKGMIPGWES

SEQ ID NO: 17264 - protein, 81 aa, Gorilla gorilla
DGLVTFRDVAIDFSQEEWECLDPAQRDLYVDVMLENYSNLVSLDLESTTYETKKIFSENDIFEINFSQWEMKDKSKTLGLE

SEQ ID NO: 17265 - protein, 81 aa, Gorilla gorilla
MKPGVISHAPDSVVPAAFPFPKPDLIFQLEQGEAAWGPDPWTLAGGEALRGMCTGGKTKTENEEKTAQLNISKESESHRLI

SEQ ID NO: 17266 - protein, 81 aa, Gorilla gorilla
VTFEDVAVNFTWEEWNLLSEAQRCLYRDVTLENLALISSLGCHCVAQDGVHDPSTLASKHAGITGVSYCAWPFFFFFFFNF

SEQ ID NO: 17267 - protein, 81 aa, Gorilla gorilla
YQDSVTFEDTAVDFTQEEWTLLDPVQRNLYRDVMLENYENVAKVGFQLLKPSVISWLEEEVLRTLQQGVLQDWAIKHQTSV

SEQ ID NO: 17268 - protein, 81 aa, Gorilla gorilla
QLSFSDVAIEFSQEEWKCLDPGQKALYRDVMLENYRNLISLDFSLLAWDARVFRVEAWRASGGAEEPTGPNFVGNDSPLPS

SEQ ID NO: 17269 - protein, 81 aa, Ailuropoda melanoleuca
QEPVTFEDVAVYFTQNEWVILDPSQRALYREVMLENYANVASLAFLFTRPVLVSQLERGELPWGLELWEPAGREALRGVCP

SEQ ID NO: 17270 - protein, 81 aa, Ailuropoda melanoleuca
LQASVSFKDVTVEFTWEEWRQMDSAQRTLYRDVMLENYSHLVSVGYCFTKPELIFTLEQGEDPWLLKKEFLRKSTPEDSQP

SEQ ID NO: 17271 - protein, 81 aa, Lynx canadensis
RPRAVKFADVAVYFSTEEWGCLRPAQRALYRDVMRETYGHLGALGFPGPKPALISWMEQESEAWSPAAQDPEEGESLGGAL

SEQ ID NO: 17272 - protein, 81 aa, Lynx canadensis
GPWTLLTFRDVAIEFSQEEWGCLNHSQRELYRDVMLETYGHLLFLGLVSKPDLVILLEQKKELWGVKRKETVGCQFEGHVT

SEQ ID NO: 17273 - protein, 81 aa, Lynx canadensis
MFTGYCLTKPKMIFRLEQEEEPWSLEEEFLNQRYPGYLSIDIHIEGNQEKQEKPLWQVIFTNNKTLSKEEQKVLEKPFNLD

SEQ ID NO: 17274 - protein, 81 aa, Lynx canadensis
FQESLALEDVAVNFTWDEWQLLDSAQKNLYRNVMLENVSSLVSLGFQLIKPDVIFKLEREQPCIIGEEVPSQSLSGESPVR

SEQ ID NO: 17275 - protein, 81 aa, Lynx canadensis
PLESVTFEDVAVDFTQEEWALLDASQRKLFRDVMLENIRHLVSLGYQHCQSDVIFQLEQGEELWAEGSGSLQSQGPGGESA

SEQ ID NO: 17276 - protein, 81 aa, Phyllostomus discolor
LQESLTFHDVAVDFTLEEWQLLDPNQKDLYRDVMLENYSNLVSVAGYQASKPDTLSRLERGEEPRAVQDEMHHVVCPELRR

SEQ ID NO: 17277 - protein, 81 aa, Phyllostomus discolor
KAQGLVTFEDVAVDFTQEEWQYLNPPQRILYRGVMMETYRNLVFVGQQATKPDLILKMEVEEPYLAEDKIPIWSCPEEACQ

SEQ ID NO: 17278 - protein, 81 aa, Desmodus rotundus
FQPPVSFKDVVVSFTRDEWGQLDTIQRTLYRDVTLETCGHLVSLGLLLPNLDVISRLENGEDPWRAEQEPPTQDWKTTLEK

SEQ ID NO: 17279 - protein, 81 aa, Desmodus rotundus
SVTFRDVIVDFTQEEWEQLKPVQKDLYRDVMMENYWNLVSLDLETEGDMNDPDPEKDSWEDRPSVTSSMPAPPRLEGPRGA

SEQ ID NO: 17280 - protein, 81 aa, Desmodus rotundus
ELLTLEDVSVEFNWEEWQLLDAAQKDLYQDVMLENYHNLLSLGYHTAKPDALSKLEHGEEPQIIEDDIYNISCAEIRKVGS

SEQ ID NO: 17281 - protein, 81 aa, Macaca fascicularis
DSMTFEDIVVDFTREEWALLDTSQRKLFQDVMLENISHLVSIGREGDIKHQEIPFIQHTYQKGTSTISTMRSHTQEDPFLC

SEQ ID NO: 17282 - protein, 81 aa, Macaca fascicularis
IQDSVVFEDVAVDFTQEEWALLDLAQRNLYREVMLENFQNLASLGYLLHTPHLICQWEQEEDLQTVKRELIQVIFMGEHQE

SEQ ID NO: 17283 - protein, 81 aa, Macaca fascicularis
MLENFALLASLGIAFSRSCAVIKLEQAEEPWVYDQVDMTSATEREAQSGLRRGCWYGVENEEVSSEQSISVAGVSQVRTLT

SEQ ID NO: 17284 - protein, 81 aa, Macaca fascicularis
PQGLLTFRDVAIEFSQDEWKCLDPAQRSLYRDVMLENYRNLVSLDISSKCMLKTLSSTGQGNTEVILTGTLQRQASHHTGE

SEQ ID NO: 17285 - protein, 81 aa, Macaca fascicularis
QGHVTFEDIAVYFSQEEWGLLDEAQRCLYHDVMLENFSLMASVARLSESNHKDSCSQQKVTVSLNNCVAQCSPDDGHYTPK

SEQ ID NO: 17286 - protein, 81 aa, Macaca fascicularis
RQAFLAFGDVTVDFTQKDWRLLNPAQRALYREVTLENYSHLVSLGILHSKPELIRRLEQGEAPWGEERRCRPGPRAGIYAE

SEQ ID NO: 17287 - protein, 81 aa, Macaca fascicularis
IWDLVMFRDVAVDFSQEEWECLNSYQRNLYRDVILENYSNLVSLGCSISKPDVITLLEQGKEPWMVMRDEKRRWTLDLESR

SEQ ID NO: 17288 - protein, 81 aa, Macaca fascicularis
MGLLTFRDVAIEFSLEEWQCLDTAQKNLYRNVMLENYRNLAFLGVAVSKPDLIICLEKDKEPWNMKRHEMVDEPPGICPHF

SEQ ID NO: 17289 - protein, 81 aa, Phascolarctos cinereus
MYFSEQEWRNLEDWQKDLYKNIMKSNYETLVFLGCANSKPDLITWIERGQEPFIRDLGSLERKDLAISTRAEEHLHLKSAK

SEQ ID NO: 17290 - protein, 81 aa, Phascolarctos cinereus
MMENYKNFVFLGLPVSKLDVISLLERGEAPWMPEGGVPSRCCPGSHTQETRCETQESGWIQGISMGVSSKKILKEDSSWHY

SEQ ID NO: 17291 - protein, 81 aa, Phascolarctos cinereus
WQESLTFKDVTVDFTQEEWGLLDHSQKGLYKEVMLENSQNLLSLGIPVLREDFMSHFEKREVSWILDQIGPRNFCPDAETS

SEQ ID NO: 17292 - protein, 81 aa, Macaca fascicularis
PQGLLTFRDVAIEFSQDEWKCLDPAQRSLYRDVMLENYRNLVSLEFQSVTQAKVQWCDLGSLQPPLPRFKQFSCLGLPSSW

SEQ ID NO: 17293 - protein, 81 aa, Phascolarctos cinereus
KESVTFKDVAVEFTQEEWVQLNPSQKKLYRDVMLENYKNLVSLALPSVAFALPQEDSLEEEGMASAPKPGPGKVSASCSFP

SEQ ID NO: 17294 - protein, 81 aa, Phascolarctos cinereus
AQELLTFKDVAVDFTQEEWGLLDHPQKKLYKEVMLENAQNLLSLGLPVLREDLISYFEEKEAPWLLEYEGRRSCYPEGEIR

SEQ ID NO: 17295 - protein, 81 aa, Phascolarctos cinereus
APGSSRPPAQELVTFQDVAVDFTQEEWGLLDHPQKELYKEVMLENAQNLLSLGLPVPREDLISYCEEREAPWLLEQEGPRS

SEQ ID NO: 17296 - protein, 81 aa, Phascolarctos cinereus
SQESVTFQDVAVDFTREEWKRLDSAQRDLYRDVMLENYQNLVSLGLLVFQSDVISQLENGEVPLVPGGEVPRGTRPGSVNQ

SEQ ID NO: 17297 - protein, 81 aa, Gorilla gorilla
FQELVTFRDVAIDFSRQEWEYLDPNQRDLYRDVMLENYRNLVSLGGRSISKPVVVDLLERGKEPWMILREETQFTDLDLQC

SEQ ID NO: 17298 - protein, 81 aa, Ailuropoda melanoleuca
HRSMIFRDVAIDFSQQEWEYLDSVQKNLYRDVMMENYEYLGLTGAGHSISKPDVITLLEQGKDPWMVVKEDTRRWCTGKYE

SEQ ID NO: 17299 - protein, 81 aa, Lynx canadensis
FQERLTFRDVAIEFSQEEWVCLDPSQRALYRDVMLENYRNLVSLGKENVPPEVGICPRAASQSNIERTHWTRHVEGWGRSV

SEQ ID NO: 17300 - protein, 81 aa, Ailuropoda melanoleuca
FQGSMMFRDVSVNFSQEEWECLDSGQMNLYKEVMLENFSNLVSVGLSNSKPAVISLLEEGKEPWMVERELTRGLCSDLESM

SEQ ID NO: 17301 - protein, 81 aa, Lynx canadensis
GRVTFEDVAVYFSGEEWGLLDEAQRCLYQDVMLETLAHITSLDLAHQQQRTGEKCFGSNRGGASSWKDYTFCVSGKPFSCG

SEQ ID NO: 17302 - protein, 81 aa, Lynx canadensis
MFTFLYRISRPSVISQLEQKEEPWALPLQNFEARRILQESHTDFENQVTKLSRDISEAAERCGTSSERANKDISPPPSWGG

SEQ ID NO: 17303 - protein, 81 aa, Lynx canadensis
GLLTFRDVAIEFSQEEWGCLNQSQRELYRDVMLETYGHLLFLGEDNSFQTSQTSLTQSNQGSHVSKQITSKYDECGKALKQ

SEQ ID NO: 17304 - protein, 81 aa, Lynx canadensis
GYGSVSFRDVAISFSQEEWACLDPAQRALYRDVMLENYSHLLSLAGRSISKPDVITLLEQEKEPWVVIWSQIMELRSYLQK

SEQ ID NO: 17305 - protein, 81 aa, Lynx canadensis
MLETYRNLVSLGLQRSKPDVISRLEKGEEPWTPHSLRIEESWIRNHRSGSFESLMEKKELTPKQEISKAVESQRAKPEEHA

SEQ ID NO: 17306 - protein, 81 aa, Lynx canadensis
RSQESLTFQDVAVDFTREEWDQLYPAQKNLYRDVMLENYRNLVALGHQLYKPEVISQLEQEEQWMMERGSSGDIRAGGENR

SEQ ID NO: 17307 - protein, 81 aa, Lynx canadensis
SQDLVTFKDVAIDFSQEEWEWLNPAQRSLYKNMMLENYRNLVSLGLCISKPDVISLLEQGEDPWMMKGERTGGLCPDLESV

SEQ ID NO: 17308 - protein, 81 aa, Lynx canadensis
MLENFRNLVSVGCQATKRDALSVLEHRDEAWMKAEDEIQDRTHAGIGKVDSHLQEHSQNHRFLKGLQQYGEQSAFRNAVHL

SEQ ID NO: 17309 - protein, 81 aa, Lynx canadensis
LLTFRDVAIEFSQDEWGCLNQSQRELYRDVMLETYGHLLFLDTLAQYTLKQSSSIAGHQRIRVGENPYTGNESGNMFSQSL

SEQ ID NO: 17310 - protein, 81 aa, Lynx canadensis
AHHLVMFRDVAVDFSQEEWECLNSYQRNLYRDVILENYSNLVSVAGCTISKPDVITLLEQGKEPWMVVRDERRRRSLDLES

SEQ ID NO: 17311 - protein, 81 aa, Lynx canadensis
FKEAVTFKDVAVVFTEEELGLLDPAQKKLYGDVMLENFRNLLSLGHQNFTPDAVPQFKRGGRLWMIKAATQSHGSSGDRNL

SEQ ID NO: 17312 - protein, 81 aa, Lynx canadensis
LQEAFSFEDLSVDFTQKEWQLLDPSQKDLYKDVMLENYSSLVSLGYEVMKPDVIFKLEQGEEPWVGDGEVPSADCSEQDLQ

SEQ ID NO: 17313 - protein, 81 aa, Phyllostomus discolor
AQGHVTFEDVAVYFSWEEWELLDEAQRHLYRSVMLENFSLMASLGLASSRTHEITQLEQWGEPFLPAHGVITAAMPGGHWH

SEQ ID NO: 17314 - protein, 81 aa, Phyllostomus discolor
SVTFKDVIVDFTQEEWKQLDPVQRDLFRDVTLENYTHLVSIDWEAKLENSISVPEPDTPEEEPSPEAVVEKHKSDDVSESW

SEQ ID NO: 17315 - protein, 81 aa, Phyllostomus discolor
AQGLMVFEDVAVYFSREEWELLDAAQRALYRHVMLENFALVASLGLSASRPRIVIQLECGEEPWLLSGSDVTLARNAQRRP

SEQ ID NO: 17316 - protein, 81 aa, Phyllostomus discolor
GLLTFEDVAVFFTQEEWDYLDPAQRSLYKDVMMENYGNLVSLDVLNRDKDEEPTVKQEIEEIEEEVESKGIIVTRIKSETD

SEQ ID NO: 17317 - protein, 81 aa, Desmodus rotundus
DPLAIEDVVVTFTLEEWALLDSSQKKLYKDVMRKTFKNFLASIGKKWDIHDIEELYKNQGRKLRNYMVEKLCENKEGSQCG

SEQ ID NO: 17318 - protein, 81 aa, Macaca fascicularis
LQVSITFKDLAVRFSEEEWRLLEEGQREFYRDVMRENYETLVSVGTAELLPLSAFLSPSESGGAVVGGSHADEGQEPAGGG

SEQ ID NO: 17319 - protein, 81 aa, Macaca fascicularis
EQGLVTFEDVAVDFTQEEWQYLNLPQRTLYRDVMLETYSNLVFVGQQVTKPNLILKLEVEEYPAEGKIPFWNFPEVCQVDE

SEQ ID NO: 17320 - protein, 81 aa, Macaca fascicularis
YQDSVTFDDVAVEFTPEEWVLLDTTQKYLYRDVMLENYMNLASVEWEIQPRTKRSSLQQGFLKNQIFTGIQMTRNYSGWKL

SEQ ID NO: 17321 - protein, 81 aa, Macaca fascicularis
MNNSQGRVTFEDVTVNFTKGEWQRLNPEQRNLYRDVMLENYRREETTKPDVILRLEQGKEPWLVEEEVLGSGRPEKNGDVG

SEQ ID NO: 17322 - protein, 81 aa, Phascolarctos cinereus
AQESVTFEDVAVEFTGEEWRQLDPAQRNLFREVTLENYRNLVSLGLTVAKPNLIFLLERGEAPWTLQRQVPGGPSSDCHCW

SEQ ID NO: 17323 - protein, 81 aa, Phascolarctos cinereus
SQELVTFKDVTVNFTQEEWRQLNPAQRDLYRDVMLENYRNLISLGLPISTSDMIFQLEQEKGPWAFDLQRSEEKEVPRNIY

SEQ ID NO: 17324 - protein, 81 aa, Ailuropoda melanoleuca
QEAVVFADVAVDFTPEEWALLDGGQRRLYRDVMLETCRNLASLDCLLPFKSSLMLGCSPGAGQQPHLLSDLPVAAGTVQSG

SEQ ID NO: 17325 - protein, 81 aa, Ailuropoda melanoleuca
LVMFEEVSVCFTSEEWECLGPIQRALYWDVMLENYGNVTSLEWETMTENEEVTPKPSISQRADSQKGTSRRLQGGVPQTPD

SEQ ID NO: 17326 - protein, 81 aa, Gorilla gorilla
ESLQFRDVAVEFSLEEWHCLDTAQQNLYRDVMLENYRHLVFLGIIVSKPDLITCLEQGIKPLTMKRHEMIANSPVMCSHFA

SEQ ID NO: 17327 - protein, 81 aa, Ailuropoda melanoleuca
SLDSVTFTDVAIDFSQDEWEWLSLAQRTLYKKVMLENYRNLLSLGLCISKPDVISLLEQGREPWMMKGERTRGLCPDLEYV

SEQ ID NO: 17328 - protein, 81 aa, Lynx canadensis
RKYVGLPFQGSVTFRDVAVAFSQQKWESLNSAQRDLYRDVMLENCSNLVSLGHSLSKPHVITLSEWKEPWMIEDHRRPCTG

SEQ ID NO: 17329 - protein, 81 aa, Lynx canadensis
VQESVTFRDVAVVFSQDEWLRLDSAQRTLYREVMLENYGTLVSLGIPSSTPKVICRLQQGKDPCVVERETPQDACLGFKTW

SEQ ID NO: 17330 - protein, 81 aa, Lynx canadensis
WLVTFRDVAINFSQEEWECLNSTQRDLYRDVMLENYSNLISLDLESSCETKKSSPEKGAYEMESLQWENRRKPISHNFDYN

SEQ ID NO: 17331 - protein, 81 aa, Lynx canadensis
ILGKEIFKDVAIYFSQKEWECLHPSQKGLYRDVMLENYNNLISLGLSDSKPNVISLLEQGKEPWLVKSKETKEWCPDWESR

SEQ ID NO: 17332 - protein, 81 aa, Lynx canadensis
AQELLTLEDVAVDFSREEWQLLAPAQKDLYRDVMLENFRNLVSVGCQATKRDALSVLEHRDEAWMKAEDEIQDRTHAGIGK

SEQ ID NO: 17333 - protein, 81 aa, Phyllostomus discolor
LPDMVTFEDVCVEFTQEEWALLDPSQKTLYKDVMLENCRNLASLGYHVDKLNLISPLEQEDKVMAEGRGVLPDICPDLETI

SEQ ID NO: 17334 - protein, 81 aa, Phyllostomus discolor
VTFGDVAVLFSRDEWLCLDSAQRTLYREVMLENYHSLVSLGWGSLFETTFSKEDYQEVMSKLIGDGTFNFKLEKIYINEDK

SEQ ID NO: 17335 - protein, 81 aa, Phyllostomus discolor
SQSLVTFGDVAVDFSQEEWELLTCAQRALYRDVMLENYRNLVSLGLCFSKPDMIYSLEQREEPWMAKRKVTRGPCPDWQAL

SEQ ID NO: 17336 - protein, 81 aa, Phyllostomus discolor
VTFEDVAVYFSRTEWSLLDAAERRLYRHVMLENFGLISSLGCCCGAADVEAPTNQNLSVRVAQAKDPKAALSSKKSHPCDS

SEQ ID NO: 17337 - protein, 81 aa, Macaca fascicularis
MLENYRNLISLGEDNVPPEAWICSGICLPDLSVISILEQKRDPWTLQSDVKVANNPNGREYIKGVKTEKSSKLGRNAGNKP

SEQ ID NO: 17338 - protein, 81 aa, Macaca fascicularis
QGRVTFEDVTVNFTKGEWQRLNPEQRNLYRDVMLENYSNLVFVGREETTKPDVILRLEQGKEPWLVEEEVLGSGRPEKNGD

SEQ ID NO: 17339 - protein, 81 aa, Phascolarctos cinereus
VKMSVTFDDVAVYFSKNEWKKLEWSQKELYKHVMRTNYETLISLDYTIPKPDLISHIEQGKEPVFKSLANLETNVRTIQSS

SEQ ID NO: 17340 - protein, 81 aa, Phascolarctos cinereus
PKVPVTFDDVAVHFSEQEWGNLSEWQKELYKNVMRGNYESLVSMDYAISKPDLMSQMERGERPTMQEPEDSEEGETPTDPS

SEQ ID NO: 17341 - protein, 81 aa, Phascolarctos cinereus
GKESVTFKDVAVEFTREEWVQLNTSQKKLYRDVMLENYRNLFSLGFAVSKPDVIYQLERKEASWMPEADIPEGSCPESREF

SEQ ID NO: 17342 - protein, 81 aa, Phascolarctos cinereus
SVTFKDVAVDFTWEEWGYLDTSQKELYWEVMLENYRNLVSLDGDTRPQIKESTPKFSISMEPLSQQRSLWDDSCFSKMGKA

SEQ ID NO: 17343 - protein, 81 aa, Phascolarctos cinereus
WSQGSVTFSDVSVDFTQEEWKQLDLAQRNLYRDVMLENYRNFISLGQQVSKPRIISQLEQEEPWMVENTIPKDICPDWEAD

SEQ ID NO: 17344 - protein, 81 aa, Phascolarctos cinereus
QDLVTFKDVSVDFTREEWMRLDHPQRALYRDVMLENYRNLVLVSLAGHPISKPDVISRLEQGGVPWVLKKGATGRAFSDRE

SEQ ID NO: 17345 - protein, 81 aa, Phascolarctos cinereus
PKVPVIIEDVAVYFSEQEWGNLDEWQKELYKHVMRGNYETLVSLDYAISKPDLLSRIEQGEEPCGQELSNTEERENPVHPS

SEQ ID NO: 17346 - protein, 81 aa, Phascolarctos cinereus
TQESVTFKDVAVDFTRKEWEQLTPAQRYLYRDVMLENYRNLVSLGLPVSKPEVISQLEQGEVPWLAEEEVPRSTYSDWETR

SEQ ID NO: 17347 - protein, 81 aa, Myotis lucifugus
MNFEDVAIVFSEEEWGLLDEAQRLLYCNVMLEVFALVSSAGCCHKTDDEEACPEQSVSVQGESQVRASKTEPTTQRTHVCK

SEQ ID NO: 17348 - protein, 81 aa, Gorilla gorilla
FKDVCVDFTQEEWYLLDPAQKILYRDVILENYSNLVSVGYCITKPEVIFKIEQGEEPWILEKGFPSQCHPERKWKVDDVLE

SEQ ID NO: 17349 - protein, 81 aa, Ailuropoda melanoleuca
FESFSYIDVAIDFSQEEWECLNSDQKDLYRDVMLENYTNLVSLDGNGHLHSAPDLFFHLPSSYFPLPHPAIPSFSKIKFWK

SEQ ID NO: 17350 - protein, 81 aa, Ailuropoda melanoleuca
KVPVSFEDVSVYFTKTEWKLLDLRQRILYKRVMMENYRHLVSLGIGFLSSKPHLVSWLEQGEGPWAADICRTPAATGRQTG

SEQ ID NO: 17351 - protein, 81 aa, Gorilla gorilla
QGLLTFSDVAIEFSQEEWKCLDPAQRTLYRDVMLENYRNLVSLDISSKCMMKTFFSTGQGNTEVFHTGTLQRQASHHIGDF

SEQ ID NO: 17352 - protein, 81 aa, Ailuropoda melanoleuca
TFKETVTFKDVAVVFTEEELGLLDLTQRKLYRDVMLENFGNLVSVGHHPFKRDVVHLVREEKFWMVKLATQRKGSSGYKVQ

SEQ ID NO: 17353 - protein, 81 aa, Ailuropoda melanoleuca
DLMTFEDVAVEFTQWEWGQLDPAQQDLYREVMLENFKNLASLGEPSGLPVSKPYVITQLEEGKDPCVLDGEISTGEVSERS

SEQ ID NO: 17354 - protein, 81 aa, Ailuropoda melanoleuca
KFNEAVTFKDVAVVFTREELGLLDPIQRKLYWDVMLENFRNLVSVGYEPFRLDTLLLGREEKLWMMETETQGDGTSGLRNQ

SEQ ID NO: 17355 - protein, 81 aa, Ailuropoda melanoleuca
EAVTFKDVAVAFTEEELGLLDSSQRKLYQDVMLENFRNLVSVGIFRSFSFGFFPHAFLSLAPLIFSSIPPYTAVSEVHSCL

SEQ ID NO: 17356 - protein, 81 aa, Gorilla gorilla
VGLQYQGSVTFEDVAIAFSQQEWESLDSSQRGLYRDVMLENYRNLVSMGHSLSKPHVIALLEQWKEPEVTVRKDGRRWCTG

SEQ ID NO: 17357 - protein, 81 aa, Phyllostomus discolor
FSQHLVTFEDVAVDYEEWMLLDQMQRDLYRDVMLENYKNLITLTGYEPCKPGVNSGLEGAEELRTGTGVLQALDLQLKTKA

SEQ ID NO: 17358 - protein, 81 aa, Phyllostomus discolor
MMGLVTFEDVAVDFTQEEWQYLNPPQRILYRGVMMETYRNLVFVAGQQATKPDLILKMEVEEPYLAEDKIPIWSCPEEACQ

SEQ ID NO: 17359 - protein, 81 aa, Phyllostomus discolor
QAKVTFEDVAVLLSPEEWGHLGPAQRGLYRDVMLETYRNLVSLAYEISTECRELTSGEMLDGAEPDQLGGPVPQGTEPEEA

SEQ ID NO: 17360 - protein, 81 aa, Phyllostomus discolor
AEASVTFEDVAVHFSWDEWRLLDEAQRRLYLCVMLENFSLISSLGCCCGRKDVETPIEQNVSVQVSQTKNPKATSSSQKTH

SEQ ID NO: 17361 - protein, 81 aa, Macaca fascicularis
SVAFEDVAVTFTQEEWALLDPSQKTLYRDVMQETFRNLASVGKKWKAQNMYVEYENLKRNLSFVGERLFESKEGHQHGEIL

SEQ ID NO: 17362 - protein, 81 aa, Macaca fascicularis
RNMIPQDNENPPQQGEANQNDSMTFEDVAVNFTPEEWALLDPSQKNLYQEVMQETLRNLASIEVLWKRDYLKVKVISLEKF

SEQ ID NO: 17363 - protein, 81 aa, Macaca fascicularis
ACESITFGDVAIDFSHQEWEYLNLVQKTLYQEVMMENYDNLVSLAGHSISKPDLITLLEQGKEPWMIVGEETRGECTDLDS

SEQ ID NO: 17364 - protein, 81 aa, Macaca fascicularis
GQLTLKDVAIEFSQEEWTYLDPAQKTLYRDVILENYRNLVSLDISCKCVNKDPPPKGKNSMGEAFHMVKLEGLESCDEALS

SEQ ID NO: 17365 - protein, 81 aa, Macaca fascicularis
AQESVTFEDVAVNFTNREWQSLTYAQRHLYKHVMLENYGNMVSLGFPFPKPPLISHLERGVEPCVQDPQDGESLSCSYPVS

SEQ ID NO: 17366 - protein, 81 aa, Macaca fascicularis
KSLVTFEDVAVYFSQEEWELLDAAQRHLYHSVMLENLELITSLGNTLSQHGDDQLMPCNISVEEVLPVRIPNADSSTKKAN

SEQ ID NO: 17367 - protein, 81 aa, Phascolarctos cinereus
VPKVPGTFENDGVYFSEQEWENLDDWQKELYRNVMKSNFETLVSLDCAISNPEILAHQEEESGTEELGDLAGESPGGPHPD

SEQ ID NO: 17368 - protein, 81 aa, Phascolarctos cinereus
AQELVTFKDVAVDFTPEEWGLLDHAQKELYKTVMLENAQTLLSLGLPVPREDWIFHLEQEGLRNSCPDAETGFDVKRMNTN

SEQ ID NO: 17369 - protein, 81 aa, Macaca fascicularis
MLVTFKDVAVTFTQEEWRQLDLTQRTLYREVMLETCGLLVSLGDRTQVHTREPTTYPPVLSEWAFLRGSLTVASSTSSDSR

SEQ ID NO: 17370 - protein, 80 aa, Phascolarctos cinereus
MTPVLGTAGHRQGSVTFQDVAVVFTPEEWGHLEPSQKELYREVMLENFRNLVCLAGARGSTVEARGRSPENQLFRLGDSA

SEQ ID NO: 17371 - protein, 81 aa, Phascolarctos cinereus
EDEEEMLAGLVTARAQEEWSHLHPTQKDLYWHVTLENCENLVSLGLPVSKLDVLSLLGRGNASWKPEGEESPQSTCPDSLN

SEQ ID NO: 17372 - protein, 81 aa, Phascolarctos cinereus
FQEAVTFKEVTVDFTREEWERLDPLQRDLYKDVMLENYRNLVSLGLMDSKPVMISWLEWGEEFQMPYPQETEKGVVLEGTC

SEQ ID NO: 17373 - protein, 81 aa, Phascolarctos cinereus
MTFEDMAMYLTREEWRPLDPTQRDLYRDVMQENYGNVVSLDFDIRSENEANPKVISEDIEFGDISERPIESAHQTPECEEG

SEQ ID NO: 17374 - protein, 81 aa, Gorilla gorilla
VIFKDVAVVFTKEELALLDKAQINLYQDVMLENFRNLMSVSEDGIKNNILNLQEKGLSYLLQEVLHCWQISKQRIQDLTGS

SEQ ID NO: 17375 - protein, 81 aa, Gorilla gorilla
SQELLTFKDISIDFTQEEWGQLAPAHQNLYREVMLENYSNLVSVGYQLSKPSVISQLEKGEEPWMAEKEGPGDPSSDLKSK

SEQ ID NO: 17376 - protein, 81 aa, Gorilla gorilla
QASVCFEDVAMAFTQEEWEQLDLAQRTLYREVTLETWEHIVSLDWKATLEENRLNSEKDRAREELSHHVEVYRSVQEEPPS

SEQ ID NO: 17377 - protein, 81 aa, Ailuropoda melanoleuca
VLEAVTFKDVAVVFTEEELGLLDPAQRKLYGDVMLENFRNLISVGHHPFKRDVVHLVREEKFWMVKLATQRKGSSGGKIQS

SEQ ID NO: 17378 - protein, 81 aa, Ailuropoda melanoleuca
ELIAFQDVVVDFSQEEWGQLSPGQKALYWDVMLENYRNLVSLGKTSVQFKALFISLPLPLSASPSGSVSHNPCDRIDCPCV

SEQ ID NO: 17379 - protein, 81 aa, Ailuropoda melanoleuca
SEESVTFKDVAVDFTQEEWGQLDSPQRALYRDVMLENYQNLLALAGPPVCKPDVISHLERGEEPWWMPREVPGGACLEGEP

SEQ ID NO: 17380 - protein, 81 aa, Ailuropoda melanoleuca
QGSVLFEDISVDFTQKEWQLLNPAQRLLYKEVMLENYRQLVSLAGHCVTKPELVLKLEQGEEPWAPKRELPSQSRPEIQKA

SEQ ID NO: 17381 - protein, 81 aa, Ailuropoda melanoleuca
PVTFQDVTVEFTRGEWEHLDTYQRALYREVMLENYRSLASLDQETRSRIAKSNLKQVISEEFSQTMIINKGKRNGVCYPTR

SEQ ID NO: 17382 - protein, 81 aa, Ailuropoda melanoleuca
QWMPVTFDDVAVTFTQEEWGQLEPVQRTLYREVMLETCGLLVSLGCPLPKPELIYALDHSPELQTLKRGLSLNSCPGDSTK

SEQ ID NO: 17383 - protein, 81 aa, Ailuropoda melanoleuca
RPLPGGPWQRHKNHRTEQVLEWLFISQEQPKMTQSRGPLSFVDVCVDFTWEEWRLLEPAQKHLYRSVMLENYSHLVSLGRS

SEQ ID NO: 17384 - protein, 81 aa, Ailuropoda melanoleuca
GESVTFKDIAVDFTQEEWALLDTSQRKLYRDVMLENISHLVSVETGYHLCKSDVISQLEQGVELWREGEGFLQGLNPGELQ

SEQ ID NO: 17385 - protein, 81 aa, Lynx canadensis
MAHMAFRDVAVDFSQEEWMLLSPAQRSLYREVMLENYSNLVSLGIPVSKPKLITQLEQGKETWREERKCSPATCPAEPKPE

SEQ ID NO: 17386 - protein, 81 aa, Lynx canadensis
TQVSVTFDDVAVTFTREEWGQLDPAQKTLYQEVMLENCGLLVSLGCPVPRPELICQLERGQEPWTAKRGLSQNTYPGDKDK

SEQ ID NO: 17387 - protein, 81 aa, Lynx canadensis
AVTFRDVAVAFTEEELGLLDSAQRKLYQDVMLENFRNLVSVGHQSLKQDKWRIEKEKLWSMKTAAQMERNVGKNQARVSSF

SEQ ID NO: 17388 - protein, 81 aa, Lynx canadensis
AGYQVSKPEVIFKLEQGEEPWISEGEIQRPFCPDWKTRPEGKSSHLQQSVSEGSRSADGLSRATFENTWDVSSQLERHQEN

SEQ ID NO: 17389 - protein, 81 aa, Lynx canadensis
KSLGSVSFKDVMVDFSREEWQRLDLAQKSLYRDVMLENYFNLISVGCQVPKPEVIFNLEQEEPCVLDGDISSHNCLNGDIG

SEQ ID NO: 17390 - protein, 81 aa, Lynx canadensis
MYFSQEEWELLDPTQKALYNDVMRENYETVISLALFVLPKPKVISYLEQGEEPWVQGSTELKDSPGELPTGIKHKSDTENH

SEQ ID NO: 17391 - protein, 81 aa, Lynx canadensis
LQESLTLEDVAVDFTQEEWRLLAPAQKDLYRDVMLENFRNLVSVGCQATKRDALSVLEHRDEAWMKAEDEIQDRTHAGIGK

SEQ ID NO: 17392 - protein, 81 aa, Phyllostomus discolor
SQDLVTFEEVAVDFSPKEWALLSLAQKILYRDVMMETLRHVASVGYYLCKHSLVTEVEQEELRTEERRNLQVEPDLQISCS

SEQ ID NO: 17393 - protein, 81 aa, Phyllostomus discolor
IRSDLVAFEDVAVRFSLEEWALLQPAQKKFYREVMWETFRNLASVSKDDKSHLVERLHKGEKNGQCGENVGFIPNLNVKKK

SEQ ID NO: 17394 - protein, 81 aa, Phyllostomus discolor
LQGSVSFKDVTVDFTQEEWQQLDTDQKALYRDVMLENYCHLVSVGFHMTKPDMIRKLEEGEELWTTERIFPSQGYLEEDGK

SEQ ID NO: 17395 - protein, 81 aa, Desmodus rotundus
GPVLFRDVAVDFTQEEWQQLDPEQKTTYRDVMLENYSHLVSVGCQVVKPEVIIKLEQGEEPWVEGELLPRRWPGVWRADVT

SEQ ID NO: 17396 - protein, 81 aa, Macaca fascicularis
QESLTLEDVAVEFSWEEWQLLDTAQKNLYRDVMVENYNHLVSLGYQTSKADVLSKLAHGQEPWITRNPIYAVNCSDYGNAF

SEQ ID NO: 17397 - protein, 81 aa, Macaca fascicularis
MGPLTFTDVAVEFSLEEWQCLDTAQQNLYRNVMLENYRNLVFLGITVSKPDLITCLEKEKEPWNMKRYEMVDELPVICSHF

SEQ ID NO: 17398 - protein, 81 aa, Macaca fascicularis
ARDLVMFRDVAIDFSQEEWECLNSYQRNLYRDVILENYSNLVSLGCSISKPDVITLLEQGKEPWMVMRDEKRRWTLGPTFK

SEQ ID NO: 17399 - protein, 81 aa, Macaca fascicularis
EMGLLTFRDVAIEFSLAEWQCLDRAQQNLYRDVMLENYKNLVSLGIAVSKPDLITHLEQNKEPRNIKKNEMLAKHPVMCSH

SEQ ID NO: 17400 - protein, 81 aa, Gorilla gorilla
MEFVTLKDVGMDFTLGDWEQLGLEQGDTFWDTALDNCQDLFLLDPPRPNLTSHPDGGEDLEPLAGGSPEAPGPDVTETKNS

SEQ ID NO: 17401 - protein, 81 aa, Ailuropoda melanoleuca
LQESVTFRDVAVFFSQDEWLRLDSAQRTLYREVMLENYGTLVSLGIPFSTPKVICQLQQGEDPCVVDRELPQDAWPGLKTQ

SEQ ID NO: 17402 - protein, 81 aa, Ailuropoda melanoleuca
LLQGFVSFKDVTVDFTWEEWQQLDSAQRSLYRDVMLENYSNLVSVGCQSLKSDVILLKQGEPWMKEEEISSWAYSDWRFED

SEQ ID NO: 17403 - protein, 81 aa, Ailuropoda melanoleuca
PQAKVTFEDVAVLLSQEEWDRLGPAQRGLYRHVMMETYGNVVSLGLPGSKPNVISQLERGEEPWVLDGQGAEKTRGLGSGH

SEQ ID NO: 17404 - protein, 81 aa, Ailuropoda melanoleuca
MTFEDVAVEFTQWEWGQLDPAQQDLYREVMLENFKNLASLGLPVSKPYVITQLEEGKDPCVLDGEISTGEPDWEKRPKAKE

SEQ ID NO: 17405 - protein, 81 aa, Ailuropoda melanoleuca
VSFKDVTVDFTWEEWQQLDSAQRSLYRDVMLENYSNLVSIGCQSLKSDVILLKQGEPWMKEEEISSWAYSDFGIRPKMKEL

SEQ ID NO: 17406 - protein, 81 aa, Lynx canadensis
AHRSVTFRDVAIHFSQQEWEYLDPVQKNLYRDVMMENYDNLVSLEHSISKPDVITLLEQRKEPWMVVREDTKRWCTDLESK

SEQ ID NO: 17407 - protein, 81 aa, Lynx canadensis
MTSGLLTFRDVAIEFSQEEWGFLNHSQWALYRNVMLETYGHLLFLAGLVVSKPDLVIFLEQKESWNVKGKETVTTHPDRWE

SEQ ID NO: 17408 - protein, 81 aa, Lynx canadensis
FQGSVTFRDVAIDFSQEEWEWLQPTQRDLYRHVMLENYSHLVSLAGLNISKPYVVSLLEQGKEPWLEKRGVRRNLFSEPNR

SEQ ID NO: 17409 - protein, 81 aa, Lynx canadensis
APGLLTFRDVAIEFSQDEWGCLNQSQRELYRDVMLETYGHLLFLGLIVSKPHLVIFLEQKRELWDVKRKKTVASPAAISSH

SEQ ID NO: 17410 - protein, 81 aa, Lynx canadensis
LQESLTLEDVAVDFTQEEWRLLAPAQKDLYRDVMLENFRNLVSVGHQASKPDVLAKLERGEEPWAIEEEVRSGTSPETGKV

SEQ ID NO: 17411 - protein, 81 aa, Lynx canadensis
AQESVMFSDVSIDFSQEEWECLNDDQKDLYRDVMLENYSHLVSMAGHSVSKPDVISFLEQGKEPWLVDRELTRDQWPVLES

SEQ ID NO: 17412 - protein, 81 aa, Phyllostomus discolor
SWQGVTFEDVAVYFSREEWSVLNSTQRSLYRDVMLENFALIVSLGFVPSRSHAVAQVEDKEELQMANMVDMTLVRRAEARR

SEQ ID NO: 17413 - protein, 81 aa, Phyllostomus discolor
AEVGVTFADIALYFSGEEWCLLNEDQRCLYLDVMLDNFELASSLGSCCGAEDVEAPIEQNVPVRVAEAKNLRVALPCWKSH

SEQ ID NO: 17414 - protein, 81 aa, Phyllostomus discolor
GSVSFTDVTVDFTQEEWEQLEPSQRILYMDVMLENYSNLLSVEVWKADDQMEREHGDPEEQARPFIIFKNQSPVEERSDLF

SEQ ID NO: 17415 - protein, 81 aa, Phyllostomus discolor
MLENYGNLVSVAGYELCKPRVISKLEKGEEPWISEKEGPGHHSSDLKSKTETYMSTAKNDILQEELYQGIMTERFMRDDVI

SEQ ID NO: 17416 - protein, 81 aa, Phyllostomus discolor
SPRRPAEVGMTFADIALYFSREEWRLLNEAQRRLYLDVMLENFELVSSLGNAFTVPVVWTRLCISLYPLFSRGYSLLIRGL

SEQ ID NO: 17417 - protein, 81 aa, Phyllostomus discolor
GIRTASCWDISMDFTWEEWQLLDSAQKYLYRDVILENYRNLVSVGYHGTKPDLIFKLEQGEEPWIRNAKISRPRCSEGWKE

SEQ ID NO: 17418 - protein, 81 aa, Phyllostomus discolor
MYFSRTEWCLLGEAQRCLYLEVMLENYALISSLGCCCGTEEVEAAIQENVSAGDSKAKNIKSALSSQKSHPCESCGFILKD

SEQ ID NO: 17419 - protein, 81 aa, Phyllostomus discolor
TARSQASMTFKDVAMDFTPEEWGKLDPAQRNVMLENYRNLVSLWLPVSKPENYNLESGKDPLMLEKKVPKSSYSELESRPE

SEQ ID NO: 17420 - protein, 81 aa, Desmodus rotundus
VQESVTFKDVVVDFTQEEWKQLDPVQRDLFRDVTLENYTHLVSIGLQVSKPDVIFQLEQGTEPWIVEPGIPVGGSGDWETR

SEQ ID NO: 17421 - protein, 81 aa, Desmodus rotundus
QEPVTFRDVAVDFTREEWGQLGPAQRTLYRDVMLETFGHLLSVGPELPKPDVISQLEQGAELWMVERGIAQGRCPGWEPGP

SEQ ID NO: 17422 - protein, 81 aa, Desmodus rotundus
RAAWAKKPVTFEDVAVNFTQEEWESLDARQRVLYQDVMSETFKNLVSVDLITKLEQEEKQWRADLCPPNGEGLSSGGKKEE

SEQ ID NO: 17423 - protein, 81 aa, Macaca fascicularis
EPLTFRDVAIEFSPEEWKCLDPAQQNLYRDVMLENYRNLVSLAVCSYFTQDFLPVQGIEDSFHKCILRRYEKFSSLFSSCH

SEQ ID NO: 17424 - protein, 81 aa, Macaca fascicularis
LGPVTFEDVAVLFTEAEWKRLNLEQRNLFKEVMLENLRNLVSLAESKPEVHTCPSCPLAFGSQQFLSQDELHNHPIPGFHA

SEQ ID NO: 17425 - protein, 81 aa, Macaca fascicularis
SQASVSFQDVTVEFTQEEWQHLGPVERTLYRDVMLENYSHLISVGYCITKPKVISRLEQGEEPWSLEDEFLNQKHQGYFKV

SEQ ID NO: 17426 - protein, 81 aa, Macaca fascicularis
FQELVTFRDVAIDFSQQEWEYLDPNQRDLYRDVMLENYRNLVSLGGHSISKPVVVDLLEQGKEPWMILREETQFTDLDLQC

SEQ ID NO: 17427 - protein, 81 aa, Macaca fascicularis
QGLLTFRDVAIEFSQEEWKCLDPAQRTLYRDVMVENYRNLVSLDISSKCKMKEFLSTAQSNREVFHTGTLQRHESHQIGDY

SEQ ID NO: 17428 - protein, 81 aa, Macaca fascicularis
VHGSVTFRDVAIDFSQEEWECLQPDQRTLYRDVMLENYSHLISLGSSISKPDVITLLEQEKEPWMVVRKETSRWYPDLESK

SEQ ID NO: 17429 - protein, 81 aa, Canis lupus
MLQTTGLIGEFFQEEWDYLDPAQRSLYKDVMMENYGNLVSLDVLNRDKDEEPTVKQEIEEIEEEVEPQGVIVTRIKSEIDQ

SEQ ID NO: 17430 - protein, 81 aa, Muntiacus muntjak
LSLTFEDVAIYFSEQEWQNLEAWQKELYKQVMRANYEILLSLDNGLPKPELISWIEQGKELFKKWGESQESRSIICSSADL

SEQ ID NO: 17431 - protein, 81 aa, Muntiacus muntjak
CYSASVSFKDVTVEFTQEEWHQMDSAQRTLYRDVMLEIYSHLVSVVMQKKKKLCSRLPSPESWWNIFIIPPNSLYPFAVII

SEQ ID NO: 17432 - protein, 81 aa, Muntiacus muntjak
FILTFKDVAIEFTQEEWECLDPAQRALYRDVMVETLRNLVSLDISHMHVIKKLQLNANIYRGEGFQTVILGRHKRNKIEDF

SEQ ID NO: 17433 - protein, 81 aa, Canis lupus
TQGCVISEDVFVYFSWEEWMLLDDSQRLLYQDVMLENFALLASLGIASSRSHLVTQLNPREDPQMPEQVNMNPATEREAQK

SEQ ID NO: 17434 - protein, 81 aa, Muntiacus muntjak
LPGSSVHGDVAIDFTQEEWECLDLGQRELYTDVMVENYRNLASLGLVISKPDLVTFLEQMKDLRNIRRMQTAGIYPGRREW

SEQ ID NO: 17435 - protein, 81 aa, Gorilla gorilla
AQERVTFRDVAVFFSQDEWLHLDSAQRALYREVMLENYSILVSLGIPFSMPKLIHQLQQGEDPCMVEREVPSDTCLGFKTW

SEQ ID NO: 17436 - protein, 81 aa, Gorilla gorilla
VTFEDVTIIFTWEEWKFLNSSQKRLYREVMWENYTNVMSVENWNESYKSQEEKFRYLEYENFSCWQGWWNAGAQMYENQNY

SEQ ID NO: 17437 - protein, 81 aa, Gorilla gorilla
YQGSVTFEDVAIAFSQQEWESLDSSQRGLYRDVMLENYRNLVSMAGHSLSKPHVIALLEQWKEPEVTVRKDGRRWCTDLRL

SEQ ID NO: 17438 - protein, 81 aa, Ailuropoda melanoleuca
QGRLTFRDVAIEFSQEEWECLDPAQRALYRDVMLENYRNLVSLGIPLPDLNSIFILEQGKEPQTVESKVKTVKKPNGFQSH

SEQ ID NO: 17439 - protein, 81 aa, Ailuropoda melanoleuca
ERVLVSFEDVAVFLSREEWGCLGPAQRGLYRDVMLETYRNLISLAGFQDSKPDVISKLEKGEEPWAPYSPRIEECSKGYGH

SEQ ID NO: 17440 - protein, 81 aa, Ailuropoda melanoleuca
KQGGVTFEDVAVYFSQEEWSLLNEAQRRLYHDVMLENFALISSLGCCCRAEAVETPFEQSISVGVSQAKTPKEPRSSQKTH

SEQ ID NO: 17441 - protein, 81 aa, Gorilla gorilla
PHLLVTFRDVAIDFSQEEWECLDPAQRDLYRDVMLENYSNLISLEPARTHKEQHNLPVPKAGSVNLAAGFGHSRSQTGCGS

SEQ ID NO: 17442 - protein, 81 aa, Gorilla gorilla
IQGPLTFGDVAVAFTRIEWRHLDAAQRALYRDVMLENYGNLVSVGLLSSKPKLITQLEQGAEPWTEMREAPSGTHAAQDCW

SEQ ID NO: 17443 - protein, 81 aa, Gorilla gorilla
MFKEAVTFKDVAVAFTEEELGLLGPAQRKLYRDVMVENFRNLLSVGHQPFKQDTSPIERNEQLWIMTTATRRQGNLDTLLV

SEQ ID NO: 17444 - protein, 81 aa, Gorilla gorilla
GPVSFKDVAVDFTQEEWQQLDPDEKIAYGDVMLENYNHLVSVGYDYHQAKHHHGVEVKEVEQGEEPWIMEGEFPCQHSPGK

SEQ ID NO: 17445 - protein, 81 aa, Gorilla gorilla
TGLLAFSDVVIEFSPEEWACLDPAQRNLYRDVMFENYRNLVSLAILCYSIQDLLPEQDMKDLCQKVTLTRHRSWGLDNLHL

SEQ ID NO: 17446 - protein, 81 aa, Lynx canadensis
SQGSVTFRDVAIDFSQEEWEWLQPTQRDLYRHVMLENYSHLVSLGLNISKPYVVSLLEQGKEPWLEKRGVRRNLFSEPNRE

SEQ ID NO: 17447 - protein, 81 aa, Lynx canadensis
MLENYNNLVSVGNCIFKPAVIFKLEQGEEPWFLEEEFLNQSHQEDYRDDYLIKRNKKIKDNYFQEVISIDNKLLTGEEEEI

SEQ ID NO: 17448 - protein, 81 aa, Lynx canadensis
KPGAVSFADVAVYFSPEEWGCLRPAQRALYRDVMRETYGHLGALGFRGTKPALISWVEEEADLWGPDARDPEVGECLTAAD

SEQ ID NO: 17449 - protein, 81 aa, Lynx canadensis
MYFSQEEWEFLDPTQEALYNDVMRENYETVISLALFVLPKPKVISYLEQGEEPWVQGSTELKDSPGELPTGIKHKSDTENH

SEQ ID NO: 17450 - protein, 81 aa, Lynx canadensis
LQEAVVFEDVAVYFTRIEWSCLAPDQRALYRDVMLENYGHVASLGFLVAKPALISLLEQGEEPGALILQVAEEQGTVANLC

SEQ ID NO: 17451 - protein, 81 aa, Lynx canadensis
MDFTQEEWALLKPAQKKLYKDVMLETFRNLVTVDDENQLRTNGSTSQQVIFGEKLSNEQKIARFTKNDSWTSLFGENWENQ

SEQ ID NO: 17452 - protein, 81 aa, Lynx canadensis
KFKETETFKDVAVVFTEEELVLLDKAQIHLYQDVMLENFRNIVSVGEDNNPLVFQLEHKGKLWPLERKPEGCADKIPEVSE

SEQ ID NO: 17453 - protein, 81 aa, Lynx canadensis
SQGPVSFRDVAVDFTQEEWQQLEPEEKTTYRDVMLENYSHLVSVGYDSTKPKVILKLEQGEEPWVVEGDLPCRSRPEVWKV

SEQ ID NO: 17454 - protein, 81 aa, Phyllostomus discolor
GSVSFADVAVYFSSEEWGCLRPAQRALYRDVMRETYGHLGALGDSPNNKEEEPKELPGATGPRKTPGKHRPEELVKHNPDS

SEQ ID NO: 17455 - protein, 81 aa, Phyllostomus discolor
EAVTFGDVAVHFSREEWQCLDPGQRALYKEVMLENHSSVAGLDSAISTDGGQAHEDVYILKSESLAAMVKTPPRDSPQSPC

SEQ ID NO: 17456 - protein, 81 aa, Phyllostomus discolor
AQESLTLEDVAVDFTWEEWQLLDPDQKGLYKDVMLENYRNLVSLGYQVSKPDVLSKLELGEEPWTTEDELHSLVCPDTDKV

SEQ ID NO: 17457 - protein, 81 aa, Phyllostomus discolor
AEGCVVLEDVAIHFSQEEWRLLDEVQRCLYHSVMLENLALLSSIGCWPGAQEEEVPSGQGDSVGVSQVQTPSQDPCTQLSH

SEQ ID NO: 17458 - protein, 81 aa, Phyllostomus discolor
AQDSVTFEDVSIYFSQEEWGLLDEAQRLLYCDVMLENFALTASLGLTSFRSHIVAQLEMGAEPWVPDRVDMSSAMARGAYN

SEQ ID NO: 17459 - protein, 81 aa, Muntiacus muntjak
LWGPVTFKDVTVEFTQEEWKLLDTAQRTLYREVMQENYSHLISVGYCANRPNAIFKLKQGKEPWILEVQFPRQNNPKDVCN

SEQ ID NO: 17460 - protein, 81 aa, Muntiacus muntjak
GLLSFEDVALYFTREEWDTLDWAQKALYRDVMLDNYRHIVSLGFPFPKPEVICQLEQWEEPWILDLPRAGTRKASGSACPD

SEQ ID NO: 17461 - protein, 81 aa, Crocuta crocuta
AILREFVTHRDVAMDFTLEDWEQLGLDQGDLFWDTALDNYQNLFLLNPCKPKLTCPDGGEELEAVARESPESEGLDVAEVK

SEQ ID NO: 17462 - protein, 81 aa, Ailuropoda melanoleuca
QESVTFKDVAVDFTQEEWGQLDSPQRALYRDVMLENYQNLLALGPPVCKPDVISHLERGEEPWWMPREVPGGACLEGEPGP

SEQ ID NO: 17463 - protein, 81 aa, Gorilla gorilla
PVTFRDVTVIFTEAEWKRLSPEQRNLYKEVMLENYRNLLSLDGVSLLLPRLECSRALCLPGSSNSPATASRVAGITAEPKP

SEQ ID NO: 17464 - protein, 81 aa, Ailuropoda melanoleuca
LFTTGLLFSKPKVISLLQQGEDPWKVEKESPGGPSLGYKSTPKTTKSTQTQDSSFQGLRRKRLKRDEPWNFISEKPCIYED

SEQ ID NO: 17465 - protein, 81 aa, Ailuropoda melanoleuca
TVGSVMFSDVSVDFSQEEWECLDPGQRDLYRDVMLENYSNLLSMGLYIPKPQVISLLEQGKEPWMVGRELTRGLCSDLESM

SEQ ID NO: 17466 - protein, 81 aa, Ailuropoda melanoleuca
SVMFSDVSVDFSQEEWECLDPGQRDLYRDVMLENYSNLLSMGKGFYTRLYIPKPQVISLLEQGKEPWMVGRELTRGLCSDL

SEQ ID NO: 17467 - protein, 81 aa, Lynx canadensis
MLENYRNLVSVEHQLSKPDVVSQLEEEEALWSVERGIPQDTFSECPAAQLDPQVDPLPAGNPLMKIEVVEVLTLNQEVARP

SEQ ID NO: 17468 - protein, 81 aa, Ailuropoda melanoleuca
FQGSVSFEDVTVGFTQEEWEHLDPVQRSLYRDVMLENYSHLVSVGYCVTKPEVIFRLEQGEEPWILEEEFPSWSFPEIWET

SEQ ID NO: 17469 - protein, 81 aa, Lynx canadensis
WQGSVTFEDVALYFSWEEWDLLDEDQRCLYHDVMLENFALTSSLGCGHGVDDEDVPLEESISVGVSQIRTLEADSSPQKAQ

SEQ ID NO: 17470 - protein, 81 aa, Lynx canadensis
SQGLLSFGDVTVGFTEEEWQRLDPAQRTLYRDVMLENYSHLVAVGLSIPKPEVILKLEQGEEPWILDSPGQSDPELINSSR

SEQ ID NO: 17471 - protein, 81 aa, Lynx canadensis
SKVPVTFGDLAIYFSQEEWEWLSPIQKDLYEDVMLENYQNLVSLGLSFRRPNVITLLEKGRAPWMVEPVRKRRGLDSRSKY

SEQ ID NO: 17472 - protein, 81 aa, Lynx canadensis
RPRAVKFADVAVYFSTEEWGCLRPAQRALYRDVMRETYGHLGALGFRGTKPALISWVEEEADLWGPDARDPEVGECLTAAD

SEQ ID NO: 17473 - protein, 81 aa, Phyllostomus discolor
MMETYRNLVFVAGQQATKPDLILKMEVEEPYLAEDKIPIWSCPEEACQVEQIERQHQDDEDKYLLMQIGFPNKNAITTKGE

SEQ ID NO: 17474 - protein, 81 aa, Phyllostomus discolor
QDSVVFEDVAVDFSQEEWALLDIAQRSLYREVMLENFQNLASLGFETQLKSSASVISQNNYGEKISDEQKIVRFKRNDSWS

SEQ ID NO: 17475 - protein, 81 aa, Phyllostomus discolor
KSQESLTFQDVAVDFTREEWDQLYPAQKNLYRDVMLENYRNLVALGHQLHKPEVIIQLEEEEQWMMERDGPLDTHPDGENR

SEQ ID NO: 17476 - protein, 81 aa, Phyllostomus discolor
AQASVTFKDVAVTFTQDEWGHLNLAQRTVYREVMLETYRLLVSLGYRVPKSELIHLSEHLSRESACPGAKAKSETTELTFS

SEQ ID NO: 17477 - protein, 81 aa, Phyllostomus discolor
KSQESLSFTDVFVPFTWEEWQLLDPAQRHLHRSVMLENYSNLAFLGYQPTKPDIIFQLEHGELWMMQAQVASPGHSVPRSL

SEQ ID NO: 17478 - protein, 81 aa, Desmodus rotundus
QKSVTFEDVAVYFTPTEWDGLSPAQRALYRDVMLENYGNVASLGFPLLKPAVISQLEGGGELGSPSLLAAGVGSDPPGLWT

SEQ ID NO: 17479 - protein, 81 aa, Nomascus leucogenys
MELLTFRDVAIEFSPEEWKCLDPAQQNLYRDVMLENYRNLVSLAVYSYYKQGIVPKQGIEDSFKKATLGRYGSCGLENICL

SEQ ID NO: 17480 - protein, 81 aa, Bos indicus
MFQDVAIDFTQEEWECLDLSQRELYRDVMLENYGNLASLGLVSKLDLVTFLEQLEDPRNIRRMGTTAIYPAMSPQDTQDLM

SEQ ID NO: 17481 - protein, 81 aa, Bos indicus
LQESVTFRDIAVLFSRDEWLHLDAAQRTLYREVMLENYSTLVSLGIPFSMPKLICQLQQGEDPCMVEREVPQDTCLGFKIW

SEQ ID NO: 17482 - protein, 81 aa, Bos indicus
FKEAVTFKDVAVVFTEEEMGLLDLAQRKLYQEVMLENFRNLLSVGHQSFTPDVPSQLEREEKLQMIKTAAQSCCSSGNQNL

SEQ ID NO: 17483 - protein, 81 aa, Bos indicus
RLTSKDVAIEFTQEEWEFLDPAQRALYRDVMLETYRNLLSVDISPTHVIKHLQPKANSDKREIFQTLMLGRPESCEIKHFH

SEQ ID NO: 17484 - protein, 81 aa, Canis lupus
AQDSVTFEDVAVYFSWEEWGLLDEAQRHLYHDVMLENFALVTTLGYWHGAEDEEAPSEQDASVEVSQVRTHHVGPYPKKTH

SEQ ID NO: 17485 - protein, 81 aa, Gorilla gorilla
PQASVCFEDVAMAFTQEEWEQLDLAQRTLYREVTLETWEHIVSLGLFLSKSDVISQLEQEEDLCRAEQEAPRGTSGLSQVT

SEQ ID NO: 17486 - protein, 81 aa, Ailuropoda melanoleuca
VTFTDVAVNFTREEWALLDSAQRILYRDVMLENCRNLASVDLVTQHKAKNSIHQQDILARKTPDEANRVCAVSHSSRSSPS

SEQ ID NO: 17487 - protein, 81 aa, Ailuropoda melanoleuca
SQGSLSFRDVTVGFTQEEWQHLDPAQRSLYRDVMLENYSHLVSLGYSISKPEVILKLEQGEEPWILEEEFPSQSDPGELMA

SEQ ID NO: 17488 - protein, 81 aa, Gorilla gorilla
KPGAVSFADVAVYFSREEWGCLRPAQRALYRDVMRETYGHLGALGVGGSKPALISWVEEKAELWDPAAQDPEVAKCPTEAD

SEQ ID NO: 17489 - protein, 81 aa, Ailuropoda melanoleuca
LQVCVISEDVFVCFSREEWMLLDDSQRLLYQDVMLENFALLASLGIASSRSHLVTQLEQREDPRMPDQSTIKRRLASGTWQ

SEQ ID NO: 17490 - protein, 81 aa, Ailuropoda melanoleuca
PQKSVTFEDVAVYFTQTEWDGLSPAQRALYRDVMLENYGNVASLGFSLLKPAVISQLEGADELEGPSPLVAGTEIGPQGLW

SEQ ID NO: 17491 - protein, 81 aa, Ailuropoda melanoleuca
ELVTFRDVAIDFSRQEWEYLDPIQRDLYRDVMLENYRNLVSLAGHSISKPDVVDLLEQGKEPWIILREETQRQYTGKEDKE

SEQ ID NO: 17492 - protein, 81 aa, Ailuropoda melanoleuca
VQNSITFEDVAMDFTQEEWALLNSRQRKLYRDVMLENYRNLASLEKQLSKPTLITQMEQEDEMKTETGSHQDILEPFLKKR

SEQ ID NO: 17493 - protein, 81 aa, Ailuropoda melanoleuca
VTFEDVAVYFSWKEWRLLDEAQRRLYHRVMLENFTLISSLGCCCGAEGEEAPFAQGTSVGASQAGTPTAAVSSRKTHPCEM

SEQ ID NO: 17494 - protein, 81 aa, Ailuropoda melanoleuca
VHSVVFEDVAVDFTLDEWALLDSMQKNLYRDVMLETFQNLVSVDYETLFKASGLVSQQDRHEEKKPNEQKMEKFTRNHSCA

SEQ ID NO: 17495 - protein, 81 aa, Ailuropoda melanoleuca
NRGLLTFRDVAIEFSQEEWGCLSHTQRELYRDVMLENYGHLLFSGLIVWKPDLVIFLEQEKQLWDVKRKETVAFHPAISSN

SEQ ID NO: 17496 - protein, 81 aa, Gorilla gorilla
QGLLTFRDVTIEFSQEEWKCLDPAQRALYRDVMLENYRNLVSLDISSKCMLKTLSSTGQDNTEVFHTGTLHRQASHHTGEF

SEQ ID NO: 17497 - protein, 81 aa, Ailuropoda melanoleuca
CWGLLSFKDISMEFTWEEWQLLDSTQKYLYRDVILENYSHLVSLGYHGTKPDLIFKLEQGEEPWIINAKVSRQSYPEGWKE

SEQ ID NO: 17498 - protein, 81 aa, Lynx canadensis
SQEQVSFKDVCVDFTQEEWYLLDPAQKILYRDVILENYSHLVSVGYCFTKPEVVFKIEQGEEPWILEAGFPSHCHQEDWKV

SEQ ID NO: 17499 - protein, 81 aa, Lynx canadensis
MLVTFDDVAVTFTQEEWGQLDPAQRTLYQEVMLETCRLLVSLGCPLPKPEQIYPLERSPELWTLQRGLSSSNCPGDNVKPE

SEQ ID NO: 17500 - protein, 81 aa, Lynx canadensis
CEGSVSFEDVTVDFSREEWQQLDSTQRRLYQDVMLENYSHLLSLGYEVPKPEVIFKLEQGEEPWILERKTPHQSCSDGRLG

SEQ ID NO: 17501 - protein, 81 aa, Lynx canadensis
SQGLLTFRDVAIELSQEDWECLNLSQWDIYRDVMLENYRILLFLGLIMTTPDLITFIEQNNEPWKVKRKETSDAQLSHPGT

SEQ ID NO: 17502 - protein, 81 aa, Lynx canadensis
EKDSVTFKDVAIDFSLEEWRLMDLSQRNLHKDVMLENYRNLVSLGLAVSKPDMISHLEDGKGPWVVVREIARTPYPELETK

SEQ ID NO: 17503 - protein, 81 aa, Phyllostomus discolor
PVTFKDVAVVFTEEELGLLDPSQRMLYQDVTLENLRNLVYVGHWNQNEIDSLQEVALSYLLHEDVVCWQIWDQLRSKLTRN

SEQ ID NO: 17504 - protein, 81 aa, Phyllostomus discolor
SLGPVLFRDVAVDFTQEEWQQLDPEQKTTYRDVMLENYSHLVSVGCHAVKPEVIVKLEQGEEPWVEGELPSPRWPDAWKVD

SEQ ID NO: 17505 - protein, 81 aa, Phyllostomus discolor
VQVVVTFEDVAVYLSRTEWCLLDEAQRRLYLDVMLENFAHVSSLGCCCGAEDVEAPTEQKLSEQVSQEKYPKAALSSQKGH

SEQ ID NO: 17506 - protein, 81 aa, Phyllostomus discolor
AVTFKDVAVVFTEEELGLLDPSQRKLYRDVMLENFWNLVSLGDKNGKEMEYIQERELKFLSCRELSYWKIWEQAAGELTGS

SEQ ID NO: 17507 - protein, 81 aa, Phyllostomus discolor
MFGDLTVYFSLKEWEGLSPIAKDLYRDVTLENYQHLVSLRKDFSYQRPNVTTLLEKGIASWMEPVRRRRGLDSEFKCKTKK

SEQ ID NO: 17508 - protein, 81 aa, Phyllostomus discolor
MAPAQRRLYRDVMLENYSNLVSLGYQVSKPEVIFKLEQGEEPWLSEGEIQRSFCPDWKTMPEAKPSNLQQSISEVSPRTDD

SEQ ID NO: 17509 - protein, 81 aa, Phyllostomus discolor
AKEPFSFEDLSVDFTQKEWQLLDPSQKDLYKDVMLENYSSLVALGYEFMKPDVIFKLEQGEEPWIGDGEVPSSESPEQVLQ

SEQ ID NO: 17510 - protein, 81 aa, Phyllostomus discolor
EAVPLTFQDVAVYFSQEEGQQLGPDQRALYRDVMLENYGHVASLGLPVPKPELISQLEQGEELWVLDLMGPEDLEPLSSCS

SEQ ID NO: 17511 - protein, 81 aa, Phyllostomus discolor
AEASVTFEDVAVHFSWEEWRLLDEAQRHLYLDVMLENFALTSSLGCCSGPEDVEALFEQSSSVGVSQASTSRAALSSLKTH

SEQ ID NO: 17512 - protein, 81 aa, Ailuropoda melanoleuca
VTFEDVAVYFSWKEWRLLDEAQRRLYHRVMLENFTLISSLGCCCGAEGEEAPFAQGTSVGASQAGTPTAAVSFWKTHPCEM

SEQ ID NO: 17513 - protein, 81 aa, Ailuropoda melanoleuca
CVISEDVFVCFSREEWMLLDDSQRLLYQDVMLENFALLASLGIASSRSHLVTQLEQREDPRMPDQVDMTPATEREAQKGLG

SEQ ID NO: 17514 - protein, 81 aa, Ailuropoda melanoleuca
LQGSLTFGDVAVSFTQFEWKHLDATQQALYRDVMLENYGNLVFVGLLSSKPKLITQLEQGAEPWMEVQQITSDTCSVQEYW

SEQ ID NO: 17515 - protein, 81 aa, Gorilla gorilla
EMRLLTFRDIAIEFSLEEWQCLDCAQQNLYRDVMLENYRNLVSLGIADSKPDLITCLEQNKEAWNIKRNEMVAKHPVTCSH

SEQ ID NO: 17516 - protein, 81 aa, Gorilla gorilla
RQEPVTFEDVAVYFTQNEWASLDSVQRALYREVMLENYANVASLAFPFITPVLVSQLEQGELPWGLDPWEPMGREALRGIC

SEQ ID NO: 17517 - protein, 81 aa, Lynx canadensis
MLENYRNLVWLGLSISKPNMISLLEQGKEPWMVEKEMSDGQYADWESWYEIKELPPKWYIDEEEISQGMVMERLTSYNLEY

SEQ ID NO: 17518 - protein, 81 aa, Lynx canadensis
AQGCVTFEDVTIYFSQEEWGLLDEAQRLLYCDVMLENFALIASLGLTSFRSHIVARLEMGAEPWVPDRVDMTSAMARGAYG

SEQ ID NO: 17519 - protein, 81 aa, Phyllostomus discolor
PKVPVTFDDVAVYFSELEWSRLDEWQKELYKHVMRGNYEMLVSLDYAISKPDILARMERGEEPCPEGLWGQDEGQEREAAR

SEQ ID NO: 17520 - protein, 81 aa, Phyllostomus discolor
MLEIYSHLFSVGYHIPNPEVIFRMEKDKELWIGEAELPHQRHQEMKFVLNTPQQDISGTASFHDMAGKVTRDGSWYSILAE

SEQ ID NO: 17521 - protein, 81 aa, Phyllostomus discolor
QGCVTFEDVALYFSWEEWELLDETQKCLYQDVMLENFALTSSLGCWSGVEGDDVPSEQSIYLEGASQSRTFKAGSDLQKIQ

SEQ ID NO: 17522 - protein, 81 aa, Phyllostomus discolor
IKWLVTFRDVAIDFSQEEWDYLDPAQRDLYRDVMMENYSNLVLLGLSISKPDVISLLEQGKEPWMQRNLEGGWCPGLEFGC

SEQ ID NO: 17523 - protein, 81 aa, Desmodus rotundus
PQVKVTFEDVAVLLSQEEWDQLGPAQRGLYRHVMMETYGNVVSLGLPGTKPNVISQLERGEEPWVLEGHGAKESKGLDSSG

SEQ ID NO: 17524 - protein, 81 aa, Desmodus rotundus
QVSVTFEDVAVLFTRDEWRKLRPSQRSLYQDVMLENYHHLVSLGLPFSKPQVISLLQQGEEPWKAEEGRPGGSCPGPGWKS

SEQ ID NO: 17525 - protein, 81 aa, Macaca fascicularis
VTFEDVTIVFTWEEWKFLDSSQKRLYREVMWENYTNVMSVENWNKSYKSQEEKFRYLEYENFSCWQGWWNAGAQMCENQNY

SEQ ID NO: 17526 - protein, 81 aa, Desmodus rotundus
SVTFEDVAVYFSRTEWRLLDEAQRRLYLDVMLENFGLISSLGCCCGAEDVEAPTEQSVSLRVSKAKNPKTALSSQKSHPCE

SEQ ID NO: 17527 - protein, 81 aa, Desmodus rotundus
SQMPVTFEDVALYLSREEWGRLDHPQQSFYRDVLQKRNGLALGVAEVRKEEPTSSPAVPGDGKSFRTRAGRAQEDVLQCGR

SEQ ID NO: 17528 - protein, 81 aa, Macaca fascicularis
QGTVTFEDVAVHFSWEEWGLLDEAQRCLYRDVMLENLALLTSLDVHHRKQHLGEKHFRSNVGTALFVKTCTFHVSGEPSTC

SEQ ID NO: 17529 - protein, 81 aa, Macaca fascicularis
ASRYFTERDVAIEFSPEEWKCLDPAQQNLYRDVMLENYRNLVSLGVAISNPDLVTCLEQRKEPYNVKIRKIVARPPAVRSH

SEQ ID NO: 17530 - protein, 81 aa, Macaca fascicularis
HLTFMDVAIEFSQEEWKCLDPGQRALYRDVMLENYRNLVSLGRSCILGSNAENKPIKNQLGFTLESHLSELQLFEAGRKIF

SEQ ID NO: 17531 - protein, 81 aa, Macaca fascicularis
QESLTLRDVAVDFSWEEWQLLGPAQKHLYRDVMLENYSNLVSVRFQASKPDALTKLEQGEPLWALEDEIHSPTHPEIEKAD

SEQ ID NO: 17532 - protein, 81 aa, Ruminococcus albus 8
FNDSDAPQPFTENDVVYVIYDIPTDRSLWQESLTANSMYYRDVDLNDESSVVALSTCASDYEGARALFAGKLTWIKEIDIH

SEQ ID NO: 17533 - protein, 81 aa, Pan troglodytes
EPGAVSFADVAVYFCREEWGCLRPAQRALYRDVMRETYGHLGALGCAGPKPALISWLERNTDDWEPAALDPQEYPRGLTVQ

SEQ ID NO: 17534 - protein, 81 aa, Sapajus apella
MDVAIEFSLEEWQCLDTAQKNLYRTVMLENYRNLVFLGVSVSNLDLITCLEKGKEPWNMKRYKMGAKPQVLSYFPKDLWLE

SEQ ID NO: 17535 - protein, 81 aa, Ursus maritimus
HGSTPFSNVTVAFTQDGWKHLIPAPRGTPKFMEGIPENARNLVLLGLPVSQPDMNSQLEQREEGPWMLEGGGLRSTCPDWK

SEQ ID NO: 17536 - protein, 81 aa, Ursus maritimus
MDSVVFEDVAVDFTLDEWALLDSMQKNLYRDVMLETFQNLVSVDYETLFKASGLVSQQDRHEEKNPSEQNMAKFTRNHSCA

SEQ ID NO: 17537 - protein, 81 aa, Acinonyx jubatus
PCRLVLFKDVAIDFSQEEWECLDLEQKDLYRDVMLENYNNLVSLAGFSISKTDVLSLLKQGKEPWKVVQDVTRSQSSAWES

SEQ ID NO: 17538 - protein, 81 aa, Acinonyx jubatus
WLQGPVTFKDVAGEFTQGWMMLDSAQRRIYRDVMLGSYINLISVEYQLQKPTVISLLGKEEIRTMRKRGDWAPIQSSKFNL

SEQ ID NO: 17539 - protein, 81 aa, Rhinopithecus roxellana
FQEVVTFGDVAVHFSREEWQCLDPGQRALYREVMLENHSSVAGLAGFLVFKPELISRLEQGEEPWVLDLQGAEGTETPSQR

SEQ ID NO: 17540 - protein, 81 aa, Rhinopithecus roxellana
TQESLTLEDVAVEFSWEEWQLLDTAQKNLYRDVMVENYNHLVSLGYQTSKPDVLSKLAHGQEEPWITVAKIQNKNCPGIGK

SEQ ID NO: 17541 - protein, 81 aa, Acinonyx jubatus
LQGSLSFEDVTVGFSQEEWQRLDPAQRTLYRDVMLENYSHLVAVGCCVPKPDVIFRLEQGQQPWLVEEESLDQSCPEVCRV

SEQ ID NO: 17542 - protein, 81 aa, Rhinopithecus roxellana
DSVTFEDVAVDFTQEEWTLLDQTQRNLYRDVMLENYKNLVAVDWESHINTKRSAPQQNFLQGKTSSVVEMERNHFGEELFD

SEQ ID NO: 17543 - protein, 81 aa, Rhinopithecus roxellana
DSVVFEDVAVDFTLEEWALLDSAQRNLYREVIFEMWERTKTQFKANGSVSQQDMYGEEKSKERTVPNFTRKNSCAYTLEKT

SEQ ID NO: 17544 - protein, 81 aa, Bison bison
WGSLVAFEEVAMHFSREEWELLDEAQRQLYHTVMLETLELVTSLGCWPVVEDEEVPSEKNASGEVVSQVKTPSVPPSMQKA

SEQ ID NO: 17545 - protein, 81 aa, Rhinopithecus roxellana
AQESITLEDVAVDFTWEEWQLLGPAQKDLYRDVMLENYSNLVAVGYQASKPDVFFKLEQGEPPWTTEDGIHSGACSEIWKV

SEQ ID NO: 17546 - protein, 81 aa, Bison bison
ENKSGMTLSQTQLTVEDVDIKFTPEEWECLDPAQRALYWDVMEETYRNLLSVAGSLPLSHKEVPKACSFTCILELMNRGIP

SEQ ID NO: 17547 - protein, 81 aa, Bison bison
FQDTVTFKDVAIDFTQEEWKQLDPAQRNLYRNVMLENYNNLITVGCPFTKPDVIFKLEQEEEPWVMEEEVLKKHCPGEIWG

SEQ ID NO: 17548 - protein, 81 aa, Cebus imitator
PQESVAFEDVAVYFTKKEWAIMVPDQRALYCVMLENCDAVALVAVPPTSRLALVSHLEQGEEPCFTQPQGVLSRRGWRAGF

SEQ ID NO: 17549 - protein, 81 aa, Cebus imitator
TGGDVTFSDVAIHFSHEEWGWLDSAQRDLYKDVMVQNYKILVSLGLSITKPYVITLLEDGKEPWMMEEKLSKDWESRLENK

SEQ ID NO: 17550 - protein, 81 aa, Cebus imitator
KLLTFRDVTIEFSPEEWKCLDPAQQNLYKDVMLENYRNLVSLGVAISNPGLVTCLEQRKEPFNVKIRKTVARPPAMCSPFT

SEQ ID NO: 17551 - protein, 81 aa, Cebus imitator
TLKEAVTFKDVAVVFTEEELGLLDPAQRKLYRDVMLENFRNVLLVGYQLLHRDTFHFPREEKFWMVETATQREGNLGPVFQ

SEQ ID NO: 17552 - protein, 81 aa, Cebus imitator
MSQVTFSDVAIDFSHEEWGWLDSAQRDLYKDVMVQNYENLVSLGLSITKPYVITLLEDGKEPWMMEKNLSKGVTPDWESRW

SEQ ID NO: 17553 - protein, 81 aa, Macaca mulatta
KEKLVTFEDVAVYFTQAEWDGLSPAQRTLYRDVMLENYGNVASLGFPLLKPAVISQLEGGGELGGPSPLAAGTGLWGLRTG

SEQ ID NO: 17554 - protein, 81 aa, Macaca mulatta
MGPLTFRDVTVEFSLEEWQCLDTAQQNLYRDVMLENYRNLVFLGIAVSKPDLITCLEQEKEPWEPMRRHEMVAKPSVMCSH

SEQ ID NO: 17555 - protein, 81 aa, Macaca mulatta
AEGLVMFEDVAVYFSREEWGLLNVTQKGLYRDVMLENFALVSSLGLAPSRSPVFSQLEKDEQLWVPSWVDVTPVSRAEARR

SEQ ID NO: 17556 - protein, 81 aa, Callithrix jacchus
AQESVTFEDVAVNFTDREWQCLTDAQRHLYKDVMLENYGHVVSLGFPFPKPPLISHLERGVEPCVQDPQDTGLSLSCSYPV

SEQ ID NO: 17557 - protein, 81 aa, Callithrix jacchus
KQGQVNFEDVFVYFSQEEWVLLDEAQRLLYRDVMLENFALMASLGHTSFTSHIVASPVMGSDWVDVTPAVTTGTLSGSGPG

SEQ ID NO: 17558 - protein, 81 aa, Macaca mulatta
TFKEGLTFKDVAVVFTEEELGLLDPVQRNLYRDVMLENFRNLLSVGHQPFKQDVSPIERNEQLWIVTTATQRQRNLGEKNQ

SEQ ID NO: 17559 - protein, 81 aa, Monodon monoceros
MATGLLKAKKEVDLDSVELKAEIPFCKPKLISQLERGEEPWIEERQRPPSLCPGSKLEIQPCPSCPLAFSSQQALSQHVWL

SEQ ID NO: 17560 - protein, 81 aa, Callithrix jacchus
GAVSFGDVAVYFSREEWGCLRPAQRALYRDVMRETYSHLSALGESPTCSPGPCAPTSPAAPQGAARGVGVPAAGQAAFPAA

SEQ ID NO: 17561 - protein, 81 aa, Callithrix jacchus
SRSLENDGVCFTEQEWENLEDWQKELYRNVMESNYETLVSLKVLGQPEGEAELGTGMLGDLEEEGPGGAHPAGGVMIKQEL

SEQ ID NO: 17562 - protein, 81 aa, Bos taurus
ATFMVPGQGHVTFEDVAVSFSQEEWGLLGEAQRLLYYDVMLENLSLIASLGKNCIHTHRCAGLGPALCLAHSSLPRLGCGH

SEQ ID NO: 17563 - protein, 81 aa, Bos taurus
HPEPENWLWHKWAGLSPAQRALYRSVMLEIYRSLTSLGYPVPKPALISLLERGDLPVGLETQDNPPAQGTRDIYKNSRTHM

SEQ ID NO: 17564 - protein, 81 aa, Ovis aries
MAMYLTREEWRPLDPTQRDIYRDVMQENYGNVVSLDFEIRSENEVNPKQEISEDVEFEAASERPVGNTEENPESEEAFDNR

SEQ ID NO: 17565 - protein, 81 aa, Ovis aries
EEGQVTFEDVAVYFSWEEWGLLDEAQRLLYHGVMLETFSLMASLGLTSSRNHDMTQLEQRGEPCVPTGGVSTTATAAGCWC

SEQ ID NO: 17566 - protein, 81 aa, Ovis aries
LQDLVTFEDVTVEFTQEEWALLDSSQRKLYRDVMLENCRNLAWLGTGYHVDKRSLISQLEQEDKVITEEGGILPGTCPGER

SEQ ID NO: 17567 - protein, 81 aa, Ovis aries
MLENYANVASLVSPFPRPDLISQLERGEAPWDPDPWETEDLRGICPGGERGIKTEEPAVEQQASEGTEAHGRPVGGLLTNG

SEQ ID NO: 17568 - protein, 81 aa, Ovis aries
SLGSDLFRDVAVVFSQEEWEQLAPTQRDLYRDVMLETYSNLVSLGLAISKPDVISFLEQGKEPWTVEEVATGGLCPVLKSR

SEQ ID NO: 17569 - protein, 81 aa, Ovis aries
AQGSVVFSDVSIDFSQEEWEFLNAAQRDLYRDVMLENYSNLVSMGLYIPKPQVISLLEQGKEPWMIGRELTRGLCSALESM

SEQ ID NO: 17570 - protein, 81 aa, Ovis aries
KGSVTLQDVAVEFTPEEWQLLDCDQRTLFWDVMLENFRNLISVGTGCPVTETTVIFRVEQGQEPWMVEGEDSRWSSPEADC

SEQ ID NO: 17571 - protein, 81 aa, Ovis aries
GQVVVTLKDVAVTFTREEWGQLDLDQRTLFREVMLETCGLLVSLGHPVPKPELIHLLEHGQKLWTGTRGLPHSTGPGDRPK

SEQ ID NO: 17572 - protein, 81 aa, Phyllostomus discolor
WAAWAKKPVTFEDVAVNFTQEEWECLDARQRVFYQDVMSETFKNLVSVDLITKLEQEEKQWRADLCPPNGEGLSSGSKKEE

SEQ ID NO: 17573 - protein, 81 aa, Acinonyx jubatus
PQESVTFKDIAVDFTQEEWALLDASQRKLYRDVMLENIGHLVSVGYRVCKSDVISQLQQGVELWREGRGFPQGVIPDRKSS

SEQ ID NO: 17574 - protein, 81 aa, Rhinopithecus roxellana
EKEPLTFRDVAIEFSLEEWQCLDTAQQGLYRKVMLENYRNLVFLGIAVTKPDLITCLEQGKEPWNIKSHEMVAKPSVICSH

SEQ ID NO: 17575 - protein, 81 aa, Acinonyx jubatus
GYMQGLLTFRDVAIEFSQEEWGCLNHSQRELYMDVMLETYGHLLFLGLVSKPDLVIVLEQEKKLWGVKRKETVALHPGRWK

SEQ ID NO: 17576 - protein, 81 aa, Acinonyx jubatus
LVKIEDVADVAVSFILEEWGHLDQSQKSLYRDDRKENYGSIPSMDYESRNDNVELMVKQISDDAEAHWMTSASTERNVPQS

SEQ ID NO: 17577 - protein, 81 aa, Rhinopithecus roxellana
AQGLVTFADVAIDFSQEEWACLNSAQRDLYWDVMLENYSNLVSLDLESAYENKGLPSEKNIHEIRASKRNSDRRSKSLGRN

SEQ ID NO: 17578 - protein, 81 aa, Rhinopithecus roxellana
MDTVVFEDVVVGFTLEEWALLNPAQRNLYRDVMLETFKHLASVDNEAQPKTSGSISQQDTSGEKLSLKQKIEKFTRKNTWA

SEQ ID NO: 17579 - protein, 81 aa, Rhinopithecus roxellana
SQESLTFKDVFVDFTLEEWQQLNSAQKNLYRDVMLENYSHLVSVGYLVAKPDVIFRLGPGEESWMADGGTPVRTCAGEDRP

SEQ ID NO: 17580 - protein, 81 aa, Rhinopithecus roxellana
FQEMVTFKDVAVVFTREELGLLDPAQRKLYQDVMLENFRNLLSVGYHPFQLDVILQLGKEDKLWLMETEIQGDGCSGLILW

SEQ ID NO: 17581 - protein, 81 aa, Acinonyx jubatus
MLENYRNLVALGHQLYKPEVISQLEQEEQWMMERGSSGDIRAGGENRPDIRKSIPNQNISDENQNHDMIMERLTGDSFWYS

SEQ ID NO: 17582 - protein, 81 aa, Rhinopithecus roxellana
CYQGSVTFDDVAVDFTQEEWTLLDPTQRSLYSDVMLENYKNLATVGGQIIKPSLISWLEQEESRTVRAGVLQGRKTQRRGT

SEQ ID NO: 17583 - protein, 81 aa, Acinonyx jubatus
MLENYSHLVSVGYDSTKPKVILKLEQGEEPWVVEGDLPCRSRPEVWKVDDLIERIPENGDDISRQAVSTNSKTPNEEREDA

SEQ ID NO: 17584 - protein, 81 aa, Rhinopithecus roxellana
EEALMAFRDVAVAFTQKEWKLLSSSQRTLYREVMLENYSHLVSLGIAFSKPKLIEQLEQGNEPWREENEHLLDLCLAQTPS

SEQ ID NO: 17585 - protein, 81 aa, Acinonyx jubatus
CQESVTFEDVAVIFTDEEWRHLVPIQKDLYKEVMLENYKSIVSLGLPVPRPEVIFQLKRGDEPWIVDLHGSEERECPENVS

SEQ ID NO: 17586 - protein, 81 aa, Odocoileus virginianus
SQGLLTFQDVTVDFTQEEWECLDLGQRELYRDVMLENYGNLACLGLVVSKPDLVMFMEQMKDPWDVRRRETAIYPAVSSHD

SEQ ID NO: 17587 - protein, 81 aa, Odocoileus virginianus
GLLSFEDVALYFTREEWDTLDWAQKALYRDVMLDNYRHIISLDLETRFHLKELAPKENTSEDLMLWKMSAVKQKTAKEPSE

SEQ ID NO: 17588 - protein, 81 aa, Odocoileus virginianus
SQRLLTFRDVTIDFTLEEWGCLDLSQQELYRDVMLENYGNLASLGLVVFKPDLVTFMEQRKHLWDVRRMETTATYPVVSSH

SEQ ID NO: 17589 - protein, 81 aa, Odocoileus virginianus
DPEQVTFEDVVVDFTQEEWGHLEPAQRTLYRDVMLETFRLLVSVDLETRPQSKLSTEKQGVTEEIANSALVEGFLQESLWH

SEQ ID NO: 17590 - protein, 81 aa, Odocoileus virginianus
TQLTVEDVDVKFTPEEWECLDPAQRALYRDVMEETYRNLLSVDVSRIDMTMKLQVKGNSGKGEIFQRVIFGRAKTHEIKDF
